(12) United States Patent
Moriarity et al.

(10) Patent No.: US 10,166,255 B2
(45) Date of Patent: Jan. 1, 2019

(54) INTRACELLULAR GENOMIC TRANSPLANT AND METHODS OF THERAPY

(71) Applicants: REGENTS OF THE UNIVERSITY OF MINNESOTA, Minneapolis, MN (US); INTIMA BIOSCIENCE, INC., New York, NY (US); The United States of America, as represented by the Secretary, Department of Health and Human Services, Washington, DC (US)

(72) Inventors: Branden Moriarity, Shoreview, MN (US); Beau Webber, Coon Rapids, MN (US); R. Scott McIvor, St. Louis Park, MN (US); Modassir Choudhry, New York, NY (US); Steven A. Rosenberg, Potomac, MD (US); Douglas C. Palmer, North Bethesda, MD (US); Nicholas P. Restifo, Chevy Chase, MD (US)

(73) Assignees: REGENTS OF THE UNIVERSITY OF MINNESOTA, Minneapolis, MN (US); INTIMA BIOSCIENCE, INC., New York, NY (US); THE UNITED STATES OF AMERICA, AS REPRESENTED BY THE SECRETARY, DEPARTMENT OF HEALTH & HUMAN SERVICES, Washington, DC (US)

( * ) Notice: Subject to any disclaimer, the term of this patent is extended or adjusted under 35 U.S.C. 154(b) by 0 days.

(21) Appl. No.: 15/224,151

(22) Filed: Jul. 29, 2016

(65) Prior Publication Data
US 2017/0130200 A1    May 11, 2017

Related U.S. Application Data

(60) Provisional application No. 62/199,905, filed on Jul. 31, 2015, provisional application No. 62/232,983, filed on Sep. 25, 2015, provisional application No. 62/286,206, filed on Jan. 22, 2016, provisional application No. 62/295,670, filed on Feb. 16, 2016, provisional application No. 62/330,464, filed on May 2, 2016, provisional application No. 62/360,245, filed on Jul. 8, 2016.

(51) Int. Cl.
| | |
|---|---|
| C12N 5/10 | (2006.01) |
| C12N 15/90 | (2006.01) |
| A61K 35/17 | (2015.01) |
| C07K 14/47 | (2006.01) |
| C07K 14/725 | (2006.01) |
| C12N 5/0783 | (2010.01) |
| C07K 14/705 | (2006.01) |
| C07K 14/715 | (2006.01) |
| C12N 9/22 | (2006.01) |
| C12N 9/96 | (2006.01) |
| C12N 15/113 | (2010.01) |
| C12N 15/87 | (2006.01) |

(52) U.S. Cl.
CPC .......... *A61K 35/17* (2013.01); *C07K 14/4718* (2013.01); *C07K 14/7051* (2013.01); *C07K 14/70503* (2013.01); *C07K 14/70521* (2013.01); *C07K 14/7158* (2013.01); *C12N 5/0636* (2013.01); *C12N 9/22* (2013.01); *C12N 9/96* (2013.01); *C12N 15/113* (2013.01); *C12N 15/907* (2013.01); *C12N 15/87* (2013.01); *C12N 2310/20* (2017.05); *C12N 2510/00* (2013.01); *C12N 2800/80* (2013.01); *Y02A 50/463* (2018.01)

(58) Field of Classification Search
None
See application file for complete search history.

(56) References Cited

U.S. PATENT DOCUMENTS

| | | | |
|---|---|---|---|
| 5,830,755 | A | 11/1998 | Nishimura et al. |
| 5,831,016 | A | 11/1998 | Wang et al. |
| 5,840,526 | A | 11/1998 | Casterman et al. |
| 5,906,936 | A | 5/1999 | Eshhar et al. |
| 6,132,980 | A | 10/2000 | Wang et al. |
| 6,187,306 | B1 | 2/2001 | Pardoll et al. |
| 6,207,147 | B1 | 3/2001 | Hiserodt et al. |
| 7,070,995 | B2 | 7/2006 | Jensen |
| 7,265,209 | B2 | 9/2007 | Jensen |
| 7,446,190 | B2 | 11/2008 | Sadelain et al. |

(Continued)

FOREIGN PATENT DOCUMENTS

| | | |
|---|---|---|
| CN | 103820454 B | 3/2016 |
| EP | 2258720 A1 | 12/2010 |

(Continued)

OTHER PUBLICATIONS

Izmiryan et al., Efficient gene targeting mediated by a lentiviral vector-associated meganuclease. Nucl Acid Res, 2011, 39:7610-7619. (Year: 2011).*
Zhang et al., A Novel RNA Motif Mediates the Strict Nuclear Localization of a Long Noncoding RNA. MCB, 2014, 34:2318-2329. (Year: 2014).*
Yang et al., The signaling suppressor CIS controls proallergic T cell development and allergic airway inflammation. Nature Immunology, 2013, 14:732-742. (Year: 2013).*

(Continued)

*Primary Examiner* — Scott Long
*Assistant Examiner* — Arthur S Leonard
(74) *Attorney, Agent, or Firm* — Wilson Sonsini Goodrich & Rosati

(57) ABSTRACT

Genetically modified compositions, such as non-viral vectors and T cells, for treating cancer are disclosed. Also disclosed are the methods of making and using the genetically modified compositions in treating cancer.

31 Claims, 109 Drawing Sheets
Specification includes a Sequence Listing.

(56) References Cited

U.S. PATENT DOCUMENTS

| | | |
|---|---|---|
| 7,608,410 B2 | 10/2009 | Dunn et al. |
| 7,619,057 B2 | 11/2009 | Wang et al. |
| 7,723,111 B2 | 5/2010 | Hwu et al. |
| 7,741,465 B1 | 6/2010 | Eshhar et al. |
| 7,763,718 B2 | 7/2010 | Jakobsen et al. |
| 7,868,158 B2 | 1/2011 | Chen et al. |
| 8,211,422 B2 | 7/2012 | Eshhar et al. |
| 8,354,516 B2 | 1/2013 | Endl et al. |
| 8,367,804 B2 | 2/2013 | Boulter et al. |
| 8,389,282 B2 | 3/2013 | Sadelain et al. |
| 8,399,645 B2 | 3/2013 | Campana et al. |
| 8,486,694 B2 | 7/2013 | Schendel et al. |
| 8,541,204 B2 | 9/2013 | Endl et al. |
| 8,546,553 B2 | 10/2013 | Terns et al. |
| 8,697,359 B1 | 4/2014 | Zhang |
| 8,754,046 B2 | 6/2014 | Wang et al. |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Zhang et al. |
| 8,889,356 B2 | 11/2014 | Zhang |
| 8,889,365 B2 | 11/2014 | Madura et al. |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,921,332 B2 | 12/2014 | Choulika et al. |
| 8,932,814 B2 | 1/2015 | Zhang et al. |
| 8,945,839 B2 | 2/2015 | Zhang |
| 8,993,233 B2 | 3/2015 | Zhang et al. |
| 8,999,641 B2 | 4/2015 | Zhang et al. |
| 9,023,649 B2 | 5/2015 | Mali et al. |
| 9,131,589 B2 | 9/2015 | Hayashi et al. |
| 9,234,213 B2 | 1/2016 | Wu |
| 9,260,723 B2 | 2/2016 | Mali et al. |
| 9,260,752 B1 | 2/2016 | May et al. |
| 9,362,208 B2 | 6/2016 | Schwab et al. |
| 9,404,098 B2 | 8/2016 | Terns et al. |
| 9,410,198 B2 | 8/2016 | May et al. |
| 9,422,553 B2 | 8/2016 | Terns et al. |
| 9,458,439 B2 | 10/2016 | Choulika et al. |
| 9,570,114 B1 | 2/2017 | Sudo et al. |
| 2005/0250207 A1* | 11/2005 | Rozwadowski ..... C12N 9/1276 435/468 |
| 2007/0274974 A1 | 11/2007 | Bonyhadi et al. |
| 2008/0009447 A1 | 1/2008 | Nash et al. |
| 2009/0220488 A1 | 9/2009 | Gardner |
| 2009/0220582 A1 | 9/2009 | Min |
| 2010/0076057 A1 | 3/2010 | Sontheimer et al. |
| 2010/0093617 A1 | 4/2010 | Barrangou et al. |
| 2010/0104556 A1 | 4/2010 | Blankenstein et al. |
| 2011/0136895 A1 | 6/2011 | Gregory et al. |
| 2011/0158957 A1 | 6/2011 | Bonini et al. |
| 2011/0189141 A1 | 8/2011 | Kieback et al. |
| 2011/0217739 A1 | 9/2011 | Terns et al. |
| 2012/0192298 A1 | 7/2012 | Weinstein et al. |
| 2013/0011828 A1 | 1/2013 | Barrangou et al. |
| 2013/0288237 A1 | 10/2013 | Robins et al. |
| 2013/0309258 A1 | 11/2013 | June et al. |
| 2013/0315884 A1 | 11/2013 | Galetto et al. |
| 2014/0004132 A1 | 1/2014 | Brenner et al. |
| 2014/0068797 A1 | 3/2014 | Doudna et al. |
| 2014/0106449 A1 | 4/2014 | June et al. |
| 2014/0113375 A1* | 4/2014 | Liu ..................... C12N 9/1276 435/462 |
| 2014/0113376 A1 | 4/2014 | Sorek et al. |
| 2014/0120622 A1 | 5/2014 | Gregory et al. |
| 2014/0134142 A1 | 5/2014 | Smith et al. |
| 2014/0141026 A1 | 5/2014 | Schendel et al. |
| 2014/0199334 A1 | 7/2014 | Sasikumar et al. |
| 2014/0199767 A1 | 7/2014 | Barrangou et al. |
| 2014/0227237 A1 | 8/2014 | June et al. |
| 2014/0242049 A1 | 8/2014 | Choi et al. |
| 2014/0242702 A1 | 8/2014 | Chen et al. |
| 2014/0273223 A1 | 9/2014 | Cho et al. |
| 2014/0273226 A1 | 9/2014 | Wu |
| 2014/0273230 A1 | 9/2014 | Chen et al. |
| 2014/0294773 A1 | 10/2014 | Brouns et al. |
| 2014/0295556 A1 | 10/2014 | Joung et al. |
| 2014/0295557 A1 | 10/2014 | Joung et al. |
| 2014/0302563 A1 | 10/2014 | Doudna et al. |
| 2014/0315985 A1 | 10/2014 | May et al. |
| 2014/0342456 A1 | 11/2014 | Mali et al. |
| 2014/0342457 A1 | 11/2014 | Mali et al. |
| 2015/0011007 A1 | 1/2015 | Liu et al. |
| 2015/0020223 A1 | 1/2015 | Zhang et al. |
| 2015/0020233 A1 | 1/2015 | Harriman et al. |
| 2015/0024499 A1 | 1/2015 | Brouns et al. |
| 2015/0031132 A1 | 1/2015 | Church et al. |
| 2015/0031133 A1 | 1/2015 | Church et al. |
| 2015/0031134 A1 | 1/2015 | Zhang et al. |
| 2015/0044772 A1 | 2/2015 | Zhao |
| 2015/0045546 A1 | 2/2015 | Siksnys et al. |
| 2015/0050699 A1 | 2/2015 | Siksnys et al. |
| 2015/0056705 A1 | 2/2015 | Conway et al. |
| 2015/0059010 A1 | 2/2015 | Cigan et al. |
| 2015/0067898 A1 | 3/2015 | Fahrenkrug et al. |
| 2015/0079681 A1 | 3/2015 | Zhang |
| 2015/0082478 A1 | 3/2015 | Cigan et al. |
| 2015/0098954 A1 | 4/2015 | Hyde et al. |
| 2015/0140664 A1 | 5/2015 | Byrne et al. |
| 2015/0141347 A1 | 5/2015 | Parkhurst et al. |
| 2015/0152436 A1 | 6/2015 | Musunuru et al. |
| 2015/0158822 A1 | 6/2015 | Raghavan et al. |
| 2015/0166980 A1 | 6/2015 | Liu et al. |
| 2015/0176013 A1 | 6/2015 | Musunuru et al. |
| 2015/0184139 A1 | 7/2015 | Zhang et al. |
| 2015/0203872 A1 | 7/2015 | Zhang |
| 2015/0211023 A1 | 7/2015 | Shiboleth et al. |
| 2015/0232881 A1 | 8/2015 | Glucksmann et al. |
| 2015/0232883 A1 | 8/2015 | Dahlman et al. |
| 2015/0240261 A1 | 8/2015 | Siksnys et al. |
| 2015/0247150 A1 | 9/2015 | Zhang et al. |
| 2015/0259684 A1 | 9/2015 | Church et al. |
| 2015/0259704 A1 | 9/2015 | Church et al. |
| 2015/0284727 A1 | 10/2015 | Kim et al. |
| 2015/0291961 A1 | 10/2015 | Siksnys et al. |
| 2015/0291965 A1 | 10/2015 | Zhang et al. |
| 2015/0291966 A1 | 10/2015 | Zhang et al. |
| 2015/0322457 A1 | 11/2015 | Kim et al. |
| 2015/0344912 A1 | 12/2015 | Kim et al. |
| 2015/0353917 A1 | 12/2015 | Miller |
| 2015/0356239 A1 | 12/2015 | Zhang et al. |
| 2016/0002670 A1 | 1/2016 | Church et al. |
| 2016/0007929 A1 | 1/2016 | Chuang et al. |
| 2016/0017366 A1 | 1/2016 | Chen et al. |
| 2016/0024523 A1 | 1/2016 | Joung et al. |
| 2016/0024524 A1 | 1/2016 | Joung et al. |
| 2016/0032274 A1 | 2/2016 | Church et al. |
| 2016/0046949 A1 | 2/2016 | May et al. |
| 2016/0046961 A1 | 2/2016 | Jinek et al. |
| 2016/0046962 A1 | 2/2016 | May et al. |
| 2016/0060330 A1 | 3/2016 | Presta |
| 2016/0060653 A1 | 3/2016 | Doudna et al. |
| 2016/0060654 A1 | 3/2016 | Doudna et al. |
| 2016/0068864 A1 | 3/2016 | Doudna et al. |
| 2016/0068887 A1 | 3/2016 | May et al. |
| 2016/0076020 A1 | 3/2016 | May et al. |
| 2016/0108470 A1 | 4/2016 | May et al. |
| 2016/0115488 A1 | 4/2016 | Zhang et al. |
| 2016/0115489 A1 | 4/2016 | Zhang et al. |
| 2016/0130609 A1 | 5/2016 | Doudna et al. |
| 2016/0138027 A1 | 5/2016 | Gan et al. |
| 2016/0138046 A1 | 5/2016 | Wu |
| 2016/0153004 A1 | 6/2016 | Zhang et al. |
| 2016/0153005 A1 | 6/2016 | Zhang et al. |
| 2016/0153006 A1 | 6/2016 | Zhang et al. |
| 2016/0160210 A1 | 6/2016 | Mali et al. |
| 2016/0168594 A1 | 6/2016 | Zhang et al. |
| 2016/0175462 A1 | 6/2016 | Zhang et al. |
| 2016/0186152 A1 | 6/2016 | Brouns et al. |
| 2016/0186213 A1 | 6/2016 | Zhang et al. |
| 2016/0186214 A1 | 6/2016 | Brouns et al. |
| 2016/0208243 A1 | 7/2016 | Zhang et al. |
| 2016/0237455 A1 | 8/2016 | Glucksmann et al. |

(56) References Cited

U.S. PATENT DOCUMENTS

| | | |
|---|---|---|
| 2016/0251640 A1 | 9/2016 | May et al. |
| 2016/0272965 A1 | 9/2016 | Zhang et al. |
| 2016/0281072 A1 | 9/2016 | Zhang |
| 2016/0289675 A1 | 10/2016 | Ryan et al. |
| 2016/0298096 A1 | 10/2016 | Charpentier et al. |
| 2016/0304907 A1 | 10/2016 | Mali et al. |
| 2016/0319349 A1 | 11/2016 | May et al. |
| 2016/0355816 A1 | 12/2016 | Terns et al. |
| 2017/0037416 A1 | 2/2017 | Barrangou et al. |
| 2017/0051310 A1 | 2/2017 | Doudna et al. |
| 2017/0051312 A1 | 2/2017 | Jinek et al. |
| 2017/0175128 A1 | 6/2017 | Welstead et al. |
| 2017/0175142 A1 | 6/2017 | Zhang et al. |

FOREIGN PATENT DOCUMENTS

| | | | |
|---|---|---|---|
| EP | 3004337 B1 | 8/2017 | |
| WO | WO-2007025097 A2 | 3/2007 | |
| WO | WO-2007136815 A2 | 11/2007 | |
| WO | WO-2010011961 A2 | 1/2010 | |
| WO | WO-2010054108 A2 | 5/2010 | |
| WO | WO-2012078540 A1 * | 6/2012 | ........... C12N 5/0636 |
| WO | WO-2012112079 A1 | 8/2012 | |
| WO | WO-2012164565 A1 | 12/2012 | |
| WO | WO-2013049330 A1 | 4/2013 | |
| WO | WO-2013074916 A1 | 5/2013 | |
| WO | WO-2013088446 A1 | 6/2013 | |
| WO | WO-2013098244 A1 | 7/2013 | |
| WO | WO-2013141680 A1 | 9/2013 | |
| WO | WO-2013176772 A1 | 11/2013 | |
| WO | WO-2013176915 A1 | 11/2013 | |
| WO | WO-2014022702 A2 | 2/2014 | |
| WO | WO-2014065596 A1 | 5/2014 | |
| WO | WO-2014083173 A1 | 6/2014 | |
| WO | WO-2014089290 A1 | 6/2014 | |
| WO | WO-2014093595 A1 | 6/2014 | |
| WO | WO-2014093622 A2 | 6/2014 | |
| WO | WO-2014093655 A2 | 6/2014 | |
| WO | WO-2014093661 A2 | 6/2014 | |
| WO | WO-2014093709 A1 | 6/2014 | |
| WO | WO-2014093712 A1 | 6/2014 | |
| WO | WO-2014099744 A1 | 6/2014 | |
| WO | WO-2014099750 A2 | 6/2014 | |
| WO | WO-2014130955 A1 | 8/2014 | |
| WO | WO-2014134165 A1 | 9/2014 | |
| WO | WO-2014150624 A1 | 9/2014 | |
| WO | WO-2014165825 A2 | 10/2014 | |
| WO | WO-2014184744 A1 | 11/2014 | |
| WO | WO-2014186585 A2 | 11/2014 | |
| WO | WO-2014191128 A1 | 12/2014 | |
| WO | WO-2014191518 A1 | 12/2014 | |
| WO | WO-2014204723 A1 | 12/2014 | |
| WO | WO-2014204725 A1 | 12/2014 | |
| WO | WO-2014204726 A1 | 12/2014 | |
| WO | WO-2014204727 A1 | 12/2014 | |
| WO | WO-2014204728 A1 | 12/2014 | |
| WO | WO-2014204729 A1 | 12/2014 | |
| WO | WO-2015006294 A2 | 1/2015 | |
| WO | WO-2015026887 A1 | 2/2015 | |
| WO | WO-2015048577 A2 | 4/2015 | |
| WO | WO-2015048690 A1 | 4/2015 | |
| WO | WO-2015052133 A1 | 4/2015 | |
| WO | WO-2015053995 A1 | 4/2015 | |
| WO | WO-2015054253 A1 | 4/2015 | |
| WO | WO-2015070083 A1 | 5/2015 | |
| WO | WO-2015071474 A2 | 5/2015 | |
| WO | WO-2015079056 A1 | 6/2015 | |
| WO | WO-2015084897 A2 | 6/2015 | |
| WO | WO-2015089419 A2 | 6/2015 | |
| WO | WO-2015143328 A1 | 9/2015 | |
| WO | WO-2015155686 A2 | 10/2015 | |
| WO | WO-2015164675 A1 | 10/2015 | |
| WO | WO-2016057821 A2 | 4/2016 | |
| WO | WO-2016057835 A2 | 4/2016 | |
| WO | WO-2016057961 A1 | 4/2016 | |
| WO | WO-2016183345 A1 | 11/2016 | |
| WO | WO-2017023801 A1 | 2/2017 | |
| WO | WO-2017023803 A1 | 2/2017 | |

OTHER PUBLICATIONS

International Search Report and Written Opinion dated Nov. 16, 2016 for International PCT Patent Application No. PCT/US2016/044858.

Li, et al. HomeRun Vector Assembly System: a flexible and standardized cloning system for assembly of multi-modular DNA constructs. PLoS One. Jun. 24, 2014;9(6):e100948. doi: 10.1371/journal.pone.0100948. eCollection 2014.

Ahmadi, et al. CD3 limits the efficacy of TCR gene therapy in vivo. Blood. Sep. 29, 2011;118(13):3528-37. doi: 10.1182/blood-2011-04-346338. Epub Jul. 12, 2011.

Arap, et al. Cancer treatment by targeted drug delivery to tumor vasculature in a mouse model. Science. Jan 16, 1998;279(5349):377-80.

Baumgaertner, et al. Ex vivo detectable human CD8 T-cell responses to cancer-testis antigens. Cancer Res. Feb. 15, 2006;66(4):1912-6.

Chacon, et al. Continuous 4-1BB co-stimulatory signals for the optimal expansion of tumor-infiltrating lymphocytes for adoptive T-cell therapy. Oncoimmunology. Sep. 1, 2013;2(9):e25581. Epub Jul. 3, 2013.

Chacon, et al. Co-stimulation through 4-1BB/CD137 improves the expansion and function of CD8(+) melanoma tumor-infiltrating lymphocytes for adoptive T-cell therapy. PLoS One. 2013;8(4):e60031. doi: 10.1371/journal.pone.0060031. Epub Apr. 1, 2013.

Chan, et al. Viral evasion of intracellular DNA and RNA sensing. Nat Rev Microbiol. Jun. 2016;14(6):360-73. doi: 10.1038/nrmicro.2016.45. Epub May 13, 2016.

Chen, et al. Molecular mechanism for silencing virally transduced genes involves histone deacetylation and chromatin condensation. Proc Natl Acad Sci U S A. Jan. 4, 2000;97(1):377-82.

Chen, et al. Reactivation of silenced, virally transduced genes by inhibitors of histone deacetylase. Proc Natl Acad Sci U S A. May 27, 1997;94(11):5798-803.

Chu, et al. Increasing the efficiency of homology-directed repair for CRISPR-Cas9-induced precise gene editing in mammalian cells. Nat Biotechnol. May 2015;33(5):543-8. doi: 10.1038/nbt.3198. Epub Mar. 24, 2015

CLR, RLR, & CDS Signaling Pathways. InvivoGen. Poster. 2016. www.invivogen.com/docs/2016-Poster_CLR-RLR-CDS-invivogen.pdf.

Cong, et al. Multiplex genome engineering using CRISPR/Cas systems. Science. Feb. 15, 2013;339(6121):819-23. doi: 10.1126/science.1231143. Epub Jan. 3, 2013.

Co-pending U.S. Appl. No. 15/224,159, filed Jul. 29, 2016.
Co-pending U.S. Appl. No. 15/250,514, filed Aug. 29, 2016.
Co-pending U.S. Appl. No. 15/256,086, filed Sep. 2, 2016.

Feoktistova, et al. Programmed necrosis and necroptosis signalling. FEBS J. Jan. 2015;282(1):19-31. doi: 10.1111/febs.13120. Epub Nov. 11, 2014. Review.

Hendel, et al. Chemically modified guide RNAs enhance CRISPR-Cas genome editing in human primary cells. Nat Biotechnol. Sep. 2015;33(9):985-9. doi: 10.1038/nbt.3290. Epub Jun. 29, 2015.

Fu, et al. High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.

Gao, et al. Structure-function analysis of STING activation by c[G(2',5')pA(3',5')p] and targeting by antiviral DMXAA. Cell. Aug. 15, 2013;154(4):748-62. doi: 10.1016/j.cell.2013.07.023. Epub Aug. 1, 2013.

Guschin, et al. A rapid and general assay for monitoring endogenous gene modification. Methods Mol Biol. 2010;649:247-56. doi: 10.1007/978-1-60761-753-2_15.

Gwiazda, et al. High Efficiency CRISPR/Cas9-mediated Gene Editing in Primary Human T-cells Using Mutant Adenoviral E4orf6/E1b55k "Helper" Proteins. Mol Ther. Jun. 28, 2016. doi: 10.1038/mt.2016.105.

Harrison. Competitive repopulation: a new assay for long-term stem cell functional capacity. Blood. Jan. 1980;55(1):77-81.

(56) References Cited

OTHER PUBLICATIONS

Hsu, et al. Development and applications of CRISPR-Cas9 for genome engineering. Cell. Jun. 5, 2014;157(6):1262-78. doi: 10.1016/j.cell.2014.05.010.

Hunder, et al. Treatment of metastatic melanoma with autologous CD4+ T cells against NY-ESO-1. N Engl J Med. Jun. 19, 2008;358(25):2698-703. doi: 10.1056/NEJMoa0800251.

Idorn, et al. Transfection of Tumor-Infiltrating T Cells with mRNA Encoding CXCR2. Methods Mol Biol. 2016;1428:261-76. doi: 10.1007/978-1-4939-3625-0_17.

InvivoGen Insight. Cytosolic DNA Sensors (CDSs): a sting in the tail. InvivoGen. Fall 2012. 8 pages.

Jin, et al. Simplified method of the growth of human tumor infiltrating lymphocytes in gas-permeable flasks to numbers needed for patient treatment. J Immunother. Apr. 2012;35(3):283-92. doi: 10.1097/CJI.0b013e31824e801f.

Keir, et al. PD-1 and its ligands in tolerance and immunity. Annu Rev Immunol. 2008;26:677-704. doi: 10.1146/annurev.immunol.26.021607.090331.

Klebanoff, et al. Prospects for gene-engineered T cell immunotherapy for solid cancers. Nat Med. Jan. 2016;22(1):26-36. doi: 10.1038/nm.4015.

Letai. BH3 domains as BCL-2 inhibitors: prototype cancer therapeutics. Expert Opin Biol Ther. Apr. 2003;3(2):293-304.

Love, et al. ITAM-mediated signaling by the T-cell antigen receptor. Cold Spring Harb Perspect Biol. Jun. 2010;2(6):a002485. doi: 10.1101/cshperspect.a002485. Epub Apr. 28, 2010.

Makarova, et al. An updated evolutionary classification of CRISPR-Cas systems. Nat Rev Microbiol. Nov. 2015;13(11):722-36. doi: 10.1038/nrmicro3569. Epub Sep. 28, 2015.

Menger, et al. TALEN-Mediated Inactivation of PD-1 in Tumor-Reactive Lymphocytes Promotes Intratumoral T-cell Persistence and Rejection of Established Tumors. Cancer Res. Apr. 15, 2016;76(8):2087-93. doi: 10.1158/0008-5472.CAN-15-3352.

Milone, et al. Chimeric receptors containing CD137 signal transduction domains mediate enhanced survival of T cells and increased antileukemic efficacy in vivo. Mol Ther. Aug. 2009;17(8):1453-64. doi: 10.1038/mt.2009.83. Epub Apr. 21, 2009.

Natsume, et al. Rapid Protein Depletion in Human Cells by Auxin-Inducible Degron Tagging with Short Homology Donors. Cell Rep. Apr. 5, 2016;15(1):210-8. doi: 10.1016/j.celrep.2016.03.001. Epub Mar. 24, 2016.

Ochi, et al. Novel adoptive T-cell immunotherapy using a WT1-specific TCR vector encoding silencers for endogenous TCRs shows marked antileukemia reactivity and safety. Blood. Aug. 11, 2011;118(6):1495-503. doi: 10.1182/blood-2011-02-337089. Epub Jun. 14, 2011.

Odunsi, et al. Epigenetic potentiation of NY-ESO-1 vaccine therapy in human ovarian cancer. Cancer Immunol Res. Jan. 2014;2(1):37-49. doi: 10.1158/2326-6066.CIR-13-0126.

Palmer, et al. Cish actively silences TCR signaling in CD8+ T cells to maintain tumor tolerance. J Exp Med. Nov. 16, 2015;212(12):2095-113. doi: 10.1084/jem.20150304. Epub Nov. 2, 2015.

Poirot, et al. Multiplex Genome-Edited T-cell Manufacturing Platform for "Off-the-Shelf" Adoptive T-cell Immunotherapies. Cancer Res. Sep. 15, 2015;75(18):3853-64. doi: 10.1158/0008-5472.CAN-14-3321. Epub Jul. 16, 2015.

Postow, et al. Immune Checkpoint Blockade in Cancer Therapy. J Clin Oncol. Jun. 10, 2015;33(17):1974-82. doi: 10.1200/JCO.2014.59.4358. Epub Jan. 20, 2015.

Rahdar, et al. Synthetic CRISPR RNA-Cas9-guided genome editing in human cells. Proc Natl Acad Sci U S A. Dec. 22, 2015;112(51):E7110-7. doi: 10.1073/pnas.1520883112. Epub Nov. 16, 2015.

Rapoport, et al. NY-ESO-1-specific TCR-engineered T cells mediate sustained antigen-specific antitumor effects in myeloma. Nat Med. Aug. 2015;21(8):914-21. doi: 10.1038/nm.3910. Epub Jul. 20, 2015.

Robbins, et al. Tumor regression in patients with metastatic synovial cell sarcoma and melanoma using genetically engineered lymphocytes reactive with NY-ESO-1. J Clin Oncol. Mar. 1, 2011;29(7):917-24. doi: 10.1200/JCO.2010.32.2537. Epub Jan. 31, 2011.

Rosenberg, et al. Adoptive cell transfer as personalized immunotherapy for human cancer. Science. Apr. 3, 2015;348(6230):62-8. doi: 10.1126/science.aaa4967.

Safa, et al. Roles of c-FLIP in Apoptosis, Necroptosis, and Autophagy. J Carcinog Mutagen. 2013;Suppl 6. pii: 003.

Samoylova, et al. Peptide phage display: opportunities for development of personalized anti-cancer strategies. Anticancer Agents Med Chem. Jan. 2006;6(1):9-17.

Sander, et al. CRISPR-Cas systems for editing, regulating and targeting genomes. Nat Biotechnol. Apr. 2014;32(4):347-55. doi: 10.1038/nbt.2842. Epub Mar. 2, 2014.

Savoldo, et al. CD28 costimulation improves expansion and persistence of chimeric antigen receptor-modified T cells in lymphoma patients. J Clin Invest. May 2011;121(5):1822-6. doi: 10.1172/JCI46110. Epub Apr. 11, 2011.

Schietinger, et al. Tolerance and exhaustion: defining mechanisms of T cell dysfunction. Trends Immunol. Feb. 2014;35(2):51-60. doi: 10.1016/j.it.2013.10.001. Epub Nov. 6, 2013.

Schmid, et al. Evidence for a TCR affinity threshold delimiting maximal CD8 T cell function. J Immunol. May 1, 2010;184(9):4936-46. doi: 10.4049/jimmunol.1000173. Epub Mar. 29, 2010.

Schumann, et al. Generation of knock-in primary human T cells using Cas9 ribonucleoproteins. Proc Natl Acad Sci U S A. Aug. 18, 2015;112(33):10437-42. doi: 10.1073/pnas.1512503112. Epub Jul. 27, 2015.

Scott, et al. Structural requirements for the biosynthesis of backbone cyclic peptide libraries. Chem Biol. Aug. 2001;8(8):801-15.

Shmakov, et al. Discovery and Functional Characterization of Diverse Class 2 CRISPR-Cas Systems. Mol Cell. Nov. 5, 2015;60(3):385-97. doi: 10.1016/j.molcel.2015.10.008. Epub Oct. 22, 2015.

Silas, et al. Direct CRISPR spacer acquisition from RNA by a natural reverse transcriptase-Cas1 fusion protein. Science. Feb. 26, 2016;351(6276):aad4234. doi: 10.1126/science.aad4234.

Smith, et al. Gene transfer properties and structural modeling of human stem cell-derived AAV. Mol Ther. Sep. 2014;22(9):1625-34. doi: 10.1038/mt.2014.107. Epub Jun. 13, 2014.

Stanislawski, et al. Circumventing tolerance to a human MDM2-derived tumor antigen by TCR gene transfer. Nat Immunol. Oct. 2001;2(10):962-70.

Su, et al. CRISPR-Cas9 mediated efficient PD-1 disruption on human primary T cells from cancer patients. Sci Rep. Jan. 28, 2016;6:20070. doi: 10.1038/srep20070.

Tebas, et al. Gene editing of CCR5 in autologous CD4 T cells of persons infected with HIV. N Engl J Med. Mar. 6, 2014;370(10):901-10. doi: 10.1056/NEJMoa1300662.

Torikai, et al. A foundation for universal T-cell based immunotherapy: T cells engineered to express a CD19-specific chimeric-antigen-receptor and eliminate expression of endogenous TCR. Blood. Jun. 14, 2012;119(24):5697-705. doi: 10.1182/blood-2012-01-405365. Epub Apr. 24, 2012.

Trabattoni, et al. Costimulatory pathways in multiple sclerosis: distinctive expression of PD-1 and PD-L1 in patients with different patterns of disease. J Immunol. Oct. 15, 2009;183(8):4984-93. doi: 10.4049/jimmunol.0901038. Epub Sep. 30, 2009.

Tran, et al. Cancer immunotherapy based on mutation-specific CD4+ T cells in a patient with epithelial cancer. Science. May 9, 2014;344(6184):641-5. doi: 10.1126/science.1251102.

Tran, et al. Immunogenicity of somatic mutations in human gastrointestinal cancers. Science. Dec. 11, 2015;350(6266):1387-90. doi: 10.1126/science.aad1253. Epub Oct. 29, 2015.

Tsai, et al. GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.

Tuschl, et al. Nucleic Acid Sensing Pathways: Innate Immunity, Immunobiology and Therapeutics. Keystone Symposia 2016 Conference. May 8-12, 2016. 3 pages.

Van Loenen, et al. Mixed T cell receptor dimers harbor potentially harmful neoreactivity. Proc Natl Acad Sci U S A. Jun. 15, 2010;107(24):10972-7. doi: 10.1073/pnas.1005802107. Epub Jun. 1, 2010.

(56) References Cited

OTHER PUBLICATIONS

Wang, et al. Highly efficient homology-driven genome editing in human T cells by combining zinc-finger nuclease mRNA and AAV6 donor delivery. Nucleic Acids Res. Feb. 18, 2016;44(3):e30. doi: 10.1093/nar/gkv1121. Epub Nov. 2, 2015.
Yuan, et al. CTLA-4 blockade enhances polyfunctional NY-ESO-1 specific T cell responses in metastatic melanoma patients with clinical benefit. Proc Natl Acad Sci U S A. Dec. 23, 2008;105(51):20410-5. doi: 10.1073/pnas.0810114105. Epub Dec. 12, 2008.
Zon. Intrinsic and extrinsic control of haematopoietic stem-cell self-renewal. Nature. May 15, 2018;453(7193):306-13. doi: 10.1038/nature07038.
Co-pending U.S. Appl. No. 15/100,105, filed May 27, 2016.
Co-pending U.S. Appl. No. 15/302,655, filed Oct. 7, 2016.
Hamid, et al. Safety and tumor responses with lambrolizumab (anti-PD-1) in melanoma. N Engl J Med. Jul. 11, 2013;369(2):134-44. doi: 10.1056/NEJMoa1305133. Epub Jun. 2, 2013.
International Search Report and Written Opinion dated Oct. 17, 2016 for International PCT Patent Application No. PCT/US2016/044856.
Jinek, et al. A programmable dual-RNA-guided DNA endonuclease in adaptive bacterial immunity. Science. Aug. 17, 2012;337(6096):816-21. doi: 10.1126/science.1225829. Epub Jun. 28, 2012.
Mali, et al. RNA-Guided Human Genome Engineering via Cas9. Science. Feb. 15, 2013; 339(6121): 823-826. Published online Jan. 3, 2013 doi: 10.1126/science.1232033.
Osborn, et al. Evaluation of TCR Gene Editing Achieved by TALENs, CRISPR/Cas9, and megaTAL Nucleases. Mol Ther. Mar. 2016;24(3):570-81. doi: 10.1038/mt.2015.197. Epub Oct. 27, 2015.
Rosenberg, et al. Durable complete responses in heavily pretreated patients with metastatic melanoma using T-cell transfer immunotherapy. Clin Cancer Res. Jul. 1, 2011;17(13):4550-7. doi: 10.1158/1078-0432.CCR-11-0116. Epub Apr. 15, 2011.
Wiedenheft, et al. RNA-guided genetic silencing systems in bacteria and archaea. Nature. Feb. 15, 2012;482(7385):331-8. doi: 10.1038/nature10886.
Beane, et al. Clinical Scale Zinc Finger Nuclease-mediated Gene Editing of PD-1 in Tumor Infiltrating Lymphocytes for the Treatment of Metastatic Melanoma. Mol Ther. Aug. 2015;23(8):1380-90. doi: 10.1038/mt.2015.71. Epub May 5, 2015.
Chen et al. Silencing of episomal transgene expression by plasmid bacterial DNA elements in vivo. Gene Ther. May 2004;11(10):856-64.
Chikuma, et al. Suppressors of cytokine signaling: Potential immune checkpoint molecules for cancer immunotherapy: Cancer Sci 108 (2017) 574-580.
clinicaltrials.gov: Archive: NC100501995 on Oct. 9, 2016 [online]. U.S. National Institute of Health. Oct. 9, 2016 [retrieved on Jan. 10, 2018]. Retrieved for the internet<https://clinicaltrials.gov/archive/NCT00501995/2016_10_09>.
Hirata et al. Targeted transgene insertion into human chromosomes by adeno-associated virus vectors. Nature Biotechnology 20 (2002): 735-738.
*Homo sapiens* cytokine inducible SH2 containing protein (CISH), RefSeqGene on chromosome 3 NCBI Reference Sequence: NG_023194.1 pp. 1-5; downloaded May 31, 2017.
Hu et al. MicroRNA-98 and let-7 Confer Cholangiocyte Expression of Cytokine-Inducible Src Homology 2-Containing Protein in Response to Microbial Challenge. J Immunol. Aug. 1, 2009; 183(3): 1617-1624.
International Search Report and Written Opinion dated Jan. 12, 2018 for International PCT Patent Application No. PCT/US2017/058605.
Invitrogen. Neon Transfer System: For transfecting mammalian cells, including primary and stem cells, with high transfection efficiency. User Guide. Life Technologies. Jul. 11, 2014. 52 pages.
Monjezi et al. Enhanced CAR T-cell engineering using non-viral Sleeping Beauty transposition from minicircle vectors. Leukemia. Jan. 2017;31(1):186-194.
Moriarity, et al. Simple and efficient methods for enrichment and isolation of endonuclease modified cells. PLoS One. 9.5 (May 5, 2014): e96114. doi: 10.1371/journal.pone.0096114. eCollection 2014.
Neon Transfection System Protocols and Cell line data. ThermoFisher Scientific, p. 1; downloaded on May 30, 2017.
Office Action dated Mar. 23, 2017 for U.S. Appl. No. 15/256,086.
Office Action dated Jun. 5, 2017 for U.S. Appl. No. 15/250,514.
Office Action dated Sep. 19, 2017 for U.S. Appl. No. 15/224,159.
Office Action dated Dec. 14, 2017 for U.S. Appl. No. 15/256,086.
Palmer, et al. Cish attenuates proximal TCR-signaling and CD8+ T cell immunity. J Immunother Cancer. 2014; 2(Suppl 3): P32. Published online Nov. 6, 2014. doi: 10.1186/2051-1426-2-S3-P32.
Palmer, et al. Suppressors of cytokine signaling (SOCS) in T cell differentiation, maturation, and function. Trends Immunol. Dec. 2009;30(12):592-602. doi: 10.1016/j.it.2009.09.009. Epub Oct. 30, 2009.
PCT/US2017/057228 International Search Report dated Mar. 22, 2018.
Rosenberg, et al. A new approach to the adoptive immunotherapy of cancer with tumor-infiltrating lymphocytes. Science Sep. 1986;233 (4770): 1318-21.
Sather et al. Efficient modification of CCR5 in primary human hematopoietic cells using a megaTAL nuclease and AAV donor template. Sci Transl Med. Sep. 30, 2015;7(307):307ra156.
Shi et al. Silenced suppressor of cytokine signaling 1 (SOCS1) enhances the maturation and antifungal immunity of dendritic cells in response to Candida albicans in vitro. Immunol Res. 2015; 61(3): 206-218.
U.S. Appl. No. 15/250,514 Office Action dated Oct. 12, 2017.
Whiteside, et al. Regulatory T cell subsets in human cancer: are they regulating for or against tumor progression? Cancer Immunol Immunother (2014) 63:67-72.

\* cited by examiner

FIG. 3
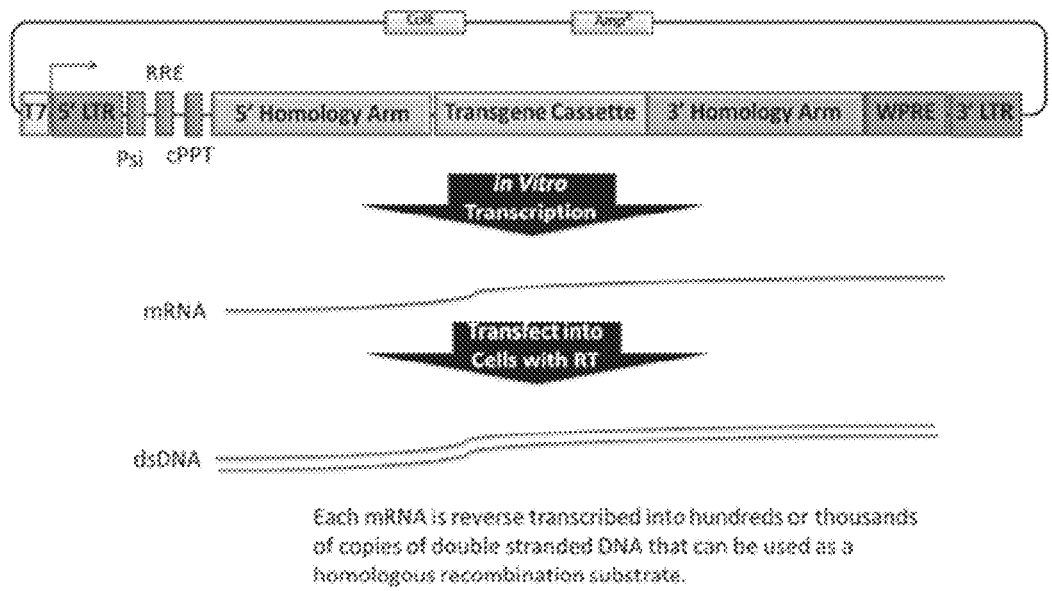
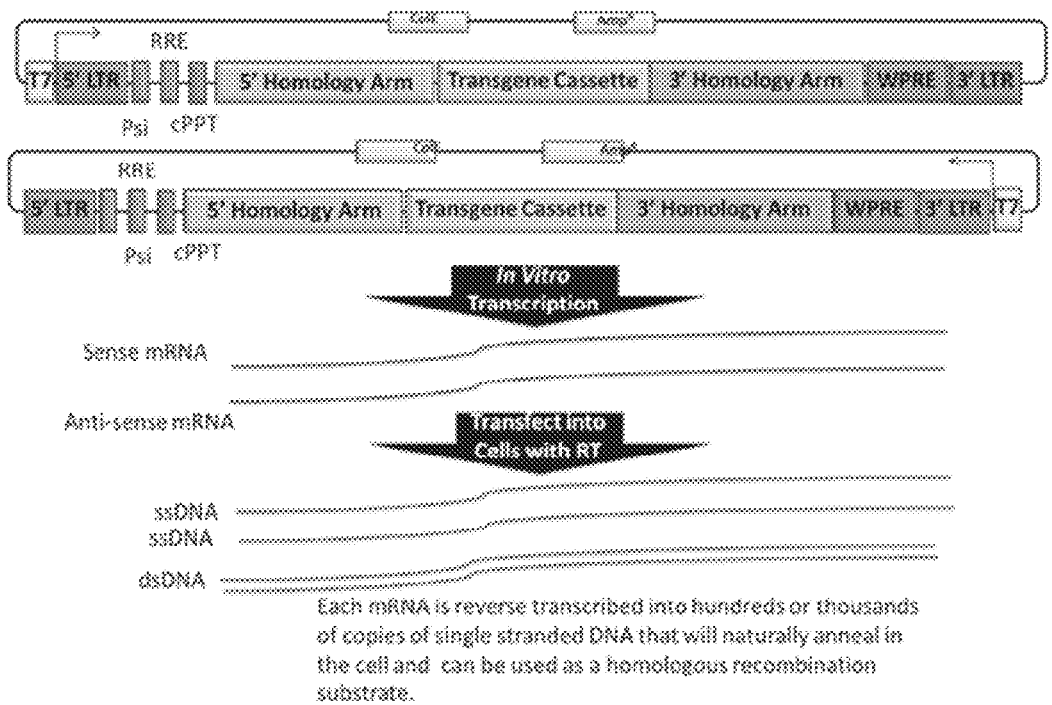

FIG. 4
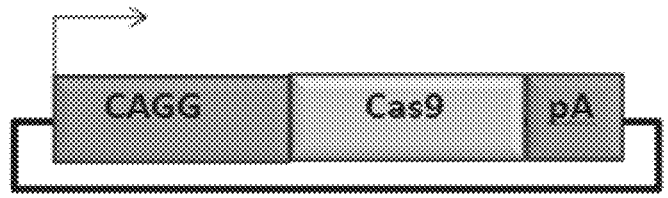
Cas9 Nuclease (10 kb)
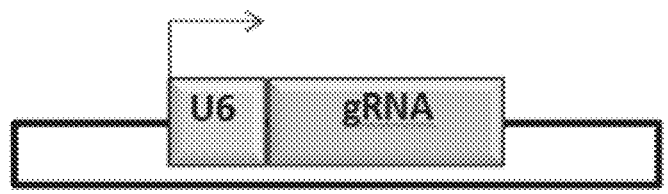
HPRT Guide RNA (4.4 kb)
Amaxa EGFPmax (~3.5 kb)
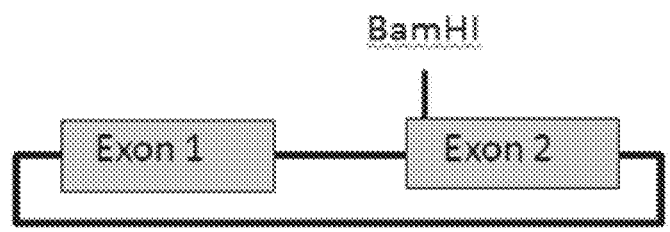
HPRT 'Target' Vector (3.6 kb)

FIG. 5
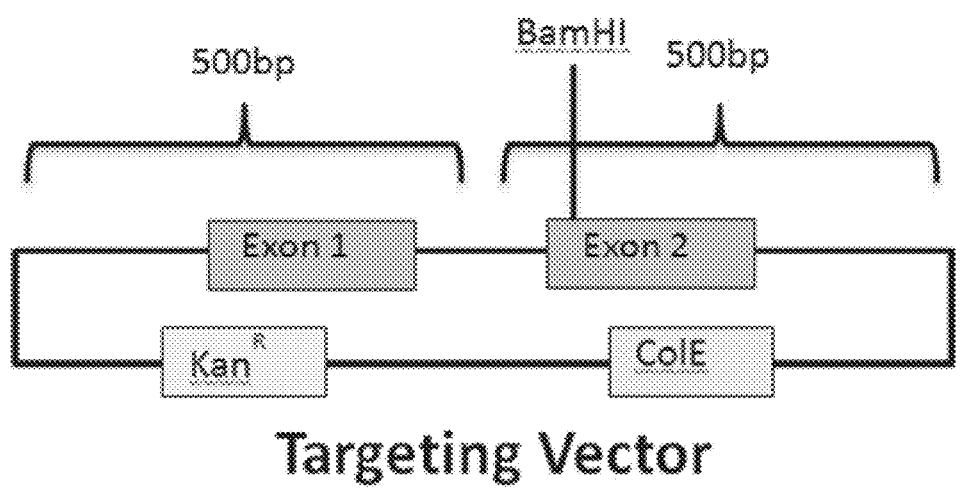
Targeting Vector
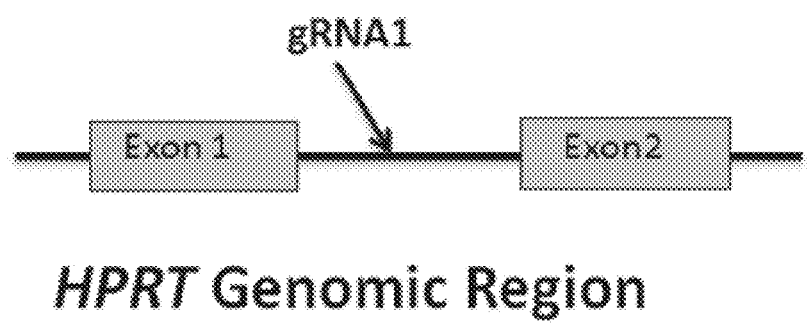
HPRT Genomic Region (1) TCR transgene transcribed by exogenous promoter
(2) TCR transgene transcribed by endogenous promoter via splicing
(3) TCR transgene transcribed by endogenous promoter via in frame translation

|         | HPRT   | AAVS1  | CCR5   | PD1    | CTLA4  |
|---------|--------|--------|--------|--------|--------|
| gRNA#1  | 27.85% | 32.99% | 21.47% | 10.83% | 10.16% |
| gRNA#2  | 30.04% | 27.10% | >60%   | >60%   | >60%   |
| gRNA#3  | <1%    | 39.82% |        | 37.42% | 39.33% |
| gRNA#4  | <5%    | 25.93% | 40.96% | 20.87% | 40.3%  |
| gRNA#5  | <1%    | 27.55% | 36.07% | 30.60% | 15.90% |
| gRNA#6  | <5%    | 39.62% | 33.17% | 25.91% | 36.93% |

| % Gene Modification |
|---|
| 0/10% |
| 10/20% |
| 20/30% |
| 30/40% |
| 40/50% |
| >60% |

FIG. 12

Lane 1: Ladder
Lane2: Cas9+gRNA
Lane3: Cas9+gRNA
Lane4: Cas9 alone Control

FIG. 23 A
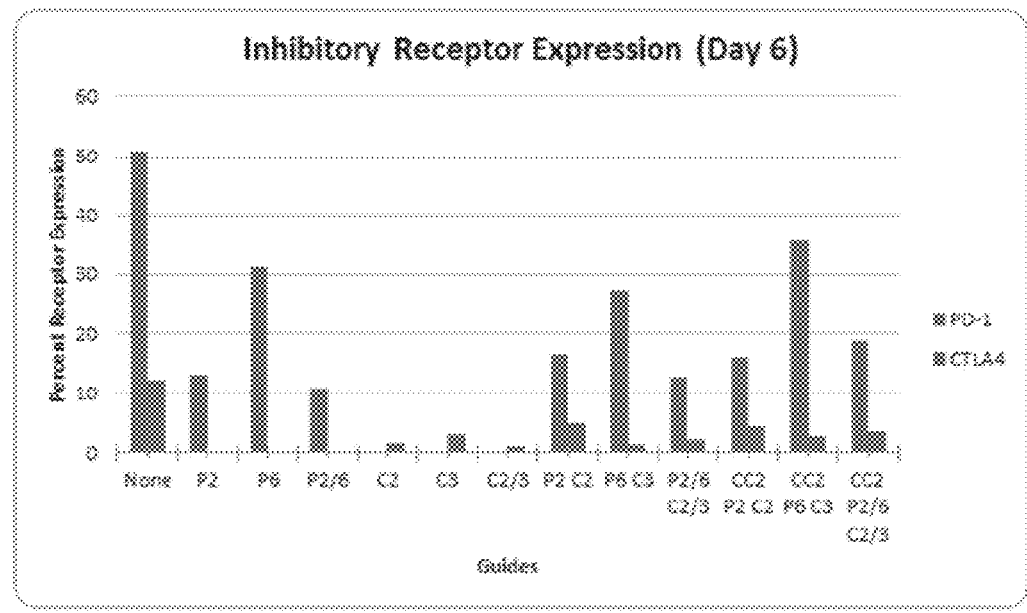
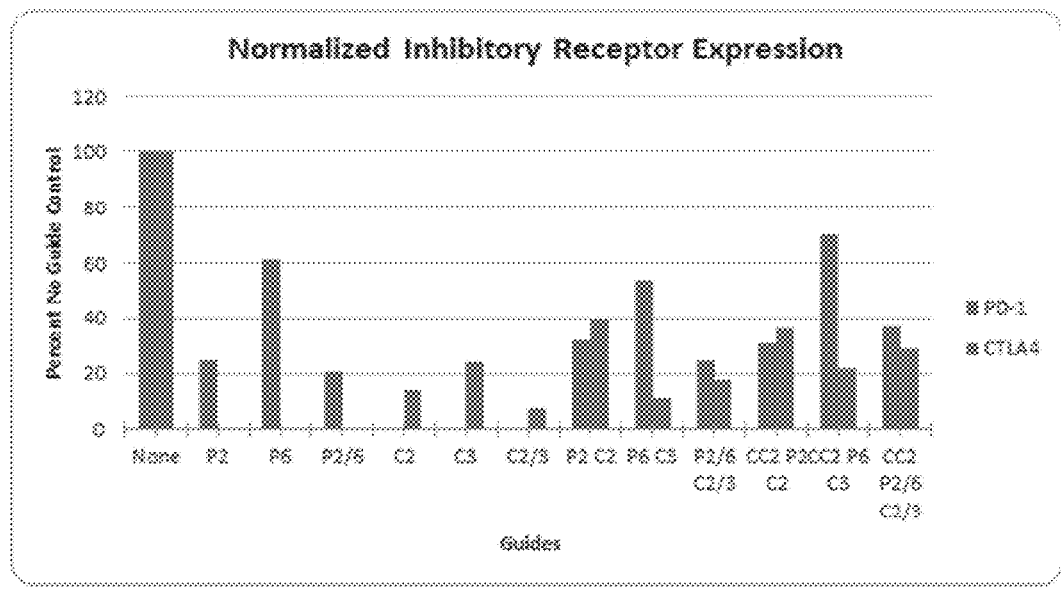
FIG. 23 B

CTLA4 KO

tattttctaaatacattcaaatatgtatccgctcatgaccaaaatccctaacgtgagtttcgttccactgagcgtcagaccccgtagaaaagatca
aaggatcttcttgagatcctttttctgcgcgtaatctgctgcttgcaaacaaaaaaaccaccgctaccagcggtggttttgtttgccggatcaagagc
taccaactctttttccgaaggtaactggcttcagcagagcgcagataccaaatactgtccttctagtgtagccgtagttaggccaccacttcaagaaac
tctgtagcaccgcctacatacctcgctctgctaatcctgttaccagtggctgctgccagtggcgataagtcgtgtcttaccgggttggactcaagacgat
agttaccggataaggcgcagcggtcgggctgaacggggggttcgtgcacacagcccagcttggagcgaacgacctacaccgaactgagatacctacagc
gtgagctatgagaaacgccacgcttcccgaagggagaaaggcggacaggtatccggtaagcggcagggtcggaacaggagagcgcacgagggagcttc
caggggaaacgcctggtatctttatagtcctgtcgggtttcgccacctctgacttgagcgtcgatttttgtgatgctcgtcaggggggcggagcctat
ggaaaaacgccagcaacgcggcctttttacggttcctggccttttgctggccttttgctcacatgttctttcctgcgttatcccctgattctgtggata
accgtattaccgcctttgagtgagctgataccgctcgccgcagccgaacgaccgagcgcagcgagtcagtgagcgaggaagcggaagagcgcctgatgc
ggtattttctccttacgcatctgtgcggtatttcacaccgcatatatggtgcactctcagtacaatctgctctgatgccgcatagttaagccagtatacac
tccgctatcgctacgtgactgggtcatggctgcgccccgacaccccgccaacacccgctgacggcacttctgctgtcgtcccggcatccgcttacagacaa
cagacaagtgtgaccgtctccgggagcgtatgacgagcagagtcagcagcagagatccacccgtcatcgcccgaggcttaccagtcacatgctctcggaagcc
gagccggccatgtgaccataatgtgccgtgcaaatgaccacaagcaggattctgcaaaccctactccgtatctcctcgggtgccccggttgcattttttaaatacccccgagaaa
tatgacaacttgacgggctacaactgcattccactttttcttcacaaccggatgggcaatacaatcaccggtgtgggcatccgggtggtggtccttggtcct
tagagttgatctgtcaaaacgctaatcccctaactgctgtgacagacgcatccggtaaccgatgcgctccattccttcggcatagacttacagtttggtcctc
cgccagcttaagacgctaagtgactgctggcggaaaagatgtgacagagcggaccgctggacgtgccgaccgtgcggaccgtgccgtgccgaccgtgcggctgcgat (SEQ ID NO: 167)

ED.1 sNRA s1 Modified RNA Oligo
GCCTCCTCTGTGACGAAGCTTTTAGACTAGAAATAGCAAGTTAAAATAAGGCTAGTCCGTTATCAACTTGAAAAAGTGG
CACCGAGTCGGTGCTTTT (SEQ ID NO: 154)

CTL.A4 sNRA s1 Modified RNA Oligo
GCTAGATGATTCCATCTGCAGTTTTAGAGCTAGAAATAGCAAGTTAAAATAAGGCTAGTCCGTTATCAACTTGAAAAAGTGG
CACCGAGTCGGTGCTTTT (SEQ ID NO: 156)

CD31 sNRA s1 Modified RNA Oligo
GGCTTCCATTAGCGCGGGTTTTAGAGCTAGAAATAGCAAGTTAAAATAAGGCTAGTCCGTTATCAACTTGAAAAAGTGGC
ACCGAGTCGGTGCTTTT (SEQ ID NO: 158)

AAVS1 sRNA modified oligo
GTCACCAATCCTGTCCCTAGTTTTAGAGCTAGAAATAGCAAGTTAAAATAAGGCTAGTCCGTTATCAACTTGAAAAAGTGG
ACCGAGTCGGTGCTTTT (SEQ ID NO: 159)

ED.1 sNRA s2 Modified RNA Oligo
GCCTCCTCTGTGACGAAGCTTTTAGACTAGAAATAGCAAGTTAAAATAAGGCTAGTCCGTTATCAACTTGAAAAAGTGG
CACCGAGTCGGTGCTTTT (SEQ ID NO: 154)

CTL.A4 sNRA s2 Modified RNA Oligo
GCTAGATGATTCCATCTGCAGTTTTAGAGCTAGAAATAGCAAGTTAAAATAAGGCTAGTCCGTTATCAACTTGAAAAAGTGG
CACCGAGTCGGTGCTTTT (SEQ ID NO: 156)

CD31 sNRA s2 Modified RNA Oligo
GGCTTCCATTAGCGCGGGTTTTAGAGCTAGAAATAGCAAGTTAAAATAAGGCTAGTCCGTTATCAACTTGAAAAAGTGGC
ACCGAGTCGGTGCTTTT (SEQ ID NO: 158)

AAVS1 sRNA modified oligo
GTCACCAATCCTGTCCCTAGTTTTAGAGCTAGAAATAGCAAGTTAAAATAAGGCTAGTCCGTTATCAACTTGAAAAAGTGG
ACCGAGTCGGTGCTTTT (SEQ ID NO: 159)

ED.1 sNRA s3 Modified RNA Oligo
GCCTCCTCTGTGACGAAGCTTTTAGACTAGAAATAGCAAGTTAAAATAAGGCTAGTCCGTTATCAACTTGAAAAAGTGG
CACCGAGTCGGTGCTTTT (SEQ ID NO: 154)

CTL.A4 sNRA s3 Modified RNA Oligo
GCTAGATGATTCCATCTGCAGTTTTAGAGCTAGAAATAGCAAGTTAAAATAAGGCTAGTCCGTTATCAACTTGAAAAAGTGG
CACCGAGTCGGTGCTTTT (SEQ ID NO: 156)

CD31 sNRA s3 Modified RNA Oligo
GGCTTCCATTAGCGCGGGTTTTAGAGCTAGAAATAGCAAGTTAAAATAAGGCTAGTCCGTTATCAACTTGAAAAAGTGGC
ACCGAGTCGGTGCTTTT (SEQ ID NO: 158)

AAVS1 sRNA modified oligo
GTCACCAATCCTGTCCCTAGTTTTAGAGCTAGAAATAGCAAGTTAAAATAAGGCTAGTCCGTTATCAACTTGAAAAAGTGG
ACCGAGTCGGTGCTTTT (SEQ ID NO: 159)

TARGET SITE
BACKBONE
2-O-METHYL 3'PHOSPHOROTHIOATE (Ms)

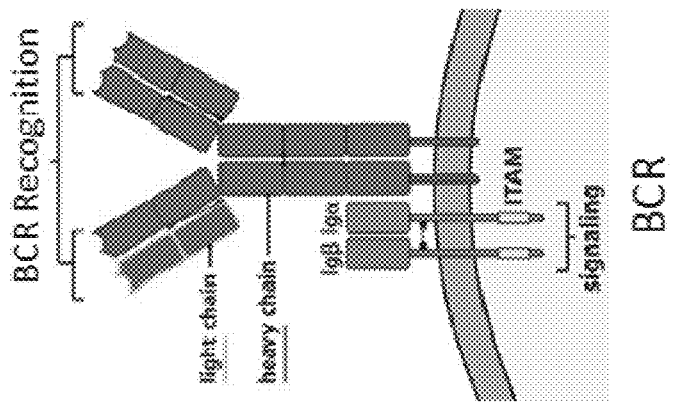
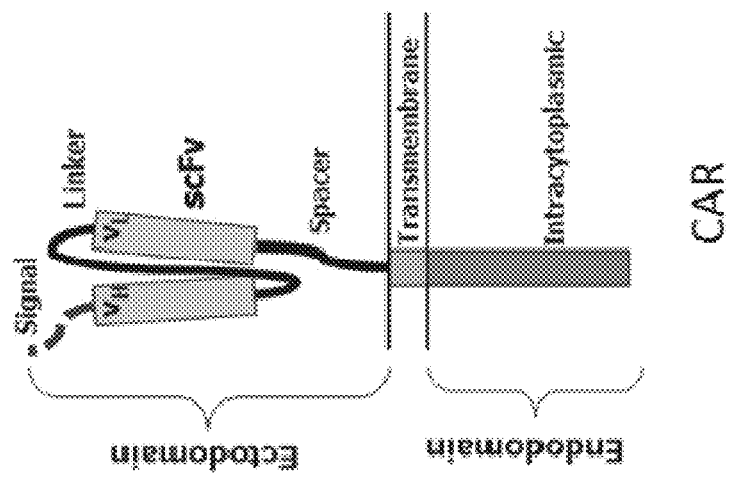
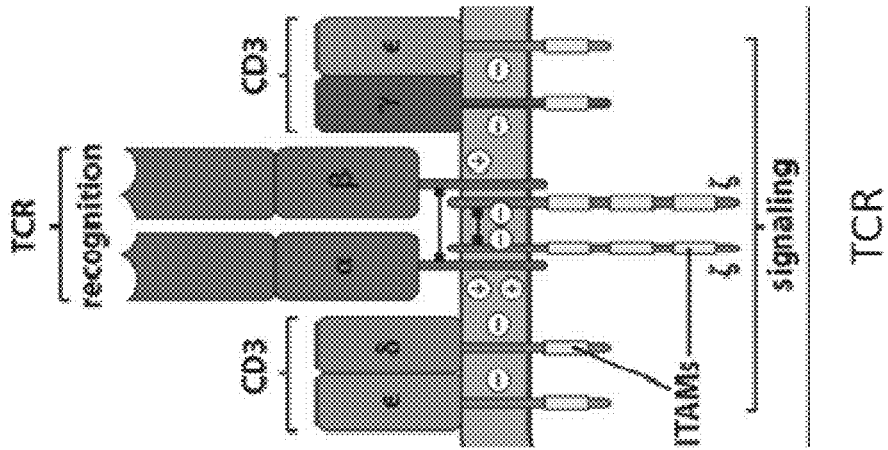
FIG. 57 A     FIG. 57 B     FIG. 57 C

N-1019
Pseudouridine-5'-Triphosphate
*Pseudo-UTP, 5-Ribosyl Uracil*
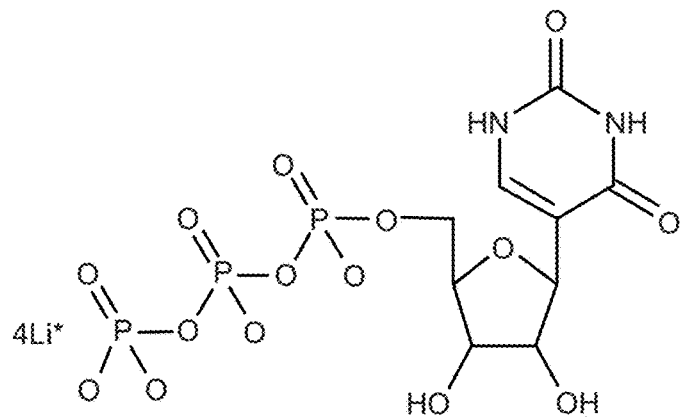
N-1014
5-Methylcytidine-5'-Triphosphate
*5-Methyl-CTP- 5-Me-CTP, 5mCTP, 5-mCTP*
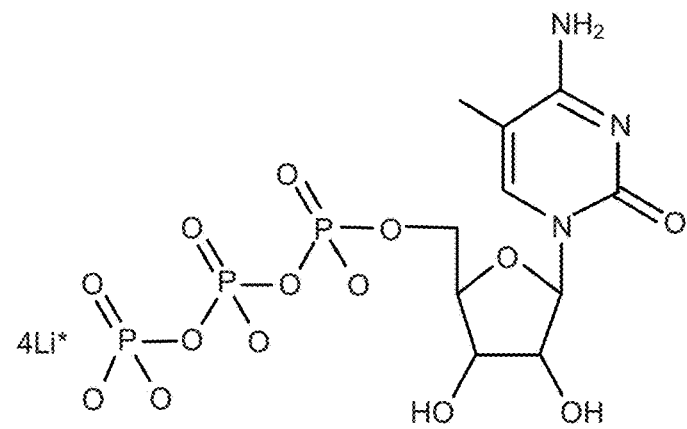
FIG. 59

FIG. 70 A
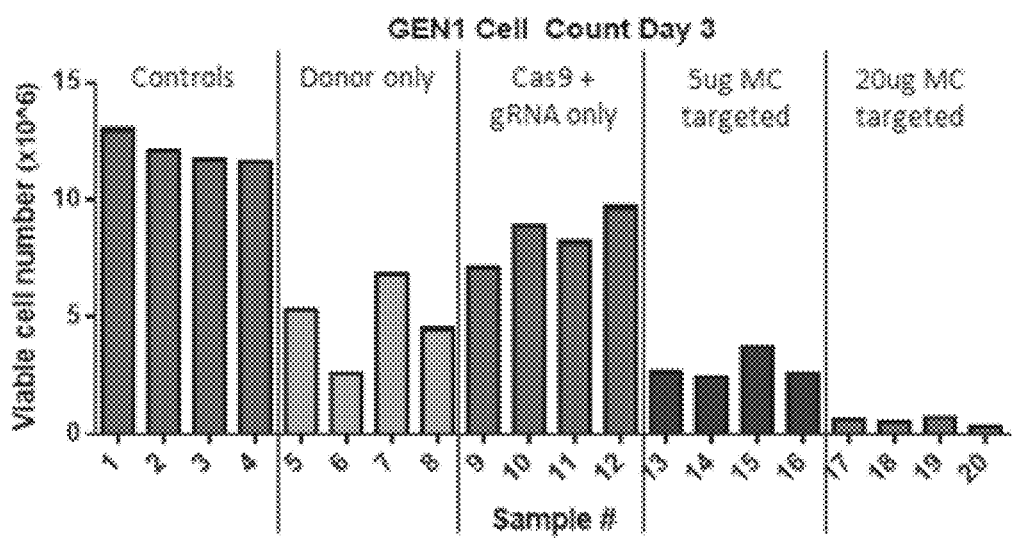
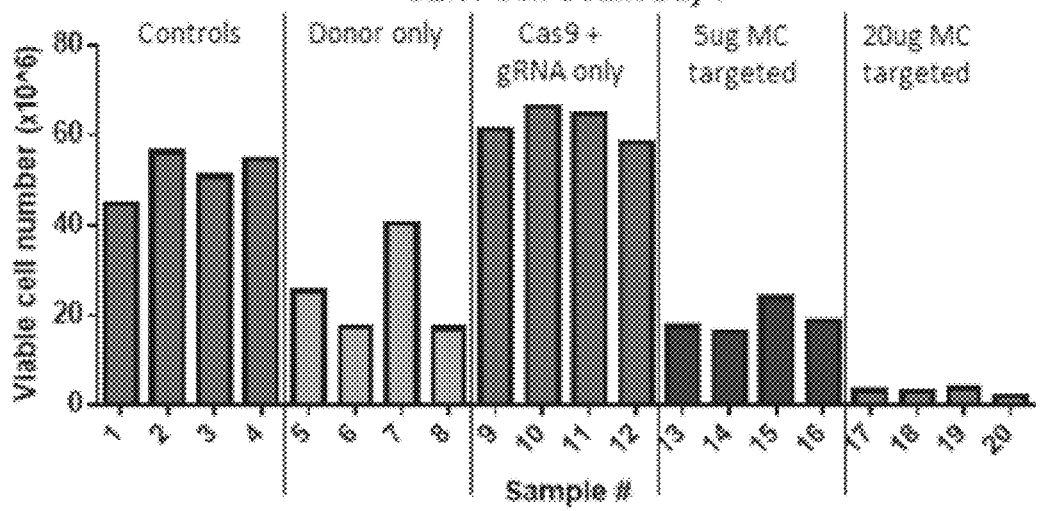
FIG. 70 B

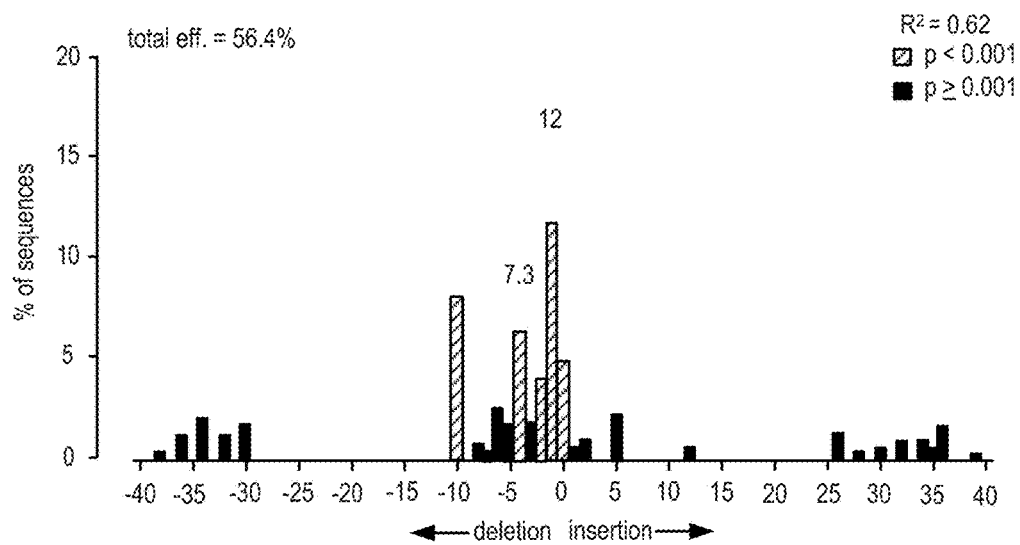
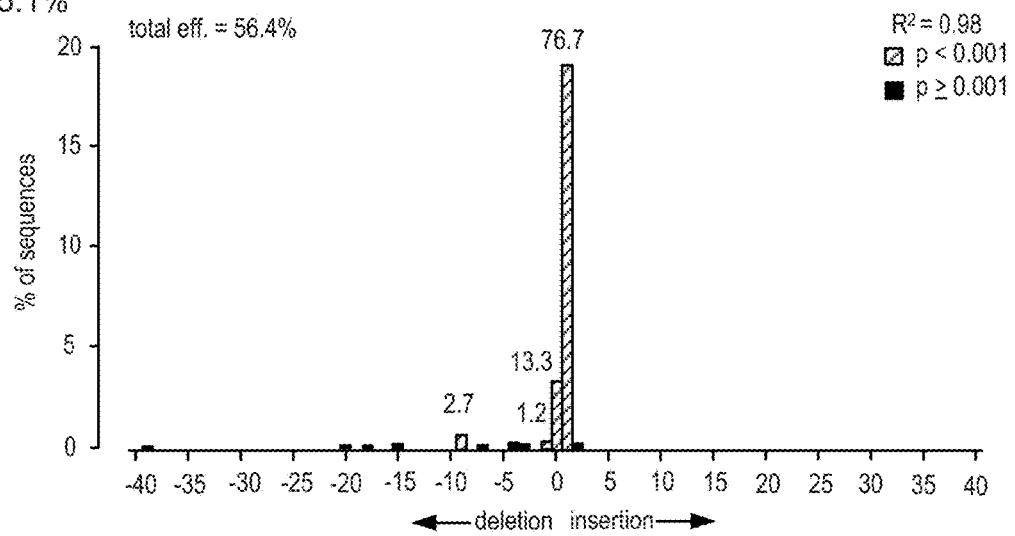
FIG. 76B

FIG. 81 A
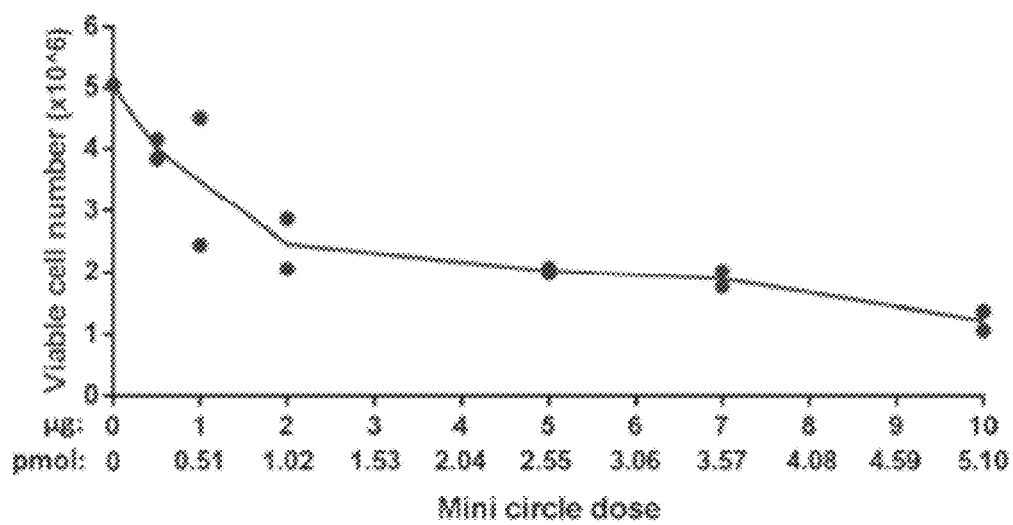
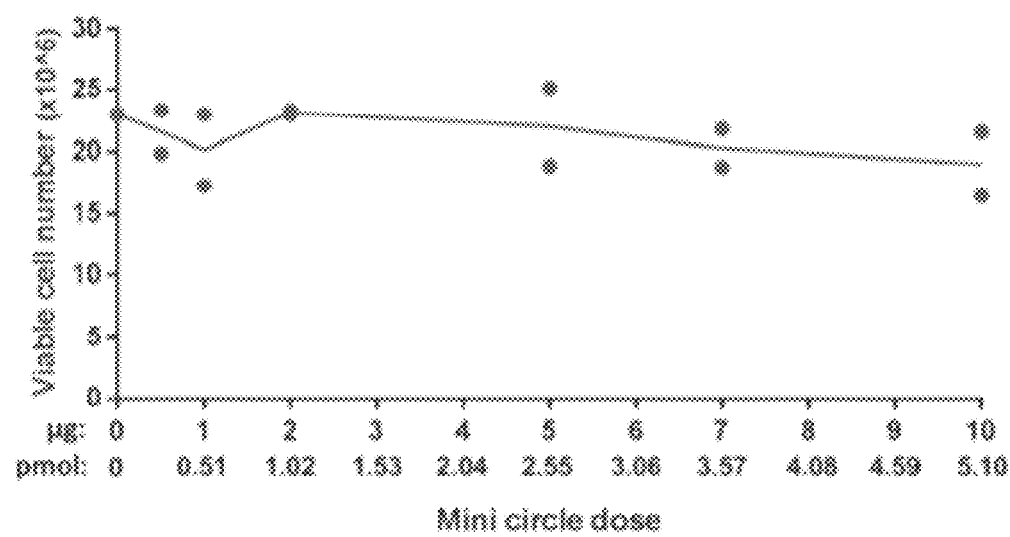
FIG. 81 B

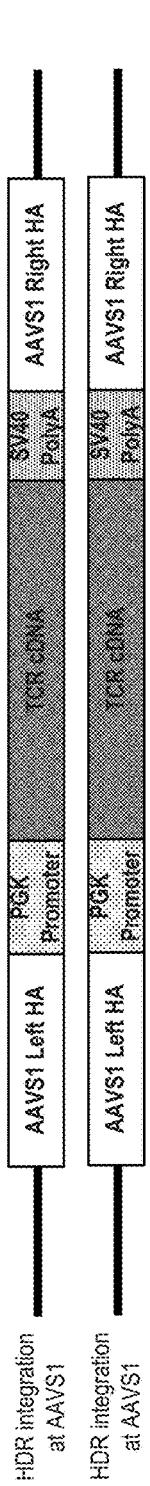
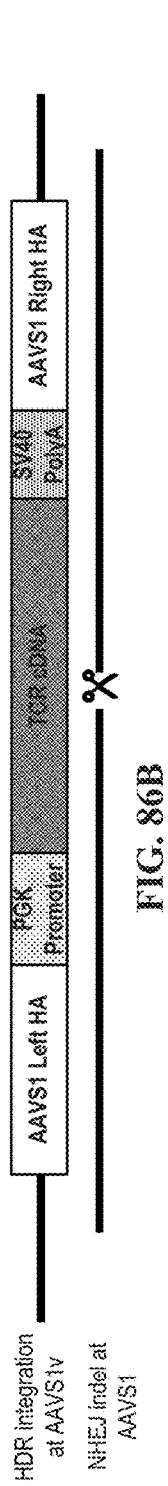
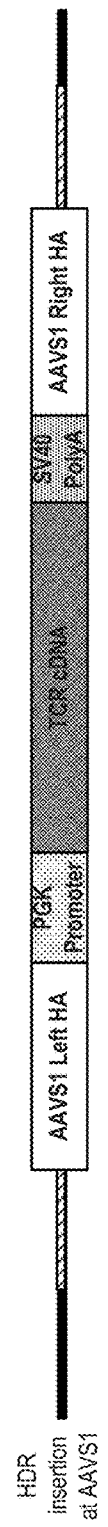
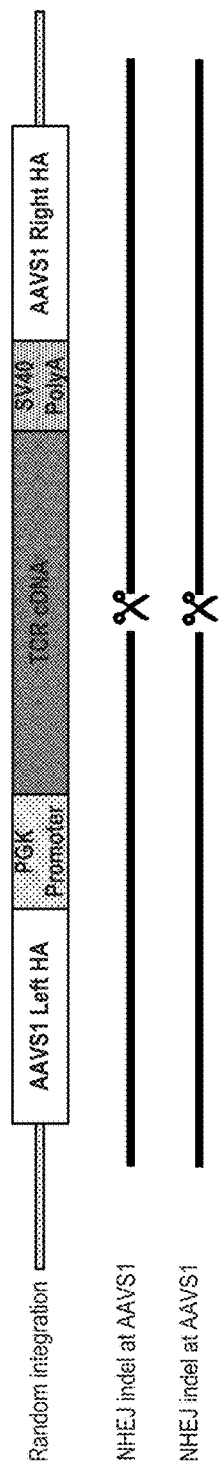
FIG. 86A
FIG. 86B
FIG. 86C
FIG. 86D

FIG. 101 A

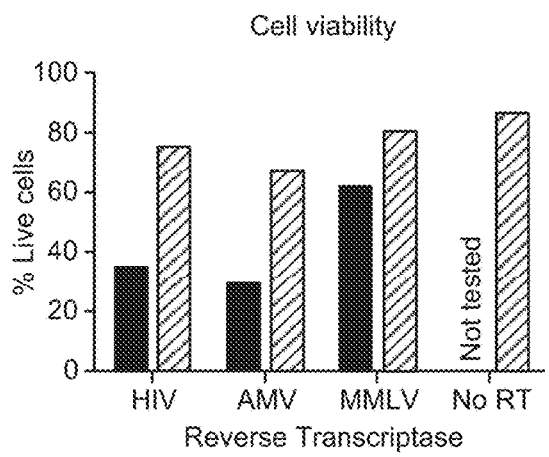

FIG. 101 B

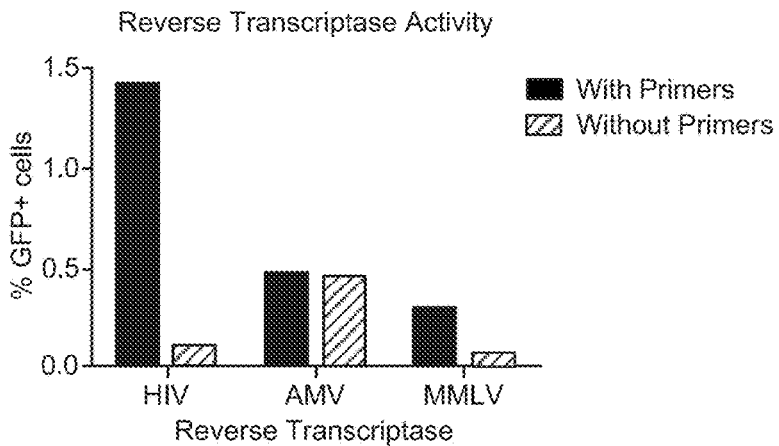

| With Primers | | |
|---|---|---|
| HIV | AMV | MMLV |
| 1 million cells | 1 million cells | 1 million cells |
| 2ug HIV RTp66 plasmid | 2ug AMV RTlarge plasmid | 2ug MMLV RT plasmid |
| 2ug HIV RTp51 plasmid | 2 g AMV RTsmall plasmid | |
| .125 pmol Forward primer | .125 pmol Forward primer | .125 pmol Forward primer |
| .125 pmol Reverse primer | .125 pmol Reverse primer | .125 pmol Reverse primer |
| Without Primers | | |
| HIV | AMV | MMLV |
| 1 million cells | 1 million cells | 1 million cells |
| 2ug HIV RTp66 plasmid | 2ug AMV RTlarge plasmid | 2ug MMLV RT plasmid |
| 2ug HIV RTp51 plasmid | 2ug AMV RTsmall plasmid | |

INTRACELLULAR GENOMIC TRANSPLANT AND METHODS OF THERAPY

CROSS REFERENCE

This application claims the benefit of U.S. Provisional Application Nos. 62/199,905, filed Jul. 31, 2015; 62/232,983, filed Sep. 25, 2015; 62/286,206, filed Jan. 22, 2016; 62/295,670, filed Feb. 16, 2016; 62/330,464, filed May 2, 2016; and 62/360,245, filed Jul. 8, 2016 all of which are herein incorporated by reference in their entirety.

GOVERNMENT INTEREST STATEMENT

This invention was made with government support under project numbers Z01BC010985 and Z01BC010763 awarded by the National Institutes of Health, National Cancer Institute. The government has certain rights in the invention.

SEQUENCE LISTING

The instant application contains a Sequence Listing which has been submitted electronically in ASCII format and is hereby incorporated by reference in its entirety. Said ASCII copy, created on Sep. 6, 2016, is named 47533_712_201_SL.txt and is 5,460,535 bytes in size.

BACKGROUND

Despite remarkable advances in cancer therapeutics over the last 50 years, there remain many tumor types that are recalcitrant to chemotherapy, radiotherapy or biotherapy, particularly in advanced stages that cannot be addressed through surgical techniques. Recently there have been significant advances in the genetic engineering of lymphocytes to recognize molecular targets on tumors in vivo, resulting in remarkable cases of remission of the targeted tumor. However, these successes have been limited largely to hematologic tumors, and more broad application to solid tumors is limited by the lack of an identifiable molecule that is expressed by cells in a particular tumor, and lack of a molecule that can be used to specifically bind to the tumor target in order to mediate tumor destruction. Some recent advances have focused on identifying tumor-specific mutations that in some cases trigger an antitumor T cell response. For example, these endogenous mutations can be identified using a whole-exomic-sequencing approach. Tran E, et al., "Cancer immunotherapy based on mutation-specific CD4+ T cells in a patient with epithelial cancer," Science 344: 641-644 (2014).

The disclosed compositions and methods herein can be used for the identification of cancer-specific T Cell Receptors (TCRs) that recognize unique immunogenic mutations in a patient's cancer and to treat any type of cancer within a patient. Insertion of these transgenes encoding the cancer-specific TCR into T cells using non-viral (e.g., CRISPR, TALEN, transposon-based, ZEN, meganuclease, or Mega-TAL) methods are innovative approaches that opens new opportunities for extending immunotherapy to many cancer types.

INCORPORATION BY REFERENCE

All publications, patents, and patent applications herein are incorporated by reference to the same extent as if each individual publication, patent, or patent application was specifically and individually indicated to be incorporated by reference. In the event of a conflict between a term herein and a term in an incorporated reference, the term herein controls.

SUMMARY OF THE INVENTION

Disclosed herein are engineered cells comprising at least one gene disruption and at least one non-virally integrated T cell receptor (TCR) sequence, where the gene can be disrupted by the non-virally integrated TCR sequence. In some cases, the gene can be a checkpoint gene, for example, the gene can be an immune checkpoint gene. The gene can be adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS SITE (E.G. AAVS1, AAVS2, ETC.)), or chemokine (C—C motif) receptor 5 (gene/pseudogene) (CCR5). In some cases the gene can be PD-1.

The engineered cell can comprises a single TCR sequence. The TCR sequence can comprises an engineered TCR sequence. The TCR sequence can comprise two or more chains. The two or more chains can comprise at least one alpha chain. The two or more chains can comprise at least one beta chain. The TCR sequence can comprises an extracellular region, a transmembrane region, and an intracellular region. The TCR sequence can produce a functional TCR. The TCR sequence can recognizes antigen. The TCR sequence can recognize antigen in the context of a major histocompatibility complex (MHC). The MHC can be class I. The MHC can be HLA-A02. The MHC can be class II. The TCR can bind to a mutation. The mutation that the TCR binds to can be identified by whole-exomic sequencing. The TCR can bind to cancer cells.

The engineered cell can be a primary cell. The engineered cell can be an immune cell. The engineered cell can be a T cell, a stem cell, or a progenitor cell. The engineered cell can be a hematopoietic progenitor cell. The engineered cell can be a human cell. The engineered cell can be selected. The engineered cell can be expanded ex vivo. The engineered cell can be expanded in vivo. The engineered cell can be CD45RO(−), CCR7(+), CD45RA(+), CD62L(+), CD27(+), CD28(+), or IL-7Rα(+). The engineered cell can be autologous to a subject in need thereof. The engineered cell can be non-autologous to a subject in need thereof. The engineered cell can be a good manufacturing practices (GMP) compatible reagent. The engineered cell can be a part of a combination therapy to treat cancer, infections, autoimmune disorders, or graft-versus-host disease (GVHD) in a subject in need thereof.

Also disclosed herein are methods for making an engineered cell comprising a) non-virally introducing into a cell one or more polynucleic acids comprising at least one exogenous T cell receptor (TCR) sequence flanked by recombination arms; and b) contacting the at least one exogenous TCR sequence with a double stranded break region that comprises a gene. The recombination arms can be complementary to a portion of the gene. The gene can be adenosine A2a receptor, CD276, V-set domain containing T cell activation inhibitor 1, B and T lymphocyte associated, cytotoxic T-lymphocyte-associated protein 4, indoleamine 2,3-dioxygenase 1, killer cell immunoglobulin-like receptor, three domains, long cytoplasmic tail, 1, lymphocyte-activation gene 3, programmed cell death 1 (PD-1), hepatitis A virus cellular receptor 2, V-domain immunoglobulin suppressor of T-cell activation, or natural killer cell receptor 2B4. In some cases, the gene can be PD-1. In some cases, the gene can be a checkpoint gene. In some cases, the checkpoint gene can be an immune checkpoint gene.

The double strand break region can be repaired by insertion of the at least one exogenous TCR sequence. The insertion of the at least one exogenous TCR sequence can comprise disruption of the at least one gene. The insertion of the at least one exogenous TCR sequence can be assisted by a homologous recombination (HR) enhancer. The enhancer can be derived from a viral protein. The enhancer can be E1B55K, E4orf6, Scr7, or L755507. In some cases, the enhancer can be a chemical inhibitor. In some cases, the enhancer inhibits Ligase IV. In some cases, the enhancer can facilitate insertion of the TCR sequence. The insertion can comprise homology directed repair.

In some cases, the double strand break region can be created by CRISPR, TALEN, transposon-based, ZEN, meganuclease, or Mega-TAL. In some cases, the double strand break region can be created by CRISPR. In some cases, CRISPR can be multiplexed. In some cases, multiplexing can be performed by adding at least 2 guide RNAs. The TCR sequence can be inserted near the double strand break region.

In some cases, the polynucleic acid can be RNA. In some cases, the RNA can be mRNA. In some cases, the cell can be contacted with reverse transcriptase (RT). In some cases, the cell can be contacted with primers that are complementary to the polynucleic acid. In some cases, the RT transcribes the mRNA into a first ssDNA template. In some cases, the RT transcribes the first ssDNA template into a second dsDNA template. In some cases, transcribing can be performed in situ. The ssDNA or dsDNA can comprise the at least one exogenous TCR sequence. In some cases, primer sequences can be used to determine the presence of an RT. A Reverse Transcriptase (RT) reporter forward primer can be AAC GTG CTG GTT GTT GTG CTG (SEQ ID NO 180). In other cases, a Reverse Transcriptase (RT) reporter reverse primer can be used. An RT reporter reverse primer can be AAA GTG GTG GTA GAA TAG GCT C (SEQ ID NO 181).

In some cases, non-viral introduction can comprise electroporation or nucleofection. A polynucleic acid can be co-delivered with at least one modifier that alters cellular response to a polynucleic acid. At least one modifier can reduce cellular toxicity. A modifier can comprise abPan Caspase Inhibitor Z-VAD-FMK or BX795. The invention can comprise a primary cell. The primary cell can be an immune cell. The immune cell can be a T cell, a stem cell, or a progenitor cell. The method can comprise a progenitor cell. In some cases a progenitor cell is a hematopoietic progenitor cell. In some cases the cell is a human cell. The method can be good manufacturing practices (GMP) compatible.

In some cases, a subject in need thereof receives treatment comprising administering to the subject a therapeutically effective amount of a pharmaceutical composition comprising an engineered cell. A pharmaceutical composition can be administered intravenously. A pharmaceutical composition can be administered locally. In some cases, a method can further comprise administering one more or more additional therapies. The one or more additional therapies can comprise transplantation. The one or more additional therapies can comprise immunotherapy. In some cases, the engineered cell can be autologous to the subject. In some cases, the engineered cell can be allogenic to the subject.

Also disclosed herein are polynucleic acids comprising at least one exogenous T cell receptor (TCR) sequence flanked by at least two recombination arms having a sequence complementary to a genomic sequence that can be adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS SITE (E.G. AAVS1, AAVS2, ETC.)), or chemokine (C—C motif) receptor 5 (gene/pseudogene) (CCR5).

The polynucleic acid sequence can be complementary to a genomic sequence that can be a partial sequence. In some cases, binding of the recombination arms to the sequence complementary to a genomic sequence inserts the exogenous TCR sequence. In some cases, binding of the recombination arms to the sequence complementary to a genomic sequence repairs a double strand break. In some cases, the genomic sequence comprises a coding sequence. In some cases, the genomic sequence comprises a non-coding sequence. In some cases, the genomic sequence comprises one or more genes. Insertion of the exogenous TCR sequence can disrupt one or more genes. In some cases, the genomic sequence can be PD-1.

In some cases, the polynucleic acid can be a plasmid vector. The plasmid vector can comprise a promoter. In some cases, the promoter can be constitutive. In some cases, the promoter can be inducible. The promoter can be CMV, U6, MND, or EF1a. In some cases, the promoter can be adjacent to the exogenous TCR sequence. In some cases, the plasmid vector further comprises a splicing acceptor. In some cases, the splicing acceptor can be adjacent to the exogenous TCR sequence. An MND promoter can be a synthetic promoter that contains a U3 region of a modified MoMuLV LTR with a myeloproliferative sarcoma virus enhancer.

In some cases, the plasmid vector further comprises an "ATG" sequence. The "ATG" sequence can be adjacent to the TCR sequence. In some cases, the TCR sequence encodes for a fusion protein. In some cases, the TCR sequence can be within a multicistronic vector. In some cases, the polynucleic acid comprises an exogenous promoter, an endogenous promoter via splicing, and/or an endogenous promoter via in frame translation.

In some cases, the plasmid can be modified. The modification can comprise demethylation, addition of CpG methylation, removal of bacterial methylation, and addition of mammalian methylation. The TCR sequence can be an engineered TCR sequence. In some cases, the polynucleic acid can be designed to be delivered to a cell by non-viral techniques. In some cases, the polynucleic acid can be a good manufacturing practices (GMP) compatible reagent.

Disclosed herein are also methods for facilitating homology directed repair (HDR) comprising: a) non-virally introducing into a cell an mRNA, reverse transcriptase (RT), enhancer, and primer; b) reverse transcribing the mRNA into one or more copies of a polynucleic acid; and c) facilitating HDR between the genome of the cell and of the polynucleic acid. In some cases, the method can comprise generating a double stranded break. In some cases, the double strand break can be performed by CRISPR, TALEN, transposon-based, ZEN, meganuclease, and Mega-TAL. In some cases, the double strand break can be performed by CRISPR. In some cases, the HDR of c) repairs the double strand break. In some cases, the CRISPR can be multiplexed with at least two (2) guide RNAs. In some cases, the polynucleic acid can be DNA. In some cases, the polynucleic acid can be cDNA. In some cases, the polynucleic acid can be single stranded.

In some cases, the RT transcribes the mRNA into a first ssDNA template. In some cases, the polynucleic acid can be double stranded. In some cases, the RT transcribes the mRNA into a second dsDNA template in situ. The mRNA or polynucleic acid can comprises at least one TCR sequence. In some cases, the TCR sequence comprises at least two flanking recombination arms having a sequence complementary to a genomic region. In some cases, the TCR sequence can be used in HDR of c). In some cases, the TCR sequence can be used in HDR of c) and further comprises binding of the recombination arms to a complementary portion of the genome of the cell. In some cases, the TCR sequence can be used in HDR of c) and further comprises binding of the recombination arms to a complementary portion of the genome of the cell and further comprises insertion of the TCR sequence. In some cases, HDR between the genome of the cell and of the polynucleic acid disrupts one or more genes. One or more genes can comprise an immune checkpoint gene. In some cases, one or more genes comprise adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS SITE (E.G. AAVS1, AAVS2, ETC.)), or chemokine (C—C motif) receptor 5 (gene/pseudogene) (CCR5). In some cases, one or more genes comprise PD-1. In some cases, one or more genes comprise a TCR.

In some cases, HDR between the genome of the cell and of the polynucleic acid can be assisted by one or more homologous recombination (HR) enhancers. The one or more enhancers can comprise a viral protein. In some cases, one or more enhancers comprise E1B55K, E4orf6, Scr7, and/or L755507. In some cases, the enhancer comprises a chemical inhibitor. In some cases, the enhancer inhibits Ligase IV. In some cases, the enhancer facilitates insertion of the polynucleic acid into the genome of the cell. The enhancer can prevent non homologous end joining (NHEJ). In some cases, the polynucleic acid can be inserted at or near the double strand break. In some cases, the mRNA, reverse transcriptase, primer, HR enhancer, and CRISPR are contacted with the cell. In some cases, the polynucleic acid, CRISPR, and HR enhancer are contacted with the cell. The cell can be a primary cell. The cell can be an immune cell. The cell can be a T-cell, a stem cell, or a progenitor cell. In some cases, the cell is a T cell. In some cases, the cell is a progenitor cell. In some cases the cell is a hematopoietic progenitor cell. The cell can be human. In some cases, the T cell can be autologous. In some cases, the T cell can be non-autologous. In some cases, the method can be good manufacturing practices (GMP) compatible.

Disclosed herein are also methods for reducing cellular toxicity to an exogenous engineered polynucleic acid comprising altering one or more cellular responses to the polynucleic acid. The one or more cellular response can comprise a cytosolic DNA-sensing pathway. In some cases, altering one or more cellular responses comprises modifying DNA-dependent activator of IFN regulatory factors (DAI), IFN inducible protein 16 (IFI16), DEAD box polypeptide 41 (DDX41) ("DEAD disclosed as SEQ ID NO: 160), absent in melanoma 2 (AIM2), DNA-dependent protein kinase, cyclic guanosine monophosphate-adenosine monophosphate synthase (cGAS), stimulator of IFN genes (STING), TANK-binding kinase (TBK1), interleukin-1 β (IL-1β), MRE11, meiotic recombination 11, Trex1, cysteine protease with aspartate specificity (Caspase-1), three prime repair exonuclease, DNA-dependent activator of IRFs (DAI), IFI16, DDX41, DNA-dependent protein kinase (DNA-PK), meiotic recombination 11 homolog A (MRE11), and/or IFN regulatory factor (IRF) 3 and 7. In some cases, one or more compounds alter one or more cellular responses. One or more compounds can comprise an inhibitor. One or more compounds can comprise an activator. In some cases, one or more compounds comprise Pan Caspase Inhibitor, Z-VAD-FMK, and/or Z-VAD-FMK.

In some cases, one or more compounds are modified. One or more compounds can prevent cellular apoptosis and pyropoptosis. In some cases, one or more compounds can inhibit Caspase-1 from cleaving proIL-1β and proIL-18. In some cases, one or more compounds can modulate activity of an apoptosis-associated speck-like protein containing a CARD (ASC). One or more compounds can modulate a cGAS-STING pathway. One or more compounds can prevent expression of type I interferons. In some cases, one or more compounds can comprise two or more compounds. In some cases the compound can be good manufacturing practices (GMP) compatible.

In some cases, the compound can be contacted with the cell prior to contacting the cell with the one or more exogenous engineered polynucleic acids. In some cases, the method can further comprise contacting the cell with one or more homologous recombination (HR) enhancers.

In some cases, the method can further comprise selecting the cell. In some cases, the method can further comprise expanding the cell. In some cases, the method produces a GMP compatible cellular therapy.

Disclosed herein are methods for genome engineering comprising a) contacting a cell with one or more signaling modifier compounds; and b) contacting the cell with a polynucleic acid comprising at least one antigen receptor sequence flanked by at least two recombination arms complementary to at least one genomic region. In some cases, the one or more signaling modifier compound alters a cytosolic DNA-sensing pathway. In some cases, the one or more signaling modifier compound alters DNA-dependent activator of IFN regulatory factors (DAI), IFN inducible protein 16 (IFI16), DEAD box polypeptide 41 (DDX41) ("DEAD" disclosed as SEQ ID NO: 160), absent in melanoma 2 (AIM2), DNA-dependent protein kinase, cyclic guanosine monophosphate-adenosine monophosphate synthase (cGAS), stimulator of IFN genes (STING), TANK-binding kinase (TBK1), interleukin-1β (IL-1β), MRE11, meiotic recombination 11, Trex1, cysteine protease with aspartate specificity (Caspase-1), three prime repair exonuclease, DNA-dependent activator of IRFs (DAI), IFI16, DDX41, DNA-dependent protein kinase (DNA-PK), meiotic recombination 11 homolog A (MRE11), and/or IFN regulatory factor (IRF) 3 and 7. In some cases, the one or more signaling modifier compound comprises an inhibitor. In some cases, the one or more signaling modifier compound comprises an activator. The one or more signaling modifier compound can comprise Pan Caspase Inhibitor, Z-VAD-FMK, and/or Z-VAD-FMK.

In some cases, the one or more signaling modifier compound can be modified. The one or more signaling modifier compound can prevent cellular apoptosis and pyropoptosis. In some cases, the one or more signaling modifier compound inhibits Caspase-1 from cleaving proIL-1β and proIL-18. The one or more signaling modifier compound can modulate activity of apoptosis-associated speck-like protein containing a CARD (ASC). In some cases, the one or more signaling modifier compound modulates a cGAS-STING pathway. The one or more signaling modifier compound can prevent expression of type I interferons. The one or more signaling modifier compound can comprise two or more compounds. In some cases, the one or more signaling modifier compound can be contacted with the cell prior to contacting the cell with the one or more exogenous engineered polynucleic acids. In some cases, the method can further comprise contacting the cell with one or more homologous recombination (HR) enhancers. In some cases the cell is a primary cell. In some cases the cell is an immune cell. In some cases the cell is a T cell, a stem cell, or a progenitor cell. The invention can comprise a progenitor cell. The cell can be a hematopoietic progenitor cell. The cell can be a human cell.

Also disclosed herein are unmethylated polynucleic acids comprising at least one engineered antigen receptor flanked by at least two recombination arms complementary to at least one genomic region. In some cases, the polynucleic acid can be modified. In some cases, the modification can be demethylation, addition of CpG methylation, removal of bacterial methylation, and/or addition of mammalian methylation. In some cases, the polynucleic acid can be capable of undergoing homologous recombination. In some cases, the recombination arms bind a complementary genomic region. In some cases, the antigen receptor comprises a TCR or a chimeric antigen receptor (CAR).

Also disclosed herein are mammalian methylated polynucleic acids comprising at least one engineered antigen receptor. In some cases, the polynucleic acid can be further modified. Modification can be demethylation, addition of CpG methylation, removal of bacterial methylation, and/or addition of mammalian methylation. In some cases, the polynucleic acid can be capable of undergoing homologous recombination. The mammalian methylated polynucleic acid can further comprise recombination arms that bind to at least one complementary genomic region. In some cases, the recombination arms bind a complementary genomic region. In some cases, the mammalian methylated polynucleic can comprise an antigen receptor comprising a TCR or a chimeric antigen receptor (CAR).

Also disclosed herein can be a composition for reducing cellular toxicity comprising a caspase modulator and cGAS-STING pathway modulator. A caspase modulator can alter a cytosolic DNA-sensing pathway. A cGAS-STING pathway modulator can alter a cytosolic DNA-sensing pathway. The cytosolic DNA-sensing pathway can comprise caspase-1. The caspase modulator can be a caspase inhibitor. The caspase modulator can inhibit caspase-1 from cleaving proIL-1β and proIL-18.

The cytosolic DNA-sensing pathway can comprise a DNA-dependent activator of IFN regulatory factors (DAI), IFN inducible protein 16 (IFI16), DEAD box polypeptide 41 (DDX41), absent in melanoma 2 (AIM2), DNA-dependent protein kinase, cyclic guanosine monophosphate-adenosine monophosphate synthase (cGAS), stimulator of IFN genes (STING), TANK-binding kinase (TBK1), interleukin-1 β(IL-1β), MRE11, meiotic recombination 11, Trex1, cysteine protease with aspartate specificity (Caspase-1), three prime repair exonuclease, DNA-dependent activator of IRFs (DAI), IFI16, DDX41, DNA-dependent protein kinase (DNA-PK), meiotic recombination 11 homolog A (MRE11), and/or IFN regulatory factor (IRF) 3 and 7. The cGAS-STING pathway modulator can be a cGAS-STING pathway inhibitor. The cGAS-STING pathway inhibitor can comprise a Pan Caspase Inhibitor, Z-VAD-FMK, and/or Z-VAD-FMK. The composition can prevent cellular apoptosis and pyropoptosis. The composition can prevent expression of type I interferons. In some cases, the composition can reduce cellular toxicity comprising a modified caspase modulator. In some cases, the composition can reduce cellular toxicity comprising a modified cGAS-STING pathway modulator. The modification can comprise deuteration, lipidization, glycosylation, alkylation, PEGylation, oxidation, phosphorylation, sulfation, amidation, biotinylation, citrullination, isomerization, ubiquitylation, protonation, small molecule conjugations, reduction, dephosphorylation, nitrosylation, and/or proteolysis. In some cases, the modification can improve activity of the modified caspase modulator and the modified cGAS-STING pathway modulator. The activity can increase by about or by 5%, 10%, 20%, 30%, 40%, 50%, 60%, 70, 80, 90, 100, 125, 150, 175, 200, 250, 300, 500, 750, or 1000% or more compared to a non-modified caspase modulator or non-modified cGAS-STING pathway modulator. The activity can increase by at least about or by at least 5%, 10%, 20%, 30%, 40%, 50%, 60%, 70, 80, 90, 100, 125, 150, 175, 200, 250, 300, 500, 750, or 1000% or more compared to a non-modified caspase modulator or non-modified cGAS-STING pathway modulator. The activity can increase by at least about or by at least 5%, 10%, 20%, 30%, 40%, 50%, 60%, 70, 80, 90, 100, 125, 150, 175, 200, 250, 300, 500, 750, or 1000% and up to 100% compared to a non-modified caspase modulator or non-modified cGAS-STING pathway modulator. In some cases, the composition is introduced to the cell. In some cases, the composition can prevent toxicity in a cell. In some cases, the cell is further contacted with the polynucleic acid.

Disclosed herein is a method for making an engineered cell comprising; introducing into a cell a guiding polynucleotide comprising a spacer region that is complementary to a target nucleic acid in a genomic region of the cell; a nuclease that is guided by the guiding polynucleotide; and a polynucleotide encoding an exogenous T cell receptor; site-specifically cleaving the target nucleic acid inside the cell by the nuclease guided by the guiding polynucleotide; and inserting the polynucleotide encoding the exogenous T cell receptor into the genomic region of the cell at the cleavage site. The nuclease can be Cas9. In some cases, the guiding polynucleotide can be a single guiding polynucleotide. The guiding polynucleotide can be RNA. The target nucleic acid can be DNA. The spacer region can be between 10-30 nucleotides in length. The nuclease can produce a double stranded break in the target nucleic acid.

In some cases the guiding polynucleotide can be introduced into a cell by electroporation. A guide nucleic acid can be introduced into a cell by nucleofection. A nuclease can also be introduced into a cell by a delivery vector. A polynucleotide encoding an exogenous T cell receptor can further comprise a promoter sequence. A promoter sequence can be a PKG or an MND promoter. An exogenous T cell receptor can be inserted by homologous recombination. A guiding polynucleotide and a nuclease can form a nucleoprotein complex.

Within the present invention, cleaving a target nucleic acid can remove a genomic nucleic acid sequence that is replaced with a polynucleotide encoding an exogenous T cell receptor. A polynucleotide encoding an exogenous T cell receptor can further comprise a first recombination arm and a second recombination arm. A first recombination arm can comprise a first sequence that is identical to a first portion of a target nucleic acid and a second recombination arm can comprise a second sequence that is identical to a second portion of a target nucleic acid. In some cases, a first recombination arm can comprise a first sequence that is identical to a first portion adjacent to a target nucleic acid and a second recombination arm can comprise a second sequence that is identical to a second portion adjacent to a target nucleic acid. A target nucleic acid can be within a gene. A gene can be selected from adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS SITE (E.G. AAVS1, AAVS2, ETC.)), or chemokine (C—C motif) receptor 5 (gene/pseudogene) (CCR5). A gene can be PD-1. A gene can be a checkpoint gene. A checkpoint gene can be an immune checkpoint gene.

In some cases, insertion of an exogenous TCR sequence at a cleavage site can result in disruption of a gene. A target nucleic acid can be within an intergenic site. An exogenous T cell receptor can be expressed in a cell. An engineered cell can be introduced into an organism. Engineered cells can be expanded ex vivo.

Within the present invention, non-homologous end joining (NHEJ) can be suppressed in a cell. Suppressing NHEJ in a cell can comprise inhibiting Ligase IV. Suppressing NHEJ in a cell can also comprise introducing a homologous recombination (HR) enhancer. An enhancer can be derived from a viral protein. An enhancer can be E1B55K, E4orf6, Scr7, or L755507. Suppressing NHEJ in a cell can facilitate insertion of a polynucleotide encoding an exogenous TCR at a cleavage site by homologous recombination.

Disclosed herein, can further comprise introducing into a cell a modifier to reduce cellular toxicity. A modifier can be Pan Caspase Inhibitor Z-VADFMK and/or BX795. A cell can be a T cell. A cell can be a mammalian cell. A cell can be a primary cell. A primary cell can be an immune cell. A cell can be a stem cell, or a progenitor cell. In some cases, a cell is a progenitor cell. A progenitor cell can be a hematopoietic progenitor cell. A cell can be a human cell.

Disclosed herein can also be a composition comprising an engineered cell. An engineered cell can be administered to a subject in a therapeutically effective amount. Administration of an engineered cell can produce a therapeutic outcome in a subject, wherein a therapeutic outcome is modulated by an exogenous TCR.

Disclosed herein can be an engineered cell comprising at least one exogenous receptor sequence that can be adjacent to a protospacer adjacent motif sequence of genomic DNA. In some cases, a protospacer adjacent motif sequence (PAM) can be recognized by a CRISPR endonuclease. An endonuclease can be a Cas protein. A Cas protein can be selected from a list comprising Cas1, Cas1B, Cas2, Cas3, Cas4, Cas5, Cas6, Cas7, Cas8, Cas9 (also known as Csn1 or Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, homologues thereof or modified versions thereof. In some cases, a CRISPR endonuclease can be Cas9. A Cas9 of the present invention can recognize a PAM sequence that may be 5' NGG 3'.

Disclosed herein can be at least one exogenous receptor that can disrupt at least one gene. A gene can be a checkpoint gene. A checkpoint gene can be selected from adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS SITE (E.G. AAVS1, AAVS2, ETC.)), or chemokine (C—C motif) receptor 5 (gene/pseudogene) (CCR5).

In some cases, a gene can comprise a protospacer. A protospacer can be disrupted by insertion of an exogenous receptor sequence. In some cases, at least one exogenous receptor sequence can be an immune receptor sequence. An immune receptor sequence can be selected from a list comprising a T cell receptor (TCR) sequence, a B cell receptor (BCR) sequence, or a chimeric antigen receptor (CAR) sequence. A TCR sequence can comprise two or more chains. Two or more chains can comprise at least one alpha chain in the present invention. Two or more chains can also comprise at least one beta chain. A TCR sequence can comprise an extracellular region, a transmembrane region, and an intracellular region. A TCR sequence can produce a functional TCR. A TCR sequence can recognize antigen. A TCR sequence can recognize antigen in the context of major histocompatibility complex (MHC). In some cases, MHC can be class I. In some cases, MHC can be HLA-A02. In other cases, MHC can be class II.

Disclosed herein can be an exogenous receptor that can bind to a mutation. A mutation can be identified by whole-exomic sequencing. An exogenous receptor sequence can bind to cancer cells. In some cases, a cell of the present invention can be a primary cell. A primary cell can be an immune cell. A cell can be a T cell, a stem cell, or a progenitor cell. A cell can be a progenitor cell. A progenitor cell can be a hematopoietic progenitor cell. A cell of the present invention can be a human cell. A cell can be selected. A cell can be expanded ex vivo. A cell can be expanded in vivo. A cell can also be CD45RO(−), CCR7(+), CD45RA (+), CD62L(+), CD27(+), CD28(+), IL-7Rα(+), or combinations thereof.

A cell of the present invention can be a cell that may be autologous to a subject in need thereof. A cell can also be non-autologous to a subject in need thereof. A cell can be a good manufacturing practices (GMP) compatible reagent. A cell can be part of a combination therapy to treat cancer, infections, autoimmune disorders, or graft-versus-host disease (GVHD) in a subject in need thereof. In some cases, a cell of the present invention can be administered of a subject in need thereof as a monotherapy.

Disclosed herein can be a composition comprising at least one guide RNA that binds to an endogenous cytokine inducible SH2-containing (CISH) gene and a secondary guide RNA that binds to an endogenous gene selected from the group consisting of adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), hypoxanthine phosphoribosyltransferase 1 (HPRT), adeno-associated virus integration site (AAVS SITE (E.G. AAVS1, AAVS2, ETC.)), and chemokine (C—C motif) receptor 5 (gene/pseudogene) (CCR5).

Disclosed herein can be an engineered cell with a disruption in an endogenous cytokine inducible SH2-containing (CISH) gene sequence and at least one secondary disruption in an endogenous gene. An endogenous gene can be selected from the group consisting of adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), hypoxanthine phosphoribosyltransferase 1 (HPRT), adeno-associated virus integration site (AAVS SITE (E.G. AAVS1, AAVS2, ETC.)), and chemokine (C—C motif) receptor 5 (gene/pseudogene) (CCR5).

In some cases, a cell of the present invention can further comprise an exogenous receptor. An exogenous receptor can be selected from a group comprising a T cell receptor (TCR), Chimeric Antigen Receptor (CAR), or B cell receptor (BCR). An exogenous receptor can binds to a mutation. A mutation can be identified by whole-exomic sequencing. An exogenous receptor can bind to cancer cells. An engineered cell can be a primary cell. A primary cell can be an immune cell. A cell can be a T cell, a stem cell, or a progenitor cell. A cell can be a progenitor cell. A progenitor cell can be a hematopoietic progenitor cell. A cell of the present invention can be a human cell.

Disclosed herein is a genetically modified immune cell comprising a lymphocyte, wherein a lymphocyte is derived from a human subject; a polynucleic acid-targeting polynucleic acid, wherein a polynucleic acid-targeting polynucleic acid is engineered to hybridize to a specific region of a target gene in a genome of a lymphocyte; a nuclease, wherein a nuclease is capable of associating with a polynucleic acid-targeting polynucleic acid to form a nucleoprotein complex, wherein a nucleoprotein complex can be capable of generating a targeted double-strand break in a target gene in a genome of a lymphocyte; and a target polynucleic acid, wherein a target polynucleic acid can be genomic DNA comprising a double-strand break in a target gene, wherein a double-strand break in a target gene results in disruption of a target gene function and wherein a disruption of a target gene function occurs with at least 60% efficiency when a nucleoprotein complex can be contacted with a population of primary lymphocytes, wherein a genetically modified immune cell can be capable of being expanded to generate a clonal population of lymphocytes with altered function of a target gene and wherein a clonal population of lymphocytes are suitable for administration to a human in need thereof.

Disclosed herein is a method for efficient checkpoint inhibitor disruption in T cells comprising contacting a T cell with a Cas9 nuclease and a guide RNA, wherein a guide RNA contains a region of 17 to 22 nucleotides that is substantially complementary to a region in a target gene; cleaving a target gene, wherein a target gene can be PD-1 and wherein a knock out event occurs in at least 30% of primary T cells when a population of primary T cells are contacted with a Cas9 nuclease and a guide RNA; and disrupting a checkpoint inhibitor in a T cell.

Disclosed herein is a method of treating a subject in need thereof, comprising collecting lymphocyte cells from a human; genetically modifying lymphocyte cells ex vivo by contacting a ribonuclease capable of knocking out PD-1 protein function by inducing a double strand break in a specific target region of genomic DNA in a lymphocyte cell, wherein a target region of genomic DNA in a lymphocyte is within a PD-1 gene and a double strand break occurs in a target region of genomic DNA that is 3' to a region of a target DNA that is capable of hybridizing to at least 15 nucleotides of a ribonuclease and is 5' to a region of a target DNA that contains a protospacer adjacent motif, expanding a population of genetically modified lymphocytes that have a knockout of PD-1 protein to generate a population of PD-1 knockout T cells; administering to a subject a population of PD-1 knockout T cells, wherein PD-1 knockout T cells are suitable for administration to a patient.

In some aspects, the present disclosure provides methods of making genetically modified cells comprising obtaining one or more cells from a subject. In some aspects, the method comprises introducing into the one or more cells a first nucleic acid. In some embodiments, the method comprises a first nucleic acid, and the first nucleic acid comprises a first transgene encoding at least one anti-DNA sensing protein. In some embodiments, the method comprises at least one DNA sensing pathway, and the at least one DNA sensing pathway is disrupted within the one or more cells by at least one anti-DNA sensing protein. In some aspects, the method comprises introducing into the one or more cells a second nucleic acid. In some embodiments, the method comprises a second nucleic acid, and the second nucleic acid comprises a second transgene encoding an engineered T-cell receptor (TCR. In some embodiments, the method comprises at least one endogenous immunological checkpoint gene, and the at least one endogenous immunological checkpoint gene is disrupted within the one or more cells by an insertion of the second transgene. In some embodiments, the method comprises the disruption of the at least one DNA sensing pathway reduces cytotoxicity induced by the second transgene, thereby maintaining or increasing viability of the one or more cells. In some embodiments, the method comprises one or more cells, and the one or more cells are immune cells. In some embodiments, the method comprises one or more cells, and the one or more cells are T cells, naïve T cells, CD4+ cells, CD8+ cells, stem cells, induced pluripotent stem cells, progenitor cells, hematopoetic cells, primary cells or any combination thereof. In some embodiments, the method comprises a first nucleic acid, and the first nucleic acid is DNA, RNA or a hybrid thereof. In some embodiments, the method comprises a first nucleic acid, and the first nucleic acid is single stranded or double stranded. In some embodiments, the method comprises a second nucleic acid, and the second nucleic acid is DNA, RNA or a hybrid thereof. In some embodiments, the method comprises a second nucleic acid, and the second nucleic acid is single stranded or double stranded. In some embodiments, the method comprises introducing a first nucleic acid, and introducing the first nucleic acid comprises non-viral transfection, biolistics, chemical transfection, electroporation, nucleofection, heat-shock transfection, lipofection, microinjection, or viral transfection. In some embodiments the method comprises viral transduction, and the viral transduction comprises an adeno-associated virus. In some embodiments, the method comprises at least one DNA sensing pathway comprising at least one DNA sensing protein, and the at least one DNA sensing protein is selected from the group consisting of three prime repair exonuclease 1 (TREX1), DEAD-box helicase 41 (DDX41) ("DEAD" disclosed as SEQ ID NO: 160), DNA-dependent activator of IFN-regulatory factor (DAI), Z-DNA-binding protein 1 (ZBP1), interferon gamma inducible protein 16 (IFI16), leucine rich repeat (In FLII) interacting protein 1 (LR-RFIP1), DEAH-box helicase 9 (DHX9) ("DEAH" disclosed as SEQ ID NO: 182), DEAH-box helicase 36 (DHX36) ("DEAH" disclosed as SEQ ID NO: 182), Lupus Ku autoantigen protein p70 (Ku70), X-ray repair complementing defective repair in chinese hamster cells 6 (XRCC6), stimulator of interferon gene (STING), transmembrane protein 173 (TMEM173), tripartite motif containing 32 (TRIM32), tripartite motif containing 56 (TRIM56), β-catenin (CTNNB1), myeloid differentiation primary response 88 (MyD88), absent in melanoma 2 (AIM2), apoptosis-associated speck-like protein containing a CARD (ASC), pro-caspase-1 (pro-CASP1), caspase-1 (CASP1), pro-interleukin 1 beta (pro-IL-1β), pro-interleukin 18 (pro-IL-18), interleukin 1 beta (IL-1β), interleukin 18 (IL-18), interferon regulatory factor 1 (IRF1), interferon regulatory Factor 3 (IRF3), interferon regulatory factor 7 (IRF7), interferon-stimulated response element 7 (ISRE7), interferon-stimulated response element 1/7 (ISRE1/7), nuclear factor kappa B (NF-κB), RNA polymerase III (RNA Pol III), melanoma differentiation-associated protein 5 (MDA-5), Laboratory of Genetics and Physiology 2 (LGP2), retinoic acid-inducible gene 1 (RIG-I), mitochondrial antiviral-signaling protein (IPS-1), TNF receptor associated factor 3 (TRAF3), TRAF family member associated NFKB activator (TANK), nucleosome assembly protein 1 (NAP1), TANK binding kinase 1 (TBK1), autophagy related 9A (Atg9a), tumor necrosis factor alpha (TNF-α), interferon lamba-1 (IFNλ1), a phosphorylated form of a protein thereof, or any combination or derivative thereof. In some embodiments, the method comprises disruption of at least one DNA sensing pathway, and the disruption of the at least one DNA sensing pathway comprises at least partial inhibition of at least one DNA sensing protein by the anti-DNA sensing protein. In some embodiments, the method comprises disruption of at least one DNA sensing pathway, and the disruption of the at least one DNA sensing pathway comprises activation of at least one DNA sensing protein by the anti-DNA sensing protein. In some embodiments, the method comprises at least one anti-DNA sensing protein, and the at least one anti-DNA sensing protein is selected from the group consisting of c-FLiP, HCMV pUL83, DENV NS2B-NS3, HPV18 E7, hAd5 E1A, HSV1 ICP0, VACV B13, VACV C16, TREX1, HCoV-NL63, SARS-CoV, HBV Pol, PEDV, and any combination or derivative thereof. In some embodiments, the method comprises at least one endogenous immunological checkpoint gene, and the at least one endogenous immunological checkpoint gene is PD-1. In some embodiments, the method comprises at least one endogenous immunological checkpoint gene, and the at least one endogenous immunological checkpoint gene is selected from the group consisting of adenosine A2a receptor (ADORA), CD276, V-set domain containing T cell activation inhibitor 1 (VTCN1), B and T lymphocyte associated (BTLA), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyl-transferase 1 (HPRT), adeno-associated virus integration site (AAVS SITE (E.G. AAVS1, AAVS2, ETC.)), or chemokine (C—C motif) receptor 5 (gene/pseudogene) (CCR5), CD160 molecule (CD160), T-cell immunoreceptor with Ig and ITIM domains (TIGIT), CD96 molecule (CD96), cytotoxic and regulatory T-cell molecule (CRTAM), leukocyte associated immunoglobulin like receptor 1 (LAIR1), sialic acid binding Ig like lectin 7 (SIGLEC7), sialic acid binding Ig like lectin 9 (SIGLEC9), tumor necrosis factor receptor superfamily member 10b (TNFRSF10B), tumor necrosis factor receptor superfamily member 10a (TNFRSF10A), caspase 8 (CASP8), caspase 10 (CASP10), caspase 3 (CASP3), caspase 6 (CASP6), caspase 7 (CASP7), Fas associated via death domain (FADD), Fas cell surface death receptor (FAS), transforming growth factor beta receptor II (TGF-BRII), transforming growth factor beta receptor I (TGFBR1), SMAD family member 2 (SMAD2), SMAD family member 3 (SMAD3), SMAD family member 4 (SMAD4), SKI proto-oncogene (SKI), SKI-like proto-oncogene (SKIL), TGFB induced factor homeobox 1 (TGIF1), programmed cell death 1 (PD-1), cytotoxic T-lymphocyte-associated protein 4 (CTLA4), interleukin 10 receptor subunit alpha (IL10RA), interleukin 10 receptor subunit beta (IL10RB), heme oxygenase 2 (HMOX2), interleukin 6 receptor (IL6R), interleukin 6 signal transducer (IL6ST), c-src tyrosine kinase (CSK), phosphoprotein membrane anchor with glycosphingolipid microdomains 1 (PAG1), signaling threshold regulating transmembrane adaptor 1 (SIT1), forkhead box P3 (FOXP3), PR domain 1 (PRDM1), basic leucine zipper transcription factor, ATF-like (BATF), guanylate cyclase 1, soluble, alpha 2 (GUCY1A2), guanylate cyclase 1, soluble, alpha 3 (GUCY1A3), guanylate cyclase 1, soluble, beta 2 (GUCY1B2), prolyl hydroxylase domain (PHD1, PHD2, PHD3) family of proteins, or guanylate cyclase 1, soluble, beta 3 (GUCY1B3), T-cell receptor alpha locus (TRA), T cell receptor beta locus (TRB), egl-9 family hypoxia-inducible factor 1 (EGLN1), egl-9 family hypoxia-inducible factor 2 (EGLN2), egl-9 family hypoxia-inducible factor 3 (EGLN3), protein phosphatase 1 regulatory subunit 12C (PPP1R12C), and any combination or derivative thereof. In some embodiments, the method comprises at least one endogenous immunological checkpoint gene, and the at least one endogenous immunological checkpoint gene comprises a double strand break. In some embodiments, the method comprises a double strand break, and creating the double strand break comprises CRISPR. In some embodiments, the method comprises a double strand break, and creating the double strand break comprises CRISPR, TALEN, transposon-based, ZEN, meganuclease, or Mega-TAL. In some embodiments, the method comprises a double strand break, and the double strand break is repaired by insertion of the second transgene encoding an engineered TCR. In some embodiments, the method comprises a second nucleic acid, and the second nucleic acid comprises recombination arms, and wherein the second transgene encoding an engineered TCR is flanked by the recombination arms. In some embodiments, the method comprises recombination arms, and the recombination arms are at least in part complementary to at least a portion of the at least one endogenous immunological checkpoint gene. In some embodiments of the methods of the present disclosure, an increase in isogenicity between the recombination arms and the at least one endogenous immunological checkpoint gene corresponds to an increase in efficiency of the insertion of the second transgene. In some embodiments, the method comprises insertion of the second transgene, and an efficiency of the insertion of the second transgene is measured using fluorescence-activated cell sorting. In some embodiments, the method comprises introducing a second nucleic acid, and introducing the second nucleic acid comprises non-viral transfection, biolistics, chemical transfection, electroporation, nucleofection, heat-shock transfection, lipofection, microinjection, or viral transfection. In some embodiments, the method comprises insertion of a second transgene, and the insertion of the second transgene encoding an engineered TCR comprises homology directed repair (HDR). In some embodiments, the method comprises insertions of a second transgene, and the insertion of the second transgene is assisted by a homologous recombination (HR) enhancer. In some embodiments, the method comprises an enhancer, and the enhancer is derived from a viral protein. In some embodiments, the method comprises an HR enhancer, and the HR enhancer is selected from the group consisting of E4orf6, E1b55K, E1b55K-H354, E1b55K-H373A, Scr7, L755507, or any combination thereof. In some embodiments, the method comprises an HR enhancer, and the HR enhancer is a chemical inhibitor. In some embodiments, the methods comprise an HR enhancer, and the HR enhancer inhibits Ligase IV. In some embodiments, the method comprises a reduction in cytotoxicity, and the cytotoxicity comprises at least one of DNA cleavage, cell death, apoptosis, nuclear condensation, cell lysis, necrosis, altered cell motility, altered cell stiffness, altered cytoplasmic protein expression, altered membrane protein expression, swelling, loss of membrane integrity, cessation of metabolic activity, hypoactive metabolism, hyperactive metabolism, increased reactive oxygen species, cytoplasmic shrinkage, or any combination thereof. In some embodiments, the method comprises measuring viability, and the viability is measured using at least one of fluorescence-activated cell sorting, trypan blue exclusion, CD4+ cell-surface markers, CD8+ cell-surface markers, telomere length, or any combination thereof. In some embodiments, the method comprises a subject, and the subject is a human subject.

In some aspects, the present disclosure provides methods of making a therapeutically effective composition comprising one or more cells. In some aspects, the method comprises measuring a viability of the one or more cells post gene editing. In some embodiments, the method comprises gene editing, and the gene editing comprises introducing into the one or more cells a first nucleic acid. In some embodiments, the method comprises a first nucleic acid, and the first nucleic acid comprises a first transgene encoding at least one anti-DNA sensing protein. In some embodiments, the method comprises at least one DNA sensing pathway, and the at least one DNA sensing pathway is disrupted within the one or more cells by the at least one anti-DNA sensing protein. In some embodiments, the method comprises gene editing, and the gene editing comprises introducing into the one or more cells a second nucleic acid. In some embodiments, the method comprises a second nucleic acid, and the second nucleic acid comprises a second transgene encoding an engineered T-cell receptor (TCR. In some embodiments, the method comprises at least one endogenous immunological checkpoint gene, and the at least one endogenous immunological checkpoint gene is disrupted within the one or more cells by an insertion of the second transgene. In some embodiments, the method comprises disruption of at least one DNA sensing pathway, and the disruption of the at least one DNA sensing pathway reduces cytotoxicity induced by the second transgene, thereby maintaining or increasing viability of the one or more cells. In some aspects, the method comprises measuring an efficiency of the gene editing of the one or more cells. In some aspects, the method comprises calculating an amount of the one or more cells necessary to effect a therapeutic response when administered to a subject. In some embodiments, the method comprises calculating an amount of cells necessary to effect a therapeutic response, and calculating the amount comprises the measured viability and the measured efficiency. In some aspects, the method comprises contacting the calculated amount of the one or more cells of with at least one excipient. In some aspects, the method comprises measuring the viability, and measuring the viability comprises at least one of fluorescence-activated cell sorting, trypan blue exclusion, CD4+ cell-surface markers, CD8+ cell-surface markers, telomere length, or any combination thereof. In some embodiments, the method comprises one or more cells, and the one or more cells are immune cells. In some embodiments, the method comprises one or more cells, and the one or more cells are T cells, naïve T cells, CD4+ cells, CD8+ cells, stem cells, induced pluripotent stem cells, progenitor cells, hematopoetic cells, primary cells or any combination thereof. In some embodiments, the method comprises a first nucleic acid, and the first nucleic acid is DNA, RNA or a hybrid thereof. In some embodiments, the method comprises a first nucleic acid, and the first nucleic acid is single stranded or double stranded. In some embodiments, the method comprises a second nucleic acid, and the second nucleic acid is DNA, RNA or a hybrid thereof. In some embodiments, the method comprises a second nucleic acid, and the second nucleic acid is single stranded or double stranded. In some embodiments, the method comprises introducing a first nucleic acid, and introducing the first nucleic acid comprises non-viral transfection, biolistics, chemical transfection, electroporation, nucleofection, heat-shock transfection, lipofection, microinjection, or viral transfection. In some embodiments the method comprises viral transduction, and the viral transduction comprises an adeno-associated virus. In some embodiments, the method comprises at least one DNA sensing pathway comprising at least one DNA sensing protein, and the at least one DNA sensing protein is selected from the group consisting of three prime repair exonuclease 1 (TREX1), DEAD-box helicase 41 (DDX41) ("DEAD" disclosed as SEQ ID NO: 160), DNA-dependent activator of IFN-regulatory factor (DAI), Z-DNA-binding protein 1 (ZBP1), interferon gamma inducible protein 16 (IFI16), leucine rich repeat (In FLII) interacting protein 1 (LRRFIP1), DEAH-box helicase 9 (DHX9) ("DEAH" disclosed as SEQ ID NO: 182), DEAH-box helicase 36 (DHX36) ("DEAH" disclosed as SEQ ID NO: 182), Lupus Ku autoantigen protein p70 (Ku70), X-ray repair complementing defective repair in chinese hamster cells 6 (XRCC6), stimulator of interferon gene (STING), transmembrane protein 173 (TMEM173), tripartite motif containing 32 (TRIM32), tripartite motif containing 56 (TRIM56), β-catenin (CTNNB1), myeloid differentiation primary response 88 (MyD88), absent in melanoma 2 (AIM2), apoptosis-associated speck-like protein containing a CARD (ASC), pro-caspase-1 (pro-CASP1), caspase-1 (CASP1), pro-interleukin 1 beta (pro-IL-1β), pro-interleukin 18 (pro-IL-18), interleukin 1 beta (IL-1β), interleukin 18 (IL-18), interferon regulatory factor 1 (IRF1), interferon regulatory Factor 3 (IRF3), interferon regulatory factor 7 (IRF7), interferon-stimulated response element 7 (ISRE7), interferon-stimulated response element 1/7 (ISRE1/7), nuclear factor kappa B (NF-κB), RNA polymerase III (RNA Pol III), melanoma differentiation-associated protein 5 (MDA-5), Laboratory of Genetics and Physiology 2 (LGP2), retinoic acid-inducible gene 1 (RIG-I), mitochondrial antiviral-signaling protein (IPS-1), TNF receptor associated factor 3 (TRAF3), TRAF family member associated NFKB activator (TANK), nucleosome assembly protein 1 (NAP1), TANK binding kinase 1 (TBK1), autophagy related 9A (Atg9a), tumor necrosis factor alpha (TNF-α), interferon lamba-1 (IFNλ1), a phosphorylated form of a protein thereof, or any combination or derivative thereof. In some embodiments, the method comprises disruption of at least one DNA sensing pathway, and the disruption of the at least one DNA sensing pathway comprises at least partial inhibition of at least one DNA sensing protein by the anti-DNA sensing protein. In some embodiments, the method comprises disruption of at least one DNA sensing pathway, and the disruption of the at least one DNA sensing pathway comprises activation of at least one DNA sensing protein by the anti-DNA sensing protein. In some embodiments, the method comprises at least one anti-DNA sensing protein, and the at least one anti-DNA sensing protein is selected from the group consisting of c-FLiP, HCMV pUL83, DENV NS2B-NS3, HPV18 E7, hAd5 E1A, HSV1 ICP0, VACV B13, VACV C16, TREX1, HCoV-NL63, SARS-CoV, HBV Pol, PEDV, and any combination or derivative thereof. In some embodiments, the method comprises at least one endogenous immunological checkpoint gene, and the at least one endogenous immunological checkpoint gene is PD-1. In some embodiments, the method comprises at least one endogenous immunological checkpoint gene, and the at least one endogenous immunological checkpoint gene is selected from the group consisting of adenosine A2a receptor (ADORA), CD276, V-set domain containing T cell activation inhibitor 1 (VTCN1), B and T lymphocyte associated (BTLA), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS SITE (E.G. AAVS1, AAVS2, ETC.)), or chemokine (C—C motif) receptor 5 (gene/pseudogene) (CCR5), CD160 molecule (CD160), T-cell immunoreceptor with Ig and ITIM domains (TIGIT), CD96 molecule (CD96), cytotoxic and regulatory T-cell molecule (CRTAM), leukocyte associated immunoglobulin like receptor 1 (LAIR1), sialic acid binding Ig like lectin 7 (SIGLEC7), sialic acid binding Ig like lectin 9 (SIGLEC9), tumor necrosis factor receptor superfamily member 10b (TNFRSF10B), tumor necrosis factor receptor superfamily member 10a (TNFRSF10A), caspase 8 (CASP8), caspase 10 (CASP10), caspase 3 (CASP3), caspase 6 (CASP6), caspase 7 (CASP7), Fas associated via death domain (FADD), Fas cell surface death receptor (FAS), transforming growth factor beta receptor II (TGFBRII), transforming growth factor beta receptor I (TGFBR1), SMAD family member 2 (SMAD2), SMAD family member 3 (SMAD3), SMAD family member 4 (SMAD4), SKI proto-oncogene (SKI), SKI-like proto-oncogene (SKIL), TGFB induced factor homeobox 1 (TGIF1), programmed cell death 1 (PD-1), cytotoxic T-lymphocyte-associated protein 4 (CTLA4), interleukin 10 receptor subunit alpha (IL10RA), interleukin 10 receptor subunit beta (IL10RB), heme oxygenase 2 (HMOX2), interleukin 6 receptor (IL6R), interleukin 6 signal transducer (IL6ST), c-src tyrosine kinase (CSK), phosphoprotein membrane anchor with glycosphingolipid microdomains 1 (PAG1), signaling threshold regulating transmembrane adaptor 1 (SIT1), forkhead box P3 (FOXP3), PR domain 1 (PRDM1), basic leucine zipper transcription factor, ATF-like (BATF), guanylate cyclase 1, soluble, alpha 2 (GUCY1A2), guanylate cyclase 1, soluble, alpha 3 (GUCY1A3), guanylate cyclase 1, soluble, beta 2 (GUCY1B2), prolyl hydroxylase domain (PHD1, PHD2, PHD3) family of proteins, or guanylate cyclase 1, soluble, beta 3 (GUCY1B3), T-cell receptor alpha locus (TRA), T cell receptor beta locus (TRB), egl-9 family hypoxia-inducible factor 1 (EGLN1), egl-9 family hypoxia-inducible factor 2 (EGLN2), egl-9 family hypoxia-inducible factor 3 (EGLN3), protein phosphatase 1 regulatory subunit 12C (PPP1R12C), and any combination or derivative thereof. In some embodiments, the method comprises at least one endogenous immunological checkpoint gene, and the at least one endogenous immunological checkpoint gene comprises a double strand break. In some embodiments, the method comprises a double strand break, and creating the double strand break comprises CRISPR. In some embodiments, the method comprises a double strand break, and creating the double strand break comprises CRISPR, TALEN, transposon-based, ZEN, meganuclease, or Mega-TAL. In some embodiments, the method comprises a double strand break, and the double strand break is repaired by insertion of the second transgene encoding an engineered TCR. In some embodiments, the method comprises a second nucleic acid, and the second nucleic acid comprises recombination arms, and wherein the second transgene encoding an engineered TCR is flanked by the recombination arms. In some embodiments, the method comprises recombination arms, and the recombination arms are at least in part complementary to at least a portion of the at least one endogenous immunological checkpoint gene. In some embodiments of the methods of the present disclosure, an increase in isogenicity between the recombination arms and the at least one endogenous immunological checkpoint gene corresponds to an increase in efficiency of the insertion of the second transgene. In some embodiments, the method comprises insertion of the second transgene, and an efficiency of the gene editing corresponds to the efficiency of the insertion of the second transgene. In some embodiments, the method comprises measuring an efficiency of the gene editing, and measuring the efficiency of the gene editing comprises at least one of fluorescence-activated cell sorting, real-time PCR, or digital droplet PCR. In some embodiments, the method comprises introducing a second nucleic acid, and introducing the second nucleic acid comprises non-viral transfection, biolistics, chemical transfection, electroporation, nucleofection, heat-shock transfection, lipofection, microinjection, or viral transfection. In some embodiments, the method comprises insertion of a second transgene, and the insertion of the second transgene encoding an engineered TCR comprises homology directed repair (HDR). In some embodiments, the method comprises insertions of a second transgene, and the insertion of the second transgene is assisted by a homologous recombination (HR) enhancer. In some embodiments, the method comprises an enhancer, and the enhancer is derived from a viral protein. In some embodiments, the method comprises an HR enhancer, and the HR enhancer is selected from the group consisting of E4orf6, E1b55K, E1b55K-H354, E1b55K-H373A, Scr7, L755507, or any combination thereof. In some embodiments, the method comprises an HR enhancer, and the HR enhancer is a chemical inhibitor. In some embodiments, the methods comprise an HR enhancer, and the HR enhancer inhibits Ligase IV. In some embodiments, the method comprises a reduction in cytotoxicity, and the cytotoxicity comprises at least one of DNA cleavage, cell death, apoptosis, nuclear condensation, cell lysis, necrosis, altered cell motility, altered cell stiffness, altered cytoplasmic protein expression, altered membrane protein expression, swelling, loss of membrane integrity, cessation of metabolic activity, hypoactive metabolism, hyperactive metabolism, increased reactive oxygen species, cytoplasmic shrinkage, or any combination thereof. In some embodiments, the method comprises an amount of the one or more cells necessary to effect a therapeutic response, and the amount of the one or more cells necessary to effect a therapeutic response when administered to a subject comprises about $5 \times 10^{10}$ cells. In some embodiments, the method comprises an amount of the one or more cells necessary to effect a therapeutic response, and the amount of the one or more cells necessary to effect a therapeutic response when administered to a subject comprises at least about $5 \times 10^7$ cells. In some embodiments, the method comprises one or more cells, and the one or more cells are viable cells. In some embodiments, the method comprises a second transgene, and the second transgene is inserted into the at least one endogenous immunological checkpoint gene in the one or more cells. In some embodiments, the method comprises a subject, and the subject is a human subject. In some embodiments, the method comprises a therapeutic response, and the therapeutic response comprises preventing, reducing, or eliminating cancer in the subject. In some embodiments, the method comprises cancer, and the cancer is bladder cancer, bone cancer, a brain tumor, breast cancer, esophageal cancer, gastrointestinal cancer, hematopoietic malignancy, leukemia, liver cancer, lung cancer, lymphoma, myeloma, ovarian cancer, prostate cancer, sarcoma, stomach cancer, or thyroid cancer. In some embodiments, the method comprises at least one excipient, and the at least one excipient is selected from the group consisting of acetate, acid, alcohol, alginate, ammonium, cell media, cellulose, chitosan, collagen, dextran, dextrose, ester, ethanol, gelatin, glucose, glycerol, lactose, mannitol, mannose, mercurial compounds, mineral oil, phenol, phosphate, polyacrylic acid, polyethylene glycol (PEG), Ringer's solution, saline, sorbitol, starch, sucrose, vegetable oil, water, white petroleum or a combination thereof. In some embodiments, the method comprises administering to a subject an amount of engineered cells necessary to effect a therapeutic response in the subject.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 3 demonstrates the in vitro transcription of mRNA and its use as a template to generate homologous recombination (HR) substrate in any type of cell (e.g., primary cells, cell lines, etc.). Upstream of the 5' LTR region of the viral genome a T7, T3, or other transcriptional start sequence can be placed for in vitro transcription of the viral cassette. mRNAs encoding both the sense and anti-sense strand of the viral vector can be used to improve yield.

FIG. 4 demonstrates the structures of four plasmids, including Cas9 nuclease plasmid, HPRT gRNA plasmid, Amaxa EGFPmax plasmid and HPRT target vector.

FIG. 5 shows an exemplary HPRT target vector with targeting arms of 0.5 kb.

FIG. 12 shows % gene modification occurring by CRISPR gRNAs at potential target sites.

FIG. 22 discloses SEQ ID NO: 163.

FIG. 23 A and FIG. 23 B show PD-1, CTLA-4, PD-1 and CTLA-2, or CCR5, PD-1, and CTLA-4 expression on day 6 post transfection with guide RNAs. Representative guides: PD-1 (P2, P6, P2/6), CTLA-4 (C2, C3, C2/3), or CCR5 (CC2). FIG. 23 A shows percent inhibitory receptor expression. FIG. 23 B shows normalized inhibitory receptor expression to a control guide RNA.

FIG. 24 B shows PD-1 expression in primary human T cells after electroporation with CRISPR and PD-1 specific guideRNAs, guides #2 and #6, as compared to unstained and a no guide control.

FIG. 26 A shows percent CTLA-4 knock out in T cells treated with CTLA-4 guides #2, #3, #2 and #3, PD-1 guide #2 and CTLA-4 guide #2, PD-1 guide #6 and CTLA-4 guide #3, as compared to Zap only, Cas9 only, and an all guideRNA control. FIG. 26 B shows percent PD-1 knock out in T cells treated with PD-1 guide#2, PD-1 guide #6, PD-1 guides #2 and #6, PD-1 guide #2 and CTLA-4 guide #2, PD-1 guide #6 and CTLA-4 guide #3, as compared to Zap only, Cas9 only, and an all guideRNA control.

FIG. 38 discloses SEQ ID NOS 164, 164, and 164, respectively, in order of appearance.

FIG. 39 discloses SEQ ID NOS 165, 166, 166, 166, and 166, respectively, in order of appearance.

FIG. 40 B shows FACs analysis of transfection efficiency of human T cells (% pos GFP).

FIG. 42 B shows CTLA-4 knock out efficiency relative to a pulsed control in human T cells post transfection with anti-CTLA-4 guide RNAs and CRISPR.

FIG. 43 shows minicircle DNA containing an engineered TCR (SEQ ID NO: 167).

FIG. 44 depicts modified sgRNA for CISH, PD-1, CTLA4 and AAVS1. FIG. 44 discloses SEQ ID NOS 154, 156, 158, 159, 154, 156, 158, 159, 154, 156, 158 and 159 respectively, in order of appearance.

FIG. 46 B shows percent PD-1 knock out efficiency as compared to Cas9 only control.

FIG. 57 A depict a schematic of a T cell receptor (TCR). FIG. 57 B shows a schematic of a chimeric antigen receptor. FIG. 57 C shows a schematic of a B cell receptor (BCR).

FIG. 59 shows pseudouridine-5'-Triphosphate and 5-Methylcytidine-5-Triphosphate modifications that can be made to nucleic acid.

FIG. 68 A, FIG. 68 B, and FIG. 68 C depict DNA viability by cell count at: FIG. 68 A 1 day, FIG. 68 B 2 days, FIG. 68 C 3 days post transfection with single or double-stranded DNA. M13 ss/dsDNA is 7.25 kb. pUC57 is 2.7 kb. GFP plasmid is 6.04 kb.

FIG. 70 A and FIG. 70 B depict cell count post transfection with the CRISPR system (15 ug Cas9, 10 ug gRNA) on FIG. 70 A Day 3 and FIG. 70 B Day 7. Sample 1-non treated. Sample 2-pulse only. Sample 3-GFP mRNA. Sample 4-Cas9 pulsed only. Sample 5-5 microgram minicircle donor pulsed only. Sample 6-20 micrograms minicircle donor pulsed only. Sample 7—plasmid donor (5 micrograms). Sample 8-plasmid donor (20 micrograms). Sample 9—+guide PD1-2/+Cas9/–donor. Sample 10—+guide PD1-6/+Cas9/–donor. Sample 11—+guide CTLA4-2/+Cas9/–donor. Sample 12—+guide CTLA4-3/+Cas9/–donor. Sample 13—PD1-2/5 ug donor. Sample 14—PD1 dual/5 ug donor. Sample 15—CTLA4-3/5 ug donor. Sample 16—CTLA4 dual/5 ug donor. Sample 17—PD1-2/20 ug donor. Sample 18—PD1 dual/20 ug donor. Sample 19—CTLA4-3/20 ug donor. Sample 20—CTLA4 dual/20 ug donor.

FIG. 76 B shows efficiency of integration at the PD-1 or CISH locus of human T cells transfected with CRISPR and PD-1 or CISH specific gRNAs.

FIG. 81 A shows Day 3 T cell viability with increasing dose of minicircle encoding an exogenous TCR. FIG. 81 B shows Day 7 T cell viability with increasing dose of minicircle encoding an exogenous TCR.

FIG. 82 B optimization conditions for Lonza nucleofection of T cells with double strand DNA encoding a GFP protein. Percent transduction is shown vs concentration of GFP plasmid used for transfection.

FIG. 83 B shows a schematic of a protocol for AAV transient transfection of 293 cells for virus production. The virus will be purified and stored for transduction of primary human T cells.

FIG. 86 A, FIG. 86 B, FIG. 86 C, and FIG. 86 D show possible recombination events that may occur using the AAVS1 system. FIG. 86 A shows homology directed repair of double stand breaks at AAVS1 with integration of the transgene. FIG. 86 B shows homology directed repair of one stand of the AAVS1 gene and non-homologous end joining indel of the complementary stand of AAVS1. FIG. 86 C shows non-homologous end joining insertion of the transgene into the AAVS1 gene site and non-homologous end joining indel at AAVS1. FIG. 86 D shows nonhomologous idels at both AAVS1 locations with random integration of the transgene into a genomic site.

FIG. 88 B shows efficiency of electroporation. Percent positive TCR is shown vs. concentration of inhibitor used.

FIG. 90 A Electroporation efficiency showing TCR positive cells vs. immune checkpoint specific guide(s) used. FIG. 90 B FACs data of the electroporation efficiency showing TCR positive cells vs. immune checkpoint specific guide(s) used.

FIG. 92A and FIG. 92B shows a cell death inhibitor study in which human T cells were pre-treated with Brefeldin A and ATM-inhibitors prior to transfection with CRISPR and minicircle DNA encoding for an exogenous TCR. FIG. 92 B shows viability of T cells on day 7 post electroporation.

FIG. 93A and FIG. 93B shows a cell death inhibitor study in which human T cells were pre-treated with Brefeldin A and ATM-inhibitors prior to transfection with CRISPR and minicircle DNA encoding for an exogenous TCR. FIG. 93 B shows TCR expression on T cells on day 7 post electroporation.

FIG. 101A and FIG. 101 B show FIG. 101 A viability and FIG. 101 B reverse transcriptase activity for Jurkat cells expressing reverse transcriptase (RT) reporter RNA that were transfected using the Neon Transfection System with RT encoding plasmids and primers (see table for concentrations) and assayed for cell viability and GFP expression on Days 3 post transfection. GFP positive cells represent cells with RT activity.

FIG. 102 A shows a first donor's cell count pre- and post-stimulation cultured in either RPMI media or ex vivo media. FIG. 102 B shows a second donor's cell count pre- and post-stimulation cultured in RPMI media.

DETAILED DESCRIPTION OF THE DISCLOSURE

Figure 1:
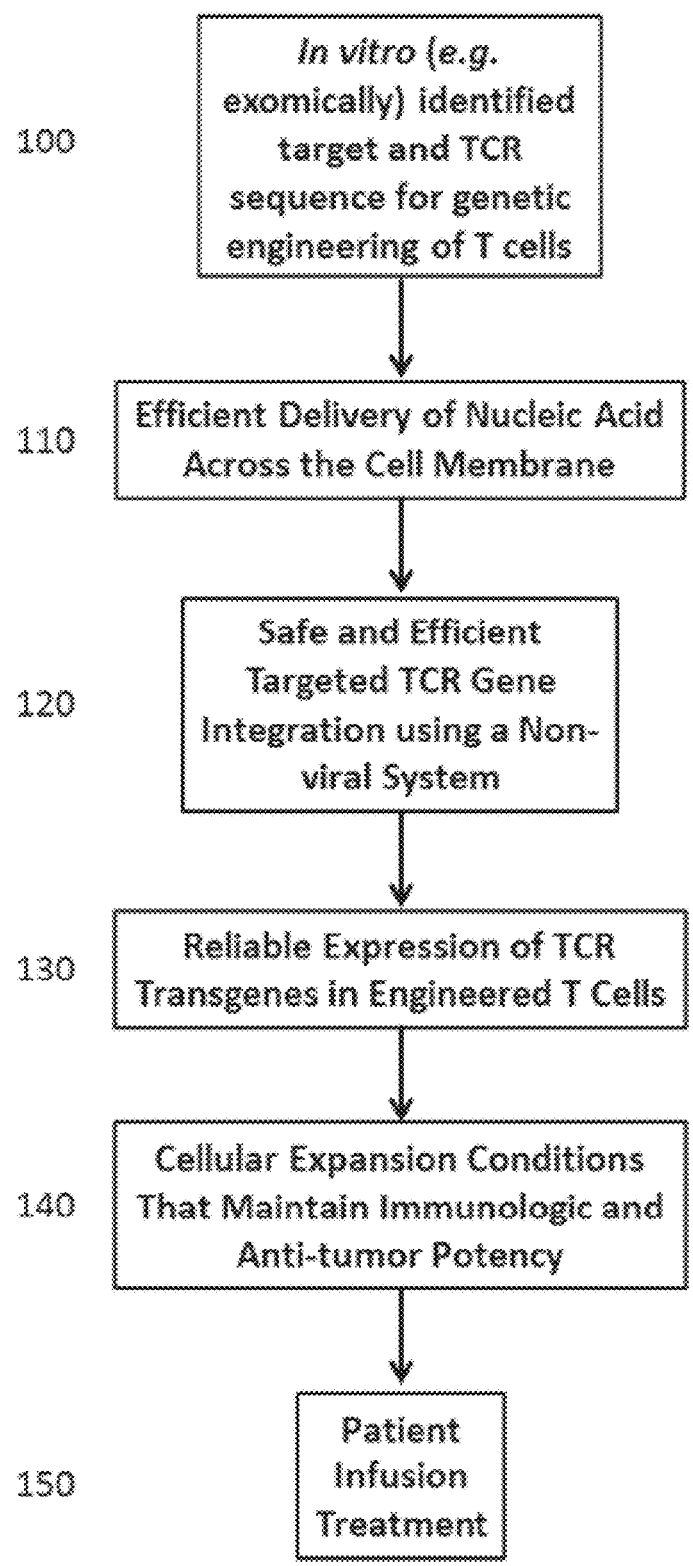
FIG. 1 is an overview of some of the methods disclosed herein.

The following description and examples illustrate embodiments of the invention in detail. It is to be understood that this invention is not limited to the particular embodiments described herein and as such can vary. Those of skill in the art will recognize that there are numerous variations and modifications of this invention, which are encompassed within its scope.

Definitions

The term "about" and its grammatical equivalents in relation to a reference numerical value and its grammatical equivalents as used herein can include a range of values plus or minus 10% from that value. For example, the amount "about 10" includes amounts from 9 to 11. The term "about" in relation to a reference numerical value can also include a range of values plus or minus 10%, 9%, 8%, 7%, 6%, 5%, 4%, 3%, 2%, or 1% from that value.

The term "activation" and its grammatical equivalents as used herein can refer to a process whereby a cell transitions from a resting state to an active state. This process can comprise a response to an antigen, migration, and/or a phenotypic or genetic change to a functionally active state. For example, the term "activation" can refer to the stepwise process of T cell activation. For example, a T cell can require at least two signals to become fully activated. The first signal can occur after engagement of a TCR by the antigen-MHC complex, and the second signal can occur by engagement of co-stimulatory molecules. Anti-CD3 can mimic the first signal and anti-CD28 can mimic the second signal in vitro.

The term "adjacent" and its grammatical equivalents as used herein can refer to right next to the object of reference. For example, the term adjacent in the context of a nucleotide sequence can mean without any nucleotides in between. For instance, polynucleotide A adjacent to polynucleotide B can mean AB without any nucleotides in between A and B.

The term "antigen" and its grammatical equivalents as used herein can refer to a molecule that contains one or more epitopes capable of being bound by one or more receptors. For example, an antigen can stimulate a host's immune system to make a cellular antigen-specific immune response when the antigen is presented, or a humoral antibody response. An antigen can also have the ability to elicit a cellular and/or humoral response by itself or when present in combination with another molecule. For example, a tumor cell antigen can be recognized by a TCR.

The term "epitope" and its grammatical equivalents as used herein can refer to a part of an antigen that can be recognized by antibodies, B cells, T cells or engineered cells. For example, an epitope can be a cancer epitope that is recognized by a TCR. Multiple epitopes within an antigen can also be recognized. The epitope can also be mutated.

The term "autologous" and its grammatical equivalents as used herein can refer to as originating from the same being. For example, a sample (e.g., cells) can be removed, processed, and given back to the same subject (e.g., patient) at a later time. An autologous process is distinguished from an allogenic process where the donor and the recipient are different subjects.

The term "barcoded to" refers to a relationship between molecules where a first molecule contains a barcode that can be used to identify a second molecule.

The term "cancer" and its grammatical equivalents as used herein can refer to a hyperproliferation of cells whose unique trait—loss of normal controls—results in unregulated growth, lack of differentiation, local tissue invasion, and metastasis. With respect to the inventive methods, the cancer can be any cancer, including any of acute lymphocytic cancer, acute myeloid leukemia, alveolar rhabdomyosarcoma, bladder cancer, bone cancer, brain cancer, breast cancer, cancer of the anus, anal canal, rectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vulva, chronic lymphocytic leukemia, chronic myeloid cancer, colon cancer, esophageal cancer, cervical cancer, fibrosarcoma, gastrointestinal carcinoid tumor, Hodgkin lymphoma, hypopharynx cancer, kidney cancer, larynx cancer, leukemia, liquid tumors, liver cancer, lung cancer, lymphoma, malignant mesothelioma, mastocytoma, melanoma, multiple myeloma, nasopharynx cancer, non-Hodgkin lymphoma, ovarian cancer, pancreatic cancer, peritoneum, omentum, and mesentery cancer, pharynx cancer, prostate cancer, rectal cancer, renal cancer, skin cancer, small intestine cancer, soft tissue cancer, solid tumors, stomach cancer, testicular cancer, thyroid cancer, ureter cancer, and/or urinary bladder cancer. As used herein, the term "tumor" refers to an abnormal growth of cells or tissues, e.g., of malignant type or benign type.

The term "cancer neo-antigen" or "neo-antigen" or "neo-epitope" and its grammatical equivalents as used herein can refer to antigens that are not encoded in a normal, non-mutated host genome. A "neo-antigen" can in some instances represent either oncogenic viral proteins or abnormal proteins that arise as a consequence of somatic mutations. For example, a neo-antigen can arise by the disruption of cellular mechanisms through the activity of viral proteins. Another example, can be an exposure of a carcinogenic compound, which in some cases can lead to a somatic mutation. This somatic mutation can ultimately lead to the formation of a tumor/cancer.

The term "cytotoxicity" as used in this specification, refers to an unintended or undesirable alteration in the normal state of a cell. The normal state of a cell may refer to a state that is manifested or exists prior to the cell's exposure to a cytotoxic composition, agent and/or condition. Generally, a cell that is in a normal state is one that is in homeostasis. An unintended or undesirable alteration in the normal state of a cell can be manifested in the form of, for example, cell death (e.g., programmed cell death), a decrease in replicative potential, a decrease in cellular integrity such as membrane integrity, a decrease in metabolic activity, a decrease in developmental capability, or any of the cytotoxic effects disclosed in the present application.

The phrase "reducing cytotoxicity" or "reduce cytotoxicity" refers to a reduction in degree or frequency of unintended or undesirable alterations in the normal state of a cell upon exposure to a cytotoxic composition, agent and/or condition. The phrase can refer to reducing the degree of cytotoxicity in an individual cell that is exposed to a cytotoxic composition, agent and/or condition, or to reducing the number of cells of a population that exhibit cytotoxicity when the population of cells is exposed to a cytotoxic composition, agent and/or condition.

The term "engineered" and its grammatical equivalents as used herein can refer to one or more alterations of a nucleic acid, e.g., the nucleic acid within an organism's genome. The term "engineered" can refer to alterations, additions, and/or deletion of genes. An engineered cell can also refer to a cell with an added, deleted and/or altered gene.

The term "cell" or "engineered cell" and their grammatical equivalents as used herein can refer to a cell of human or non-human animal origin.

The term "checkpoint gene" and its grammatical equivalents as used herein can refer to any gene that is involved in an inhibitory process (e.g., feedback loop) that acts to regulate the amplitude of an immune response, for example, an immune inhibitory feedback loop that mitigates uncontrolled propagation of harmful responses. These responses can include contributing to a molecular shield that protects against collateral tissue damage that might occur during immune responses to infections and/or maintenance of peripheral self-tolerance. Non-limiting examples of checkpoint genes can include members of the extended CD28 family of receptors and their ligands as well as genes involved in co-inhibitory pathways (e.g., CTLA-4 and PD-1). The term "checkpoint gene" can also refer to an immune checkpoint gene.

A "CRISPR," "CRISPR system system," or "CRISPR nuclease system" and their grammatical equivalents can include a non-coding RNA molecule (e.g., guide RNA) that binds to DNA and Cas proteins (e.g., Cas9) with nuclease functionality (e.g., two nuclease domains). See, e.g., Sander, J. D., et al., "CRISPR-Cas systems for editing, regulating and targeting genomes," Nature Biotechnology, 32:347-355 (2014); see also e.g., Hsu, P. D., et al., "Development and applications of CRISPR-Cas9 for genome engineering," Cell 157 (6):1262-1278 (2014).

The term "disrupting" and its grammatical equivalents as used herein can refer to a process of altering a gene, e.g., by deletion, insertion, mutation, rearrangement, or any combination thereof. For example, a gene can be disrupted by knockout. Disrupting a gene can be partially reducing or completely suppressing expression of the gene. Disrupting a gene can also cause activation of a different gene, for example, a downstream gene.

The term "function" and its grammatical equivalents as used herein can refer to the capability of operating, having, or serving an intended purpose. Functional can comprise any percent from baseline to 100% of normal function. For example, functional can comprise or comprise about 5, 10, 15, 20, 25, 30, 35, 40, 45, 50, 55, 60, 65, 70, 75, 80, 85, 90, 95, and/or 100% of normal function. In some cases, the term functional can mean over or over about 100% of normal function, for example, 125, 150, 175, 200, 250, 300% and/or above normal function.

The term "gene editing" and its grammatical equivalents as used herein can refer to genetic engineering in which one or more nucleotides are inserted, replaced, or removed from a genome. Gene editing can be performed using a nuclease (e.g., a natural-existing nuclease or an artificially engineered nuclease).

The term "mutation" and its grammatical equivalents as used herein can include the substitution, deletion, and insertion of one or more nucleotides in a polynucleotide. For example, up to 1, 2, 3, 4, 5, 6, 7, 8, 9, 10, 11, 12, 13, 14, 15, 20, 25, 30, 40, 50, or more nucleotides/amino acids in a polynucleotide (cDNA, gene) or a polypeptide sequence can be substituted, deleted, and/or inserted. A mutation can affect the coding sequence of a gene or its regulatory sequence. A mutation can also affect the structure of the genomic sequence or the structure/stability of the encoded mRNA.

The term "non-human animal" and its grammatical equivalents as used herein can include all animal species other than humans, including non-human mammals, which can be a native animal or a genetically modified non-human animal. The terms "nucleic acid," "polynucleotide," "polynucleic acid," and "oligonucleotide" and their grammatical equivalents can be used interchangeably and can refer to a deoxyribonucleotide or ribonucleotide polymer, in linear or circular conformation, and in either single- or double-stranded form. For the purposes of the present disclosure, these terms should not to be construed as limiting with respect to length. The terms can also encompass analogues of natural nucleotides, as well as nucleotides that are modified in the base, sugar and/or phosphate moieties (e.g., phosphorothioate backbones). Modifications of the terms can also encompass demethylation, addition of CpG methylation, removal of bacterial methylation, and/or addition of mammalian methylation. In general, an analogue of a particular nucleotide can have the same base-pairing specificity, i.e., an analogue of A can base-pair with T.

The term "peripheral blood lymphocytes" (PBL) and its grammatical equivalents as used herein can refer to lymphocytes that circulate in the blood (e.g., peripheral blood). Peripheral blood lymphocytes can refer to lymphocytes that are not localized to organs. Peripheral blood lymphocytes can comprise T cells, NK cells, B cell, or any combinations thereof.

The term "phenotype" and its grammatical equivalents as used herein can refer to a composite of an organism's observable characteristics or traits, such as its morphology, development, biochemical or physiological properties, phenology, behavior, and products of behavior. Depending on the context, the term "phenotype" can sometimes refer to a composite of a population's observable characteristics or traits.

The term "protospacer" and its grammatical equivalents as used herein can refer to a PAM-adjacent nucleic acid sequence capable to hybridizing to a portion of a guide RNA, such as the spacer sequence or engineered targeting portion of the guide RNA. A protospacer can be a nucleotide sequence within gene, genome, or chromosome that is targeted by a guide RNA. In the native state, a protospacer is adjacent to a PAM (protospacer adjacent motif). The site of cleavage by an RNA-guided nuclease is within a protospacer sequence. For example, when a guide RNA targets a specific protospacer, the Cas protein will generate a double strand break within the protospacer sequence, thereby cleaving the protospacer. Following cleavage, disruption of the protospacer can result though non-homologous end joining (NHEJ) or homology-directed repair (HDR). Disruption of the protospacer can result in the deletion of the protospacer. Additionally or alternatively, disruption of the protospacer can result in an exogenous nucleic acid sequence being inserted into or replacing the protospacer.

The term "recipient" and their grammatical equivalents as used herein can refer to a human or non-human animal. The recipient can also be in need thereof.

The term "recombination" and its grammatical equivalents as used herein can refer to a process of exchange of genetic information between two polynucleic acids. For the purposes of this disclosure, "homologous recombination" or "HR" can refer to a specialized form of such genetic exchange that can take place, for example, during repair of double-strand breaks. This process can require nucleotide sequence homology, for example, using a donor molecule to template repair of a target molecule (e.g., a molecule that experienced the double-strand break), and is sometimes known as non-crossover gene conversion or short tract gene conversion. Such transfer can also involve mismatch correction of heteroduplex DNA that forms between the broken target and the donor, and/or synthesis-dependent strand annealing, in which the donor can be used to resynthesize genetic information that can become part of the target, and/or related processes. Such specialized HR can often result in an alteration of the sequence of the target molecule such that part or all of the sequence of the donor polynucleotide can be incorporated into the target polynucleotide. In some cases, the terms "recombination arms" and "homology arms" can be used interchangeably.

The terms "target vector" and "targeting vector" are used interchangeably herein.

The term "transgene" and its grammatical equivalents as used herein can refer to a gene or genetic material that is transferred into an organism. For example, a transgene can be a stretch or segment of DNA containing a gene that is introduced into an organism. When a transgene is transferred into an organism, the organism is then referred to as a transgenic organism. A transgene can retain its ability to produce RNA or polypeptides (e.g., proteins) in a transgenic organism. A transgene can be composed of different nucleic acids, for example RNA or DNA. A transgene may encode for an engineered T cell receptor, for example a TCR transgene. A transgene may comprise a TCR sequence. A transgene can comprise recombination arms. A transgene can comprise engineered sites.

The term "T cell" and its grammatical equivalents as used herein can refer to a T cell from any origin. For example, a T cell can be a primary T cell, e.g., an autologous T cell, a cell line, etc. The T cell can also be human or non-human.

The term "TIL" or tumor infiltrating lymphocyte and its grammatical equivalents as used herein can refer to a cell isolated from a tumor. For example, a TIL can be a cell that has migrated to a tumor. A TIL can also be a cell that has infiltrated a tumor. A TIL can be any cell found within a tumor. For example, a TIL can be a T cell, B cell, monocyte, natural killer cell, or any combination thereof. A TIL can be a mixed population of cells. A population of TILs can comprise cells of different phenotypes, cells of different degrees of differentiation, cells of different lineages, or any combination thereof.

A "therapeutic effect" may occur if there is a change in the condition being treated. The change may be positive or negative. For example, a 'positive effect' may correspond to an increase in the number of activated T-cells in a subject. In another example, a 'negative effect' may correspond to a decrease in the amount or size of a tumor in a subject. There is a "change" in the condition being treated if there is at least 10% improvement, preferably at least 25%, more preferably at least 50%, even more preferably at least 75%, and most preferably 100%. The change can be based on improvements in the severity of the treated condition in an individual, or on a difference in the frequency of improved conditions in populations of individuals with and without treatment with the therapeutic compositions with which the compositions of the present invention are administered in combination. Similarly, a method of the present disclosure may comprise administering to a subject an amount of cells that is "therapeutically effective". The term "therapeutically effective" should be understood to have a definition corresponding to 'having a therapeutic effect'.

The term "safe harbor" and "immune safe harbor", and their grammatical equivalents as used herein can refer to a location within a genome that can be used for integrating exogenous nucleic acids wherein the integration does not cause any significant effect on the growth of the host cell by the addition of the nucleic acid alone. Non-limiting examples of safe harbors can include HPRT, AAVS SITE (E.G. AAVS1, AAVS2, ETC.), CCR5, or Rosa26.

The term "sequence" and its grammatical equivalents as used herein can refer to a nucleotide sequence, which can be DNA or RNA; can be linear, circular or branched; and can be either single-stranded or double stranded. A sequence can be mutated. A sequence can be of any length, for example, between 2 and 1,000,000 or more nucleotides in length (or any integer value there between or there above), e.g., between about 100 and about 10,000 nucleotides or between about 200 and about 500 nucleotides.

Overview

Figure 58:
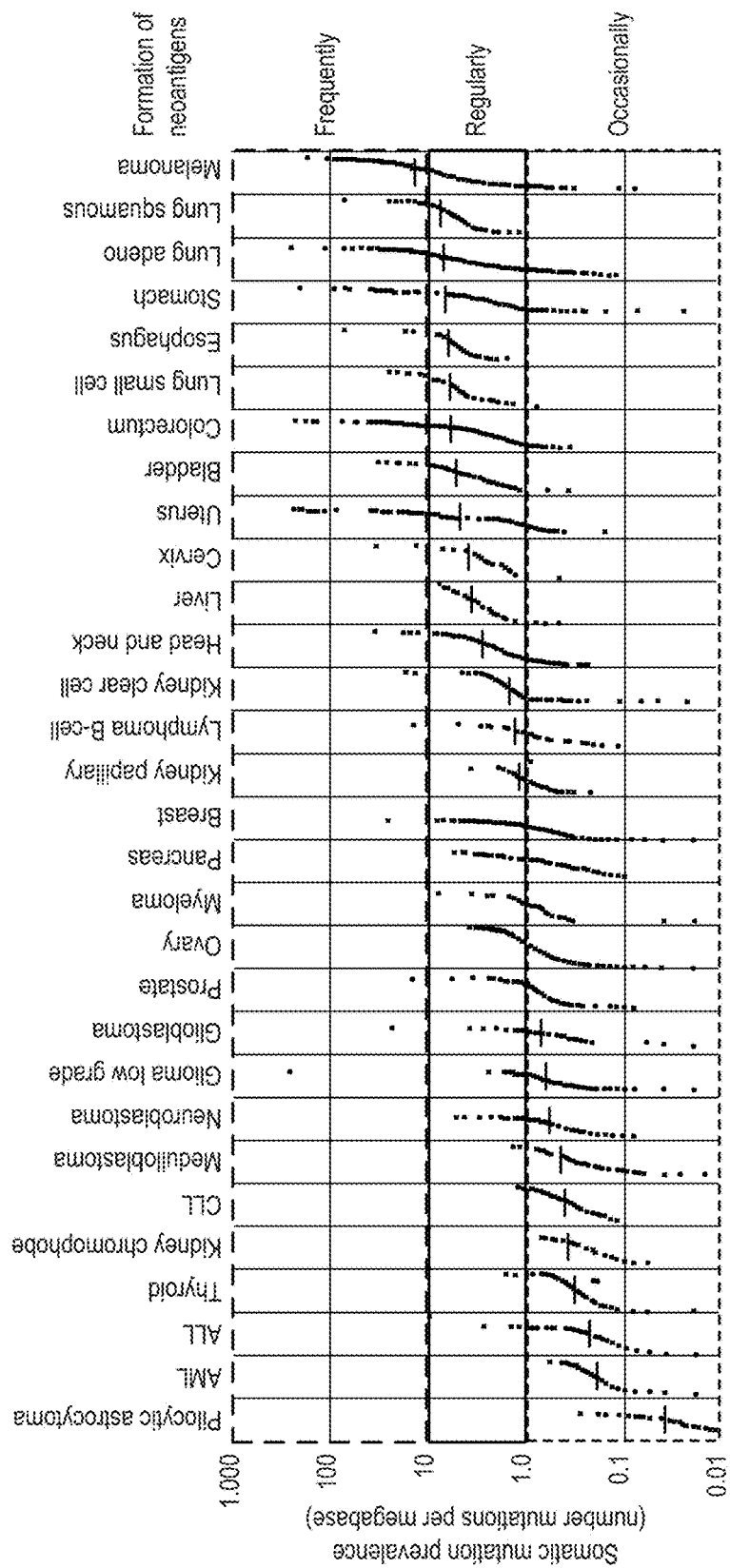
FIG. 58 shows that somatic mutational burden varies among tumor type. Tumor-specific neo-antigen generation and presentation is theoretically directly proportional to mutational burden.

Disclosed herein are compositions and methods useful for performing an intracellular genomic transplant. An intracellular genomic transplant may comprise genetically modifying cells and nucleic acids for therapeutic applications. The compositions and methods described throughout can use a nucleic acid-mediated genetic engineering process for delivering a tumor-specific TCR in a way that improves physiologic and immunologic anti-tumor potency of an engineered cell. Effective adoptive cell transfer-based immunotherapies (ACT) can be useful to treat cancer (e.g., metastatic cancer) patients. For example, autologous peripheral blood lymphocytes (PBL) can be modified using non-viral methods to express T Cell Receptors (TCR) that recognize unique mutations, neo-antigens, on cancer cells and can be used in the disclosed compositions and methods of an intracellular genomic transplant. A Neoantigen can be associated with tumors of high mutational burden, FIG. 58.

FIG. 1 depicts and example of a method which can identify a cancer-related target sequence, in some cases a Neoantigen, from a sample obtained from a cancer patient using an in vitro assay (e.g. whole-exomic sequencing). The method can further identify a TCR transgene from a first T cell that recognizes the target sequence. The cancer-related target sequence and a TCR transgene can be obtained from samples of the same patient or different patients. The method can effectively and efficiently deliver a nucleic acid comprising a TCR transgene across membrane of a second T cell. In some instances, the first and second T cells can be obtained from the same patient. In other instances, the first and second T cells can be obtained from different patients. In other instances, the first and second T cells can be obtained from different patients. The method can safely and efficiently integrate a TCR transgene into the genome of a T cell using a non-viral integration system (e.g., CRISPR, TALEN, transposon-based, ZEN, meganuclease, or MegaTAL) to generate an engineered T cell and thus, a TCR transgene can be reliably expressed in the engineered T cell. The engineered T cell can be grown and expanded in a condition that maintains its immunologic and anti-tumor potency and can further be administered into a patient for cancer treatment.

The engineered cell can also be grown and expanded in conditions that can improve its performance once administered to a patient. The engineered cell can be selected. For example, prior to expansion and engineering of the cells, a source of cells can be obtained from a subject through a variety of non-limiting methods. Cells can be obtained from a number of non-limiting sources, including peripheral blood mononuclear cells, bone marrow, lymph node tissue, cord blood, thymus tissue, tissue from a site of infection, ascites, pleural effusion, spleen tissue, and tumors. For example, any T cell lines can be used. Alternatively, the cell can be derived from a healthy donor, from a patient diagnosed with cancer, or from a patient diagnosed with an infection. In another embodiment, the cell can be part of a mixed population of cells which present different phenotypic characteristics. A cell line can also be obtained from a transformed T-cell according to the method previously described. A cell can also be obtained from a cell therapy bank. Modified cells resistant to an immunosuppressive treatment can be obtained. A desirable cell population can also be selected prior to modification. An engineered cell population can also be selected after modification.

In some cases, the engineered cell can be used in autologous transplantation. Alternatively, the engineered cell can be used in allogeneic transplantation. In some instances, the engineered cell can be administered to the same patient whose sample was used to identify the cancer-related target sequence and/or a TCR transgene. In other instances, the engineered cell can be administered to a patient different from the patient whose sample was used to identify the cancer-related target sequence and/or a TCR transgene. One or more homologous recombination enhancers can be introduced with cells of the invention. Enhancers can facilitate homology directed repair of a double strand break. Enhancers can facilitate integration of a TCR into a cell of the invention. An enhancer can block non-homologous end joining (NHEJ) so that homology directed repair of a double strand break occurs preferentially.

A modifying compound can also be utilized to reduce toxicity of exogenous polynucleic acids of the invention. For example, a modifier compound can act on Caspase-1, TBK1, IRF3, STING, DDX41, DNA-PK, DAI, IFI16, MRE11, cGAS, 2'3'-cGAMP, TREX1, AIM2, ASC, or any combination thereof. A modifier can be a TBK1 modifier. A modifier can be a caspcase-1 modifier. A modifier compound can also act on the innate signaling system, thus, it can be an innate signaling modifier. In some cases, exogenous nucleic acids can be toxic to cells. A method that inhibits an innate immune sensing response of cells can improve cell viability of engineered cellular products. A modifying compound can be brefeldin A and or an inhibitor of an ATM pathway, FIG. 92A, FIG. 92B, FIG. 93A and FIG. 93B.

A modifying compound can be introduced to a cell before the addition of a polynucleic acid. A modifying compound can be introduced concurrently with a polynucleic acid. A modifying compound can be comprised within a polynucleic acid. These compositions and methods can provide an efficient and low toxicity method by which cell therapy, e.g., a cancer specific cellular therapy, can be produced.

One or more cytokines can be introduced with cells of the invention. Cytokines can be utilized to boost cytotoxic T lymphocytes (including adoptively transferred tumor-specific cytotoxic T lymphocytes) to expand within a tumor microenvironment. In some cases, IL-2 can be used to facilitate expansion of the cells described herein. Cytokines such as IL-15 can also be employed. Other relevant cytokines in the field of immunotherapy can also be utilized, such as IL-2, IL-7, IL-12, IL-15, IL-21, or any combination thereof. In some cases, IL-2, IL-7, and IL-15 are used to culture cells of the invention.

Cytotoxicity may generally refer to the quality of a composition, agent, and/or condition (e.g., exogenous DNA) being toxic to a cell. In some aspects, the methods of the present disclosure generally relate to reduce the cytotoxic effects of exogenous DNA introduced into one or more cells during genetic modification. In some embodiments, cytotoxicity, or the effects of a substance being cytotoxic to a cell, can comprise DNA cleavage, cell death, autophagy, apoptosis, nuclear condensation, cell lysis, necrosis, altered cell motility, altered cell stiffness, altered cytoplasmic protein expression, altered membrane protein expression, undesired cell differentiation, swelling, loss of membrane integrity, cessation of metabolic activity, hypoactive metabolism, hyperactive metabolism, increased reactive oxygen species, cytoplasmic shrinkage, production of pro-inflammatory cytokines (e.g., as a product of a DNA sensing pathway) or any combination thereof. Non-limiting examples of pro-inflammatory cytokines include interleukin 6 (IL-6), interferon alpha (IFNα), interferon beta (IFNβ), C—C motif ligand 4 (CCL4), C—C motif ligand 5 (CCL5), C—X—C motif ligand 10 (CXCL10), interleukin 1 beta (IL-1β), IL-18 and IL-33. In some cases, cytotoxicity may be affected by introduction of a polynucleic acid, such as a transgene or TCR.

A change in cytotoxicity can be measured in any of a number of ways known in the art. In one embodiment, a change in cytotoxicity can be assessed based on a degree and/or frequency of occurrence of cytotoxicity-associated effects, such as cell death or undesired cell differentiation. In another embodiment, reduction in cytotoxicity is assessed by measuring amount of cellular toxicity using assays known in the art, which include standard laboratory techniques such as dye exclusion, detection of morphologic characteristics associated with cell viability, injury and/or death, and measurement of enzyme and/or metabolic activities associated with the cell type of interest.

Generally, the T cells of the invention can be expanded by contact with a surface having attached thereto an agent that can stimulate a CD3 TCR complex associated signal and a ligand that can stimulate a co-stimulatory molecule on the surface of the T cells. In particular, T cell populations can be stimulated in vitro such as by contact with an anti-CD3 antibody or antigen-binding fragment thereof, or an anti-CD2 antibody immobilized on a surface, or by contact with a protein kinase C activator (e.g., bryostatin) sometimes in conjunction with a calcium ionophore. For co-stimulation of an accessory molecule on the surface of the T cells, a ligand that binds the accessory molecule can be used. For example, a population of T cells can be contacted with an anti-CD3 antibody and an anti-CD28 antibody, under conditions that can stimulate proliferation of the T cells. In some cases, 4-1BB can be used to stimulate cells. For example, cells can be stimulated with 4-1BB and IL-21 or another cytokine.

To stimulate proliferation of either CD4 T cells or CD8 T cells, an anti-CD3 antibody and an anti-CD28 antibody can be used. For example, the agents providing a signal may be in solution or coupled to a surface. The ratio of particles to cells may depend on particle size relative to the target cell. In further embodiments, the cells, such as T cells, can be combined with agent-coated beads, where the beads and the cells can be subsequently separated, and optionally cultured. Each bead can be coated with either anti-CD3 antibody or an anti-CD28 antibody, or in some cases, a combination of the two. In an alternative embodiment, prior to culture, the agent-coated beads and cells are not separated but are cultured together. Cell surface proteins may be ligated by allowing paramagnetic beads to which anti-CD3 and anti-CD28 can be attached (3×28 beads) to contact the T cells. In one embodiment the cells and beads (for example, DYNABEADS® M-450 CD3/CD28 T paramagnetic beads at a ratio of 1:1) are combined in a buffer, for example, phosphate buffered saline (PBS) (e.g., without divalent cations such as, calcium and magnesium). Any cell concentration may be used. The mixture may be cultured for or for about several hours (e.g., about 3 hours) to or to about 14 days or any hourly integer value in between. In another embodiment, the mixture may be cultured for or for about 21 days or for up to or for up to about 21 days. Conditions appropriate for T cell culture can include an appropriate media (e.g., Minimal Essential Media or RPMI Media 1640 or, X-vivo 5, (Lonza)) that may contain factors necessary for proliferation and viability, including serum (e.g., fetal bovine or human serum), interleukin-2 (IL-2), insulin, IFN-g, IL-4, IL-7, GM-CSF, IL-10, IL-21, IL-15, TGF beta, and TNF alpha or any other additives for the growth of cells. Other additives for the growth of cells include, but are not limited to, surfactant, plasmanate, and reducing agents such as N-acetyl-cysteine and 2-mercaptoethanol. Media can include RPMI 1640, A1 M-V, DMEM, MEM, α-MEM, F-12, X-Vivo 1, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, can be included only in experimental cultures, possibly not in cultures of cells that are to be infused into a subject. The target cells can be maintained under conditions necessary to support growth; for example, an appropriate temperature (e.g., 37° C.) and atmosphere (e.g., air plus 5% $CO_2$). In some instances, T cells that have been exposed to varied stimulation times may exhibit different characteristics. In some cases, a soluble monospecific tetrameric antibody against human CD3, CD28, CD2, or any combination thereof may be used.

In some cases, cells to undergo genomic transplant can be activated or expanded by co-culturing with tissue or cells. A cell can be an antigen presenting cell. An artificial antigen presenting cells (aAPCs) can express ligands for T cell receptor and costimulatory molecules and can activate and expand T cells for transfer, while improving their potency and function in some cases. An aAPC can be engineered to express any gene for T cell activation. An aAPC can be engineered to express any gene for T cell expansion. An aAPC can be a bead, a cell, a protein, an antibody, a cytokine, or any combination. An aAPC can deliver signals to a cell population that may undergo genomic transplant. For example, an aAPC can deliver a signal 1, signal, 2, signal 3 or any combination. A signal 1 can be an antigen recognition signal. For example, signal 1 can be ligation of a TCR by a peptide-MHC complex or binding of agonistic antibodies directed towards CD3 that can lead to activation of the CD3 signal-transduction complex. Signal 2 can be a co-stimulatory signal. For example, a co-stimulatory signal can be anti-CD28, inducible co-stimulator (ICOS), CD27, and 4-1BB (CD137), which bind to ICOS-L, CD70, and 4-1BBL, respectively. Signal 3 can be a cytokine signal. A cytokine can be any cytokine. A cytokine can be IL-2, IL-7, IL-12, IL-15, IL-21, or any combination thereof.

In some cases an artificial antigen presenting cell (aAPC) may be used to activate and/or expand a cell population. In some cases, an artificial may not induce allospecificity. An aAPC may not express HLA in some cases. An aAPC may be genetically modified to stably express genes that can be used to activation and/or stimulation. In some cases, a K562 cell may be used for activation. A K562 cell may also be used for expansion. A K562 cell can be a human erythroleukemic cell line. A K562 cell may be engineered to express genes of interest. K562 cells may not endogenously express HLA class I, II, or CD1d molecules but may express ICAM-1 (CD54) and LFA-3 (CD58). K562 may be engineered to deliver a signal 1 to T cells. For example, K562 cells may be engineered to express HLA class I. In some cases, K562 cells may be engineered to express additional molecules such as B7, CD80, CD83, CD86, CD32, CD64, 4-1BBL, anti-CD3, anti-CD3 mAb, anti-CD28, anti-CD28mAb, CD1d, anti-CD2, membrane-bound IL-15, membrane-bound IL-17, membrane-bound IL-21, membrane-bound IL-2, truncated CD19, or any combination. In some cases, an engineered K562 cell can expresses a membranous form of anti-CD3 mAb, clone OKT3, in addition to CD80 and CD83. In some cases, an engineered K562 cell can expresses a membranous form of anti-CD3 mAb, clone OKT3, membranous form of anti-CD28 mAb in addition to CD80 and CD83.

An aAPC can be a bead. A spherical polystyrene bead can be coated with antibodies against CD3 and CD28 and be used for T cell activation. A bead can be of any size. In some cases, a bead can be or can be about 3 and 6 micrometers. A bead can be or can be about 4.5 micrometers in size. A bead can be utilized at any cell to bead ratio. For example, a 3 to 1 bead to cell ratio at 1 million cells per milliliter can be used. An aAPC can also be a rigid spherical particle, a polystyrene latex microbeads, a magnetic nano- or microparticles, a nanosized quantum dot, a 4, poly(lactic-co-glycolic acid) (PLGA) microsphere, a nonspherical particle, a 5, carbon nanotube bundle, a 6, ellipsoid PLGA microparticle, a 7, nanoworms, a fluidic lipid bilayer-containing system, an 8, 2D-supported lipid bilayer (2D-SLBs), a 9, liposome, a 10, RAFTsomes/microdomain liposome, an 11, SLB particle, or any combination thereof.

In some cases, an aAPC can expand CD4 T cells. For example, an aAPC can be engineered to mimic an antigen processing and presentation pathway of HLA class II-restricted CD4 T cells. A K562 can be engineered to express HLA-D, DP α, DP β chains, Ii, DM α, DM β, CD80, CD83, or any combination thereof. For example, engineered K562 cells can be pulsed with an HLA-restricted peptide in order to expand HLA-restricted antigen-specific CD4 T cells.

In some cases, the use of aAPCs can be combined with exogenously introduced cytokines for T cell activation, expansion, or any combination. Cells can also be expanded in vivo, for example in the subject's blood after administration of genomically transplanted cells into a subject.

These compositions and methods for intracellular genomic transplant can provide a cancer therapy with many advantages. For example, they can provide high efficiency gene transfer, expression, increased cell survival rates, an efficient introduction of recombinogenic double strand breaks, and a process that favors the Homology Directed Repair (HDR) over Non-Homologous End Joining (NHEJ) mechanism, and efficient recovery and expansion of homologous recombinants.

Ribonucleic Acid System

One exemplary method of generating engineered cells through the use of a ribonucleic acid (RNA) system, e.g., a full or partial RNA system for intracellular genomic transplant. Cells to be engineered can be genetically modified with RNA or modified RNA instead of DNA to prevent DNA (e.g., double or single stranded DNA)-induced toxicity and immunogenicity sometimes observed with the use of DNA. In some cases a RNA/DNA fusion polynucleic acid can also be employed for genomic engineering.

In some cases, an all RNA polynucleic acid system for gene editing of primary human T cells can be used, see e.g. FIG. 5. The schematic shows that an in vitro transcribed ribonucleic acid can be delivered and reverse transcribed into dsDNA inside a target cell. A DNA template can then be used for a homologous recombination (HR) reaction inside the cell.

In some cases, robust genome engineering can be achieved by increasing the amount of polynucleic acid encoding a transgene. Introducing increased amounts of DNA may result in cellular toxicity, FIGS. 2 and 3, in some cases; therefore it may be desirable to introduce RNA to a cell for genome engineering.

In some cases, a transgene comprising an exogenous receptor sequence can be introduced into a cell for genome engineering via RNA, e.g., messenger RNA (mRNA). RNA, e.g., mRNA can be converted to DNA in situ. One exemplary method utilizes in vitro transcription of a polynucleic acid to produce an mRNA polynucleic acid. An mRNA polynucleic acid may then be transfected into a cell with a reverse transcriptase (RT) (either in protein form or a polynucleic acid encoding for a RT).polynucleic acid encoding a reverse transcriptase (RT). In other cases, an RT protein is introduced into a cell. An RT can be or can be derived from Avian Myeloblastosis Virus Reverse Transcriptase (AMV RT), Moloney murine leukemia virus (M-MLV RT), human immunodeficiency virus (HIV) reverse transcriptase (RT), derivatives thereof or combinations thereof. Once transfected, a reverse transcriptase may transcribe the engineered mRNA polynucleic acid into a double strand DNA (dsNDA). A reverse transcriptase (RT) can be an enzyme used to generate complementary DNA (cDNA) from an RNA template. In some cases, an RT enzyme can synthesize a complementary DNA strand initiating from a primer using RNA (cDNA synthesis) or single-stranded DNA as a template. In some cases, an RT may be functional at temperatures of 37 degrees Celsius. In other cases, an RT may be functional below temperatures of 37 degrees Celsius. In other cases, an RT may be functional at temperatures over 37 degrees Celsius.

An RT can be any enzyme that is used to generate complementary DNA (cDNA) from an RNA template. An RT can be derived from retroviruses, hepatitis B virus, hepadnaviridae, or any double strand or single strand viruses. An RT can have any number of biochemical activities. For example, an RT can have RNA-dependent DNA polymerase activity. An RT can have ribonuclease H activity. An RT can have DNA-dependent DNA polymerase activity. In some cases, an RT can be used to convert single-strand RNA to double strand cDNA. cDNA can subsequently be introduced into a cell genome. FIG. 101A and FIG. 101B shows in vivo reverse transcription of electroporated mRNA.

An RT can be an HIV-1 RT from human immunodeficiency virus type 1. An HIV-1 RT can have subunits. For example, an HIV-1 RT can have two subunits. An RT can also be from a Maloney murine leukemia virus (M-MLV). An M-MLV virus may or may not have subunits. In some cases, a M-MLV virus is a single monomer. An RT can also be an avian myeloblastosis virus RT (AMV RT). An AMV RT may have subunits. In some cases, an AMV RT has two subunits. In some cases, a telomerase RT is also used.

In some cases, a ds DNA can be used in a subsequent homologous recombination step. A subsequent homologous recombination step can introduce an exogenous receptor sequence into the genome of a cell.

Methods of Targeting a Reverse Transcriptase to an Engineered Polynucleic Acid a) Unique Sequence In some cases, an introduced RT may need to be targeted to an introduced polynucleic acid. An introduced polynucleic acid may be RNA or DNA. In some cases, an introduced polynucleic acid may be a combination of RNA and DNA. Targeting an introduced RT may be performed by incorporating a unique sequence to a polynucleic acid encoding for an engineered receptor, FIG. 22. These unique sequences can help target the RT to a particular polynucleic acid. In some cases, a unique sequence can increase efficiency of a reaction. Table 1 describes possible unique sequences to target an RT to an engineered polynucleic acid. A unique sequence may be a sequence that may not be found in any human mRNA transcripts. In some, cases a unique sequence may be modified from a known mRNA transcript so that it is no longer an endogenous sequence. A unique sequence may be identified using bioinformatics. In some cases, a unique sequence may be identified using publically available databases.

TABLE 1

| Unique Sequences | |
|---|---|
| SEQ ID | Unique Sequence 5' to 3' |
| 1 | TAG TCG GTA CGC GAC TAA GCC G |
| 2 | TAG TCG TCG TAA CGT ACG TCG G |
| 3 | CGG CTA TAA CGC GTC GCG TAG |
| 4 | TAG AGC GTA CGC GAC TAA CGA C |

A unique sequence may be any base pair length in size. A unique sequence can be or can be between 1-20 base pairs, 1-30 base pairs, 1-40, 1-50, 1-60, 1-70, 1-80, 1-90, 1-100 base pairs, or any length over 100 base pairs. In some cases, a unique sequence is or is between 1-20 base pairs. In some cases, a unique sequence is over 20 base pairs. In some cases, a unique sequence is exactly 20 base pairs in length. A unique sequence may be 1, 2, 3, 4, 5, 6, 7, 8, 9, 10, 11, 12, 13, 14, 15, 16, 17, 18, 19, 20, 21, or more base pairs. In some cases, multiple unique sequences are introduced into a polynucleic acid.

In some cases, a unique sequence may be included in an engineered polynucleic acid. A unique sequence can be used to target a RT to an engineered polynucleic acid. In some cases, oligonucleotides can be pre-annealed to an engineered polynucleic acid. Pre-annealed oligonucleotides can encompass any length of a complementary unique sequence in an engineered polynucleic acid. Pre-annealed oligonucleotides may be exactly the same length of a complementary unique sequence or less than the entire length of a complementary sequence of a unique sequence in an engineered polynucleic acid.

b) Engineered Structure

In some cases, a reverse transcriptase can be targeted to an engineered polynucleic acid by engineering the polynucleic acid to have a secondary structure. A secondary structure can be any structure. In some cases, multiple secondary structures can be utilized.

For example, a secondary structure can be a double helix. A double helix can be formed by regions of many consecutive base pairs. In some cases, a double helix is a tertiary structure. A double helix can be a spiral polymer. In some cases, a double helix can be right-handed. A double helix can also be left-handed. In some cases, a double helix can be a right-handed structure that can contain a two nucleotide strand that can base pair together. In some cases, a single turn of a double helix can be or can be about 10 nucleotides. In other cases, a single turn of a double helix can be or can be about over 10 nucleotides or less than 10 nucleotides. A single turn of a double helix can be or can be about 1-5 nucleotides, 1-10, 1-20, or over 20 nucleotides in length.

A secondary structure can also be a stem-loop or hairpin structure. RNA hairpins can be formed when two complementary sequences in a single RNA molecule meet and bind together, after a folding or wrinkling of a molecule. In some cases, an RNA hairpin can consist of a double-stranded RNA (dsRNA) stem, and a terminal loop. Structurally, an RNA hairpin can occur in different positions within different types of RNAs. An RNA hairpin may occur on a 5' end, a 3' end or anywhere in between a 5' end and a 3' end of a ribonucleic acid. An RNA hairpin can differ in the length of a stem, the size of a loop, the number and size of bulges, and in the nucleotide sequence. An RNA hairpin can be of any stem length. An RNA hairpin can have any size loop. For example, a hairpin loop can be between or between about 4 to 8 bases long. In some cases, a hairpin loop is over or over about 8 bases long. In certain instances, a hairpin loop that is over or over about 8 bases long can have a secondary structure. An RNA hairpin can have any number and size of bulges. An RNA hairpin can be of any base pair length. e.g., an RNA hairpin can be or can be about 1-100 base pairs, 1-200 base pairs, 1-300 base pairs, or over 300 base pairs. An RNA hairpin can have secondary structure such as bulging for example.

Functionally, an RNA hairpin can regulate gene expression in cis or trans, e.g., an RNA hairpin within an RNA molecule can regulate just that molecule (cis) or it can induce effects on other RNAs or pathways (trans). Hairpins can serve as binding sites for a variety of proteins, act as substrates for enzymatic reactions as well as display intrinsic enzymatic activities. In some cases, a hairpin can be used to target an RT to an engineered polynucleic acid for transcription. A hairpin structure can be located at a ribosome binding site. A hairpin structure can facilitate translation.

A hairpin structure can have an internal ribosomal entry site (IRES). An IRES sequence may allow for targeted transcription of an mRNA containing a hairpin. In some cases, a hairpin structure can direct an engineered polynucleic acid to a cellular location. For example, a hairpin can be or can contain a nuclear localization signal.

In some cases, an RT can target an RNA hairpin of an engineered polynucleic acid. An engineered polynucleic acid can contain one or more hairpin regions. A hairpin can form at any location of an engineered polynucleic acid.

A secondary structure can also be a pseudoknot. A pseudoknot can be a nucleic acid secondary structure that may contain at least two stem-loop, or hair pin, structures in which half of one stem is intercalated between the two halves of another stem. Several distinct folding topologies of pseudoknots can be used. In some cases, an H type pseudoknot can be used. In an H-type fold, bases in a loop of a hairpin can form intramolecular pairs with bases outside of a stem. This can cause formation of a second stem and loop, resulting in a pseudoknot with two stems and two loops. Two stems can be able to stack on top of each other to form a quasi-continuous helix with one continuous and one discontinuous strand.

In some cases, a pseudoknot can be used to initiate transcription of an engineered polynucleic acid. A pseudoknot can induce a ribosome to slip into alternative reading frames. A pseudoknot can in some instances cause frameshifting.

Targeting an Engineered Polynucleic Acid to a Nucleus

In some cases, an engineered polynucleic acid may need to be localized to a cellular nucleus. An engineered polynucleic acid may encode for an exogenous or engineered receptor sequence that may need to be introduced into a genome of a cell. In some cases, introducing a receptor sequence to a cell genome may be performed by localizing an engineered polynucleic acid to a cell nuclease for transcription.

An engineered RNA polynucleic acid may be localized to a cellular nuclease. Localization may comprise any number of techniques. In some cases, a nuclear localization signal can be used to localize an engineered polynucleic acid encoding for an engineered receptor to a nucleus. A nuclear localization signal can be any endogenous or engineered sequence.

In some cases, a nuclear localization signal, or sequence, can be derived from a protein that may be strictly nuclear. A protein that is nuclear may have nuclear localization signal that may not be affected by cellular state or its genomic expression locus. In some cases, nuclear localization may be derived from sequences or structures within a mature, spliced protein transcript.

In some cases, a nuclear localization signal can be a BMP2-OP1-responsive gene ("BORG") sequence. In some cases, multiple BORG NLS sequences are included in a polynucleic acid. 1-5 BORG sequences may be included in some cases. In other cases, 5-10 BORG sequences are included. 1, 2, 3, 4, 5, 6, 7, 8, 9, 10, or more BORG sequences can be included as a nuclear localization signal in a polynucleic acid. In some cases, as many BORG sequences that may be encoded within a polynucleic acid are utilized. A nuclear localization signal can be a short, RNA motif consisting of a pentamer AGCCC with two sequence restrictions at positions −8 and −3 relative to the start of a pentamer. A BORG sequence can be used in an engineered polynucleic acid to localize it to a nucleus of a cell.

In some cases, a nuclear localization may be mediated by interaction of a SF1 with tandem repeats of a short sequence that resembles the intronic branch site consensus sequence, resulting in localization of an RNA polynucleic acid to discrete nuclear subdomains. A BORG sequence may function using by interacting with an abundant, nuclear-restricted protein or protein complex such as transcriptional complexes. In other cases, a nuclear localization sequence may interact with nuclear-localized RNAs or chromatin-associated RNA-protein complexes that may anchor a polynucleic acid containing a nuclear localization motif within the nucleus. In other cases, a nuclear localization sequence may interact with factors that can interfere with the formation of export complexes, resulting in retention of a polynucleic acid in a nucleus.

A nuclear localization signals may be a sequence, a structure, or any combination thereof. In some cases, nuclear localization of a nucleic acid may not require transport but only anchoring to a cytoskeleton (actin or intermediate filaments). In other cases, an engineered polynucleic acid can be transported on microtubules to a nucleus. Transport can take place in the form of large ribonucleoprotein (RNP) complexes or RNP transport granules. In some cases, a polynucleic acid can be complexed with a secondary protein that localizes it to a nucleus. In some cases, a transported polynucleic acid can be anchored at its final destination. Some trans-acting factors can shuttle back into the nucleus.

In some cases, a polynucleic acid may be introduced directly into a nucleus. In other cases, a polynucleic acid can be synthesized in a nucleus. A polynucleic acid can be engineered to encode at least one BORG sequence. A polynucleic acid can be engineered to encode for multiple BORG sequences. A polynucleic acid can be engineered to encode for four BORG sequences. In some cases, a cell is transfected with a polynucleic acid containing a BORG sequence. A polynucleic acid containing a BORG sequence can be localized into a cellular nucleus where it can participate in homologous recombination. In some cases, a polynucleic acid that is localized to a nucleus can encode a receptor sequence. A receptor sequence can be introduced into a genome of a cell through a BORG-mediated nuclear localization.

Polynucleic Acid Modifications

The polynucleic acids as described herein can be modified. A modification can be made at any location of a polynucleic acid. More than one modification can be made to a single polynucleic acid. A polynucleic acid can undergo quality control after a modification. In some cases, quality control may include PAGE, HPLC, MS, or any combination thereof.

A modification can be a substitution, insertion, deletion, chemical modification, physical modification, stabilization, purification, or any combination thereof.

Figure 31:
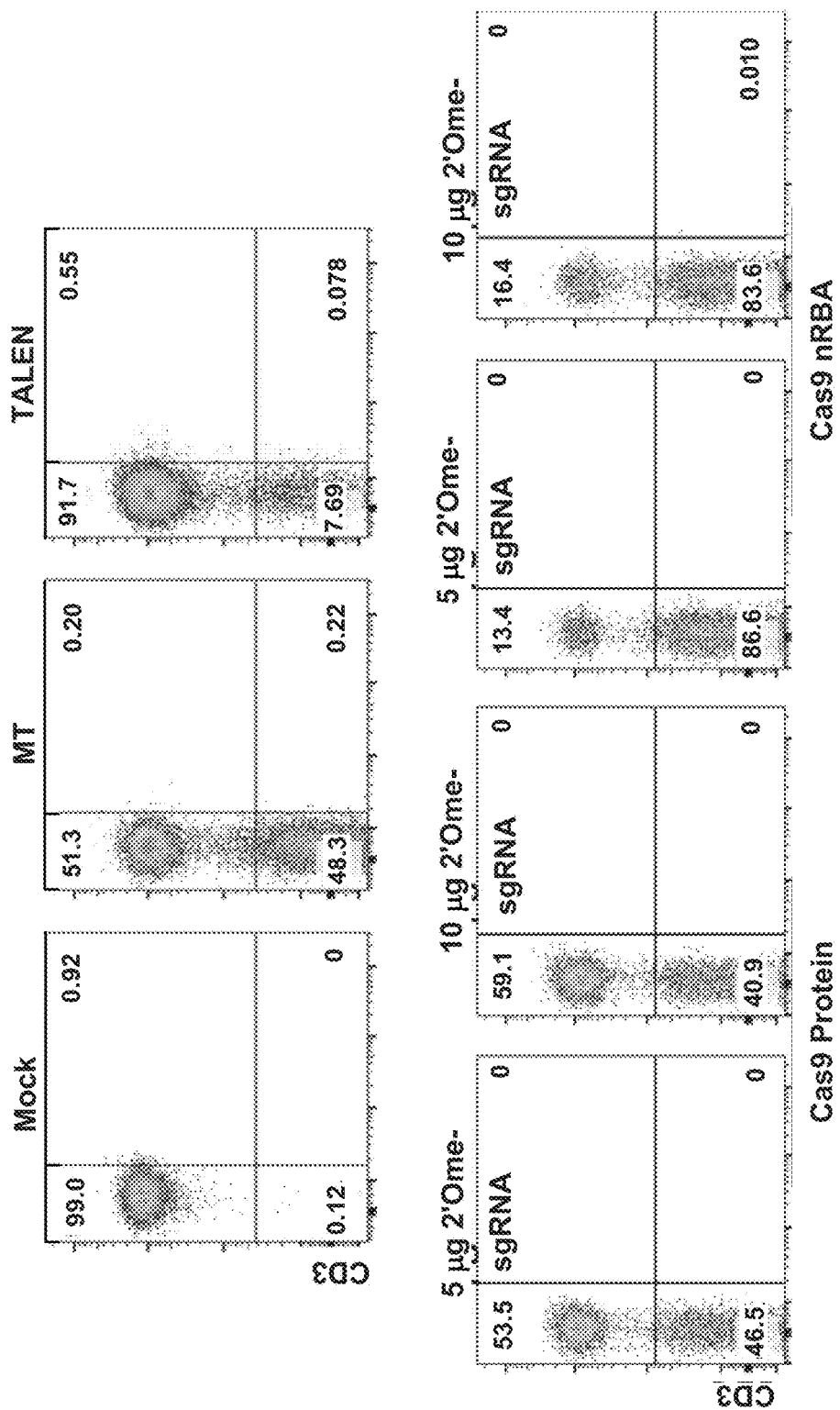
FIG. 31 shows knockout of TCR alpha, as measured by CD3 FACs expression, in primary human T cells utilizing optimized CRISPR guideRNAs with 2' O-Methyl RNA modification at 5 micrograms and 10 micrograms.
Figure 32:
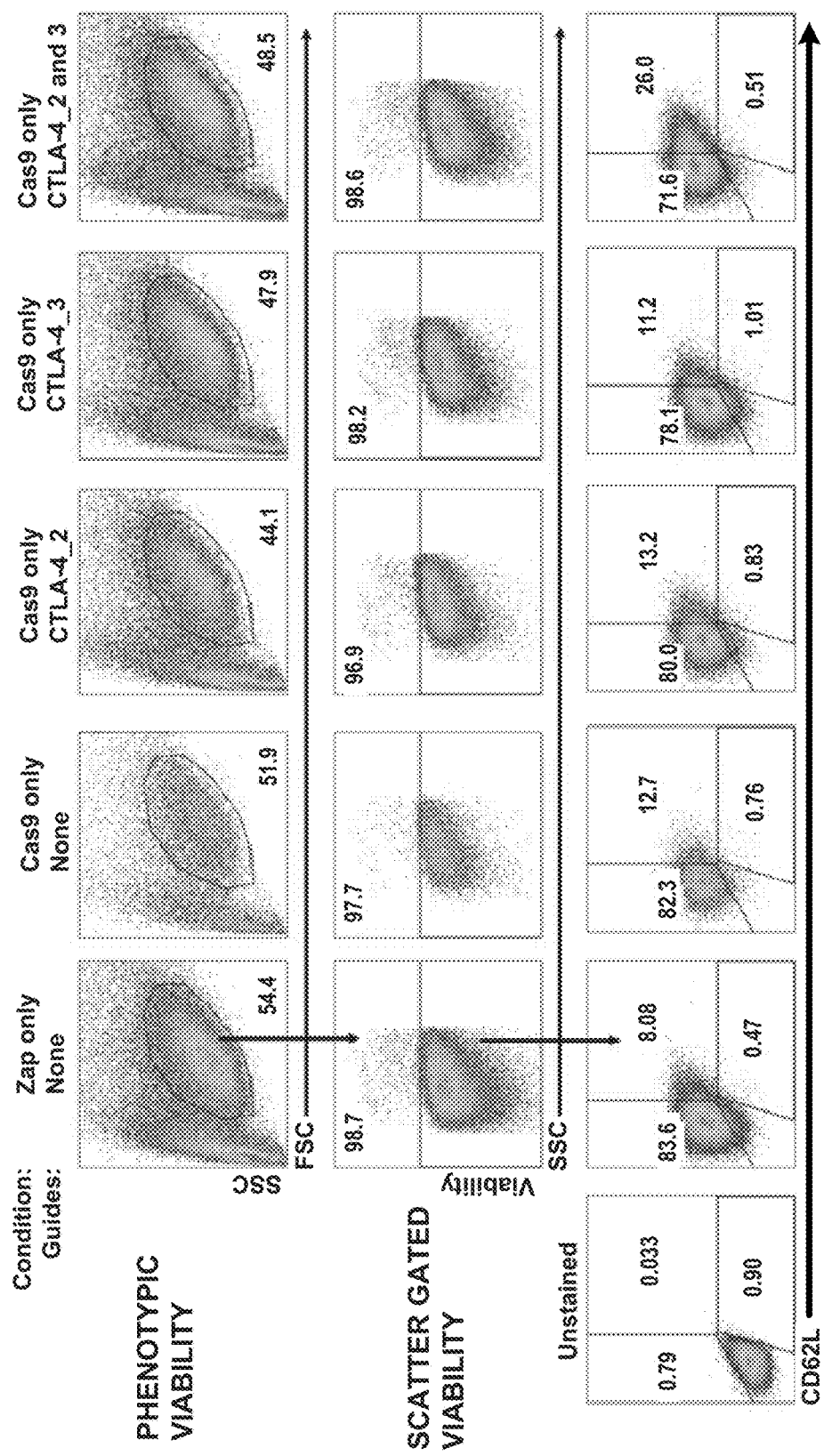
FIG. 32 depicts a method of measuring T cell viability and phenotype post treatment with CRISPR and guide RNAs to CTLA-4. Phenotype was measured by quantifying the frequency of treated cells exhibiting a normal FSC/SSC profile normalized to frequency of electroporation alone control. Viability was also measured by exclusion of viability dye by cells within the FSC/SSC gated population. T cell phenotype is measured by CD3 and CD62L.
Figure 33:
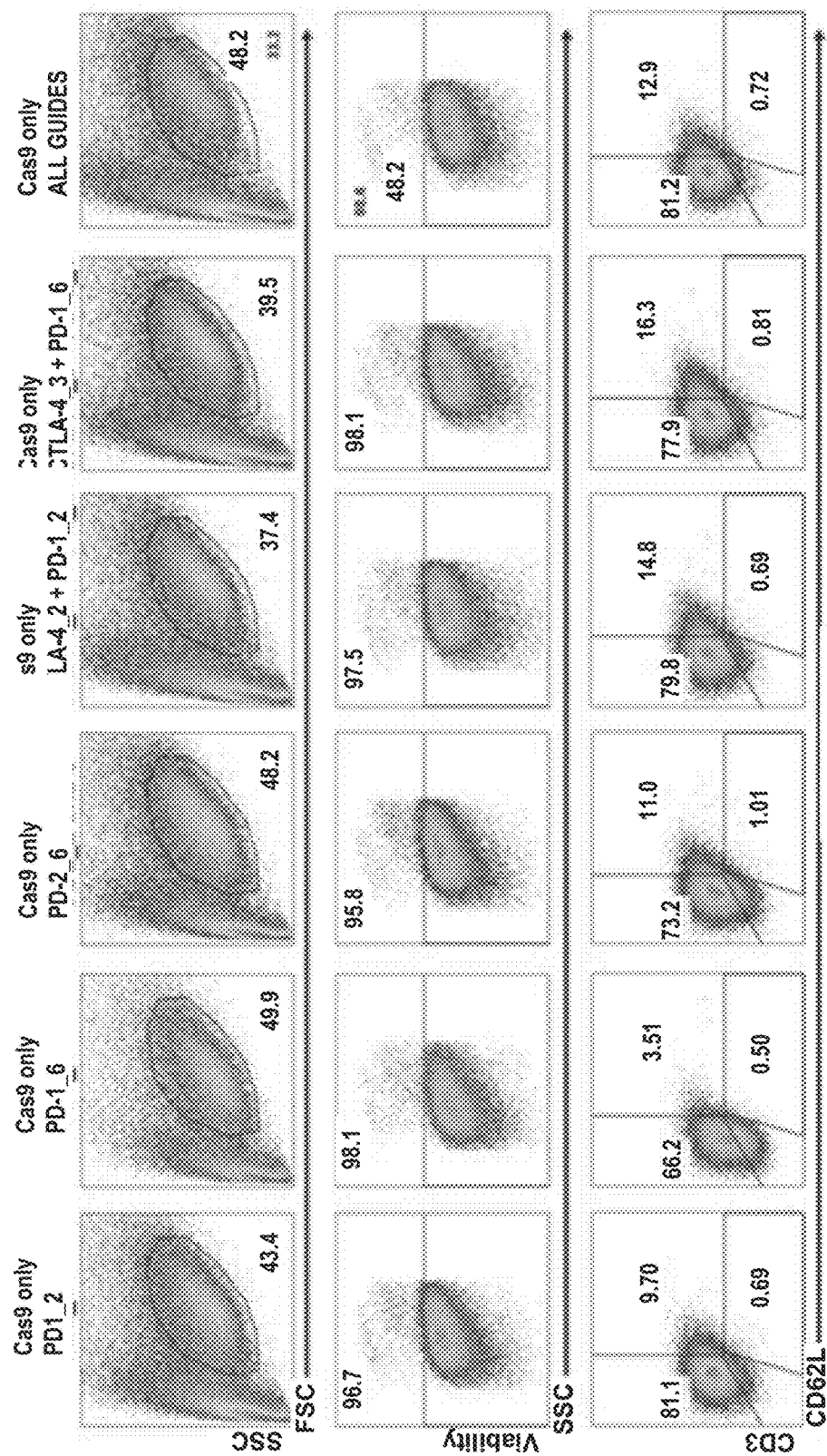
FIG. 33 shows method of measuring T cell viability and phenotype post treatment with CRISPR and guide RNAs to PD-1, and PD-1 and CTLA-4. Phenotype was measured by quantifying the frequency of treated cells exhibiting a normal FSC/SSC profile normalized to frequency of electroporation alone control. Viability was also measured by exclusion of viability dye by cells within the FSC/SSC gated population. T cell phenotype is measured by CD3 and CD62L.

A polynucleic acid can also be modified by 5' adenylate, 5' guanosine-triphosphate cap, 5'$N^7$-Methylguanosine-triphosphate cap, 5' triphosphate cap, 3' phosphate, 3' thiophosphate, 5' phosphate, 5' thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DAB-CYL, black hole quencher 1, black hole quencher 2, DAB-CYL SE, dT-DABCYL, IRDye QC-1, QSY-21, QSY-35, QSY-7, QSY-9, carboxyl linker, thiol linkers, 2' deoxyribonucleoside analog purine, 2' deoxyribonucleoside analog pyrimidine, ribonucleoside analog, 2'-O-methyl ribonucleoside analog, sugar modified analogs, wobble/universal bases, fluorescent dye label, 2' fluoro RNA, 2' O-methyl RNA, methylphosphonate, phosphodiester DNA, phosphodiester RNA, phosphothioate DNA, phosphorothioate RNA, UNA, pseudouridine-5'-triphosphate, 5-methylcytidine-5'-triphosphate, or any combination thereof. A representative 2' O-methyl RNA modified gRNA is shown in FIG. 31.

In some cases, a modification can be modification is permanent. In other cases, a modification is transient. In some cases, multiple modifications are made to a polynucleic acid. A polynucleic acid modification may alter physico-chemical properties of a nucleotide, such as their conformation, polarity, hydrophobicity, chemical reactivity, base-pairing interactions, or any combination thereof.

A modification can also be a phosphorothioate substitute. In some cases, a natural phosphodiester bond may be susceptible to rapid degradation by cellular nucleases and; a modification of internucleotide linkage using phosphorothioate (PS) bond substitutes can be more stable towards hydrolysis by cellular degradation. A modification can increase stability in a polynucleic acid. A modification can also enhance biological activity. In some cases, a phosphorothioate enhanced RNA polynucleic acid can inhibit RNase A, RNase T1, calf serum nucleases, or any combinations thereof. These properties can allow the use of PS-RNA polynucleic acids to be used in applications where exposure to nucleases is of high probability in vivo or in vitro. For example, phosphorothioate (PS) bonds can be introduced between the last 3-5 nucleotides at the 5'- or 3'-end of a polynucleic acid which can inhibit exonuclease degradation. In some cases, phosphorothioate bonds can be added throughout an entire polynucleic acid to reduce attack by endonucleases.

In some cases, a modification can be screened. Screening can include, but is not limited to, testing for immunogenicity, testing for toxicity, testing for efficiency of transcription, testing for efficiency of translation, or any combination thereof. In some cases, a modification may not be immunogenic. A modification may not be toxic. In some cases, candidate modifications are screened prior to being incorporated into a polynucleic acid. In other cases, polynucleic acids with different modifications are screened to determine the level of immunogenicity, toxicity, efficacy, or any combination of the added modifications. In some cases, a modification is screened for its ability to support reverse transcription of a polynucleic acid. In some cases, a modification is a pseudouridine-5'-triphosphate (see e.g., FIG. 59). In other cases a modification is a 5-methylcytidine-5'-triphosphate (see e.g., FIG. 59). A modification can also include a change in chirality.

Polynucleic acids can be assembled by a variety of methods, e.g., by automated solid-phase synthesis. A polynucleic acid can be constructed using standard solid-phase DNA/RNA synthesis. A polynucleic acid can also be constructed using a synthetic procedure. A polynucleic acid can also be synthesized either manually or in a fully automated fashion. In some cases, a synthetic procedure may comprise 5'-hydroxyl oligonucleotides can be initially transformed into corresponding 5'-H-phosphonate mono esters, subsequently oxidized in the presence of imidazole to activated 5'-phosphorimidazolidates, and finally reacted with pyrophosphate on a solid support. This procedure may include a purification step after the synthesis such as PAGE, HPLC, MS, or any combination thereof.

In some cases, a polynucleic acid can be modified to make it less immunogenic and more stable for transfection into a cell. A modified polynucleic acid can encode for any number of genes. In some cases, a polynucleic acid can encode for a transgene. A transgene can encode for an engineered receptor. A receptor can be a T cell receptor (TCR), B cell receptor (BCR), chimeric antigen receptor (CAR), or any combination thereof, see e.g., FIG. 57. In some cases, a receptor can be a TCR.

In some cases, a modified polynucleic acid can be used in subsequent steps. For example, a modified polynucleic acid may be used in a homologous recombination reaction. A homologous recombination reaction may include introducing a transgene encoding for an exogenous receptor in a genome of a cell. An introduction may include any mechanism necessary to introduce a transgene sequence into a genome of a cell. In some cases, CRISPR is used in steps to introduce a receptor sequence into a genome of a cell.

Intracellular Genomic Transplant

Intracellular genomic transplant can be method of genetically modifying cells and nucleic acids for therapeutic applications. The compositions and methods described throughout can use a nucleic acid-mediated genetic engineering process for tumor-specific TCR expression in a way that leaves the physiologic and immunologic anti-tumor potency of the T cells unperturbed. Effective adoptive cell transfer-based immunotherapies (ACT) can be useful to treat cancer (e.g., metastatic cancer) patients. For example, autologous peripheral blood lymphocytes (PBL) can be modified using non-viral methods to express T Cell Receptors (TCR) that recognize unique mutations, neo-antigens, on cancer cells and can be used in the disclosed compositions and methods of an intracellular genomic transplant.

One exemplary method of identifying a sequence of cancer-specific TCR that recognizes unique immunogenic mutations on the patient's cancer are described in PCT/US14/58796. For example, a cancer-specific TCR transgene can be inserted into the genome of a cell (e.g., T cell) using random or specific insertions.

In some aspects, the methods disclosed herein comprise introducing into the cell one or more nucleic acids (e.g., a first nucleic acid or a second acid). A person of skill in the art will appreciate that a nucleic acid may generally refer to a substance whose molecules consist of many nucleotides linked in a long chain. Non-limiting examples of the nucleic acid include an artificial nucleic acid analog (e.g., a peptide nucleic acid, a morpholino oligomer, a locked nucleic acid, a glycol nucleic acid, or a threose nucleic acid), a circular nucleic acid, a DNA, a single stranded DNA, a double stranded DNA, a genomic DNA, a plasmid, a plasmid DNA, a viral DNA, a viral vector, a gamma-retroviral vector, a lentiviral vector, an adeno-associated viral vector, an RNA, short hairpin RNA, psiRNA and/or a hybrid or combination thereof. In some embodiments, a method may comprise a nucleic acid, and the nucleic acid is synthetic. In some embodiments, a sample may comprise a nucleic acid, and the nucleic acid may be fragmented. In some cases, a nucleic acid is a minicircle.

In some embodiments, a nucleic acid may comprise promoter regions, barcodes, restriction sites, cleavage sites, endonuclease recognition sites, primer binding sites, selectable markers, unique identification sequences, resistance genes, linker sequences, or any combination thereof. In some aspects, these sites may be useful for enzymatic digestion, amplification, sequencing, targeted binding, purification, providing resistance properties (e.g., antibiotic resistance), or any combination thereof. In some embodiments, the nucleic acid may comprise one or more restriction sites. A restriction site may generally refer to a specific peptide or nucleotide sequences at which site-specific molecules (e.g., proteases, endonucleases, or enzymes) may cut the nucleic acid. In one example, a nucleic acid may comprise one or more restriction sites, wherein cleaving the nucleic acid at the restriction site fragments the nucleic acid.

In some embodiments, the nucleic acid may comprise at least one endonuclease recognition site. In some embodiments, the endonuclease recognition site may comprise a Type I endonuclease recognition site, a Type II endonuclease recognition site, a Type III endonuclease recognition site, a Type IV endonuclease recognition site, or a Type V endonuclease recognition site. Non-limiting examples of endonuclease recognition sites include an AatII recognition site, an Acc65I recognition site, an AccI recognition site, an AclI recognition site, an AatII recognition site, an Acc65I recognition site, an AccI recognition site, an AclI recognition recognition site, an AfeI recognition site, an AflII recognition site, an AgeI recognition site, an ApaI recognition site, an ApaLI recognition site, an ApoI recognition site, an AscI recognition site, an AseI recognition site, an AsiSI recognition site, an AvrII recognition site, a BamHI recognition site, a BclI recognition site, a BglII recognition site, a Bme1580I recognition site, a BmtI recognition site, a BsaI recognition site, a BsaHI recognition site, a BsiEI recognition site, a BsiWI recognition site, a BspEI recognition site, a BspHI recognition site, a BsrGI recognition site, a BssHII recognition site, a BstBI recognition site, a BstZ17I recognition site, a BtgI recognition site, a ClaI recognition site, a DraI recognition site, an EaeI recognition site, an EagI recognition site, an EcoRI recognition site, an EcoRV recognition site, an FseI recognition site, an FspI recognition site, an HaeII recognition site, an HincII recognition site, a HindIII recognition site, an HpaI recognition site, a KasI recognition site, a KpnI recognition site, an MfeI recognition site, an MluI recognition site, an MscI recognition site, an MspA1I recognition site, an MfeI recognition site, an MluI recognition site, an MscI recognition site, an MspA1I recognition site, an NaeI recognition site, a NarI recognition site, an NcoI recognition site, an NdeI recognition site, an NgoMIV recognition site, an NheI recognition site, a NotI recognition site, an NruI recognition site, an NsiI recognition site, an NspI recognition site, a PacI recognition site, a PciI recognition site, a PmeI recognition site, a PmlI recognition site, a PsiI recognition site, a PspOMI recognition site, a PstI recognition site, a PvuI recognition site, a PvuII recognition site, a SacI recognition site, a SacII recognition site, a SalI recognition site, an SbfI recognition site, an ScaI recognition site, an SfcI recognition site, an SfoI recognition site, an SgrAI recognition site, an SmaI recognition site, an SmlI recognition site, an SnaBI recognition site, an SpeI recognition site, an SphI recognition site, an SspI recognition site, an StuI recognition site, an SwaI recognition site, an XbaI recognition site, an XhoI recognition site, and an XmaI recognition site. In a particular example, the restriction site may comprise NotI endonuclease recognition site.

In some cases, a nucleic acid may readily bind to another nucleic acid (e.g., the nucleic acid comprises a sticky end or nucleotide overhang). For example, the nucleic acid may comprise an overhang at a first end of the nucleic acid. Generally, a sticky end or overhang may refer to a series of unpaired nucleotides at the end of a nucleic acid. In some cases, the nucleic acid may comprise a single stranded overhang at one or more ends of the nucleic acid. In some cases, the overhang can occur on the 3' end of the nucleic acid. In some cases, the overhang can occur on the 5' end of the nucleic acid. The overhang can comprise any number of nucleotides. For example, the overhang can comprise 1 nucleotide, 2 nucleotides, 3 nucleotides, 4 nucleotides, or 5 or more nucleotides. In some cases, the nucleic acid may require modification prior to binding to another nucleic acid (e.g., the nucleic acid may need to be digested with an endonuclease). In some cases, modification of the nucleic acid may generate a nucleotide overhang, and the overhang can comprise any number of nucleotides. For example, the overhang can comprise 1 nucleotide, 2 nucleotides, 3 nucleotides, 4 nucleotides, or 5 or more nucleotides. In one example, the nucleic acid may comprise a restriction site, wherein digesting the nucleic acid at the restriction site with a restriction enzyme (e.g., NotI) produces a 4 nucleotide overhang. In some cases, the modifying comprises generating a blunt end at one or more ends of the nucleic acid. Generally, a blunt end may refer to a double stranded nucleic acid wherein both strands terminate in a base pair. In one example, the nucleic acid may comprise a restriction site, wherein digesting the nucleic acid at the restriction site with a restriction enzyme (e.g., BsaI) produces a blunt end.

Promoters are sequences of nucleic acid that control the binding of RNA polymerase and transcription factors, and can have a major effect on the efficiency of gene transcription, where a gene may be expressed in the cell, and/or what cell types a gene may be expressed in. Non limiting examples of promoters include a cytomegalocirus (CMV) promoter, an elongation factor 1 alpha (EF1α) promoter, a simian vacuolating virus (SV40) promoter, a phosphoglycerate kinase (PGK1) promoter, a ubiquitin C (Ubc) promoter, a human beta actin promoter, a CAG promoter, a Tetracycline response element (TRE) promoter, a UAS promoter, an Actin 5c (Ac5) promoter, a polyhedron promoter, Ca2+/calmodulin-dependent protein kinase II (CaM-KIIa) promoter, a GAL1 promoter, a GAL 10 promoter, a TEF1 promoter, a glyceraldehyde 3-phosphage dehydrogenase (GDS) promoter, an ADH1 promoter, a CaMV35S promoter, a Ubi promoter, a human polymerase III RNA (H1) promoter, a U6 promoter, or a combination thereof.

In some cases, the nucleic acid may be a viral vector, and the viral vector may comprise sequence encoding long terminal repeats (LTRs); U3-R-U5 regions found on either side of a retroviral provirus. In some cases, the nucleic acid may be a viral vector, and the viral vector may comprise sequence encoding U3, a unique region at the 3' end of viral genomic RNA, containing sequences necessary for activation of viral genomic RNA transcription. In some cases, the nucleic acid may be a viral vector, and the viral vector may comprise sequence encoding R, a repeat region found within both the 5' and 3' LTRs of retro/lentiviral vectors. In some cases, the nucleic acid may be a viral vector, and the viral vector may comprise sequence encoding U5, a unique region at the 5' end of the viral genomic RNA. In some cases, the nucleic acid may be a viral vector, and the viral vector may comprise sequence encoding 5' LTR, which may acts as an RNA pot II promoter. In some cases, the nucleic acid may be a viral vector, and the viral vector may comprise sequence encoding a hybrid 5' LTR with a constitutive promoter such as CMV or RSV. In some cases, the nucleic acid may be a viral vector, and the viral vector may comprise sequence encoding a TAR, a trans-activating response element which may be located in the R region of the LTR and acts as a binding site for Tat. In some cases, the nucleic acid may be a viral vector, and the viral vector may comprise sequence encoding 3' LTR, which may be used to terminate transcription started by 5' LTR by the addition of a poly A tract following the R sequence. In some cases, the nucleic acid may be a viral vector, and the viral vector may comprise sequence encoding central polypurine tract (cPPT), a recognition site for proviral DNA synthesis. The presence of cPPT can affect transduction efficiency and transgene expression. In some cases, the nucleic acid may be a viral vector, and the viral vector may comprise sequence encoding Psi, an RNA target site for packaging by nucleocapsid. In some cases, the nucleic acid may be a viral vector, and the viral vector may comprise sequence encoding rev response element (RRE), a sequence to which the Rev protein binds. In some cases, the nucleic acid may be a viral vector, and the viral vector may comprise sequence encoding the woodchuck hepatitis virus post-transcriptional regulatory element, a sequence that stimulates the expression of transgenes via increased nuclear export. In some cases, the nucleic acid may be a viral vector, and the viral vector may comprise sequence encoding GAG, a precursor structural protein of the lentiviral particle containing matrix, capsid, and nucleocapsid components. In some cases, the nucleic acid may be a viral vector, and the viral vector may comprise sequence encoding Pol, a precursor protein containing reverse transcriptase and integrase components. In some cases, the nucleic acid may be a viral vector, and the viral vector may comprise sequence encoding Rev, which may bind to RRE within unspliced and partially spliced transcripts to facilitate nuclear export. In some cases, the nucleic acid may be a viral vector, and the viral vector may comprise sequence encoding trans-activator (Tat), which may bind to TAR to activate transcription from the LTR promoter. In some cases, the nucleic acid may be a viral vector, and the viral vector may comprise sequence encoding vesicular stomatitis virus G glycoprotein (VSVG), a broad tropism envelope protein that can be used to pseudotype lentiviral vectors. In some cases, the nucleic acid may be a viral vector, and the viral vector may comprise sequence encoding inverted terminal repeat (ITR), which forms a T-shaped hairpin that can serve as the origin of viral DNA replication. ITR symmetry can affect the efficient multiplication of the AAV genome. In some cases, the nucleic acid may be a viral vector, and the viral vector may comprise sequence encoding Rep (e.g., Rep78, Rep68, Rep52, and Rep40), which are packaging proteins that are required for genome replication and necessary for integration. In some cases, the nucleic acid may be a viral vector, and the viral vector may comprise sequence encoding structural capsid proteins (e.g., VP1, VP2, and VP3), may serve to release the AAV particles from late endosomes and/or ensure correct virion assembly.

In some cases, the nucleic acid may comprise a barcode or a barcode sequence. A barcode or barcode sequence relates to a natural or synthetic nucleic acid sequence comprised by a polynucleotide allowing for unambiguous identification of the polynucleotide and other sequences comprised by the polynucleotide having said barcode sequence. For example, a nucleic acid comprising a barcode can allow for identification of the encoded transgene. A barcode sequence can comprise a sequence of at least 3, 4, 5, 6, 7, 8, 9, 10, 11, 12, 13, 14, 15, 16, 17, 18, 19, 20, 25, 30, 40, 45, or 50 or more consecutive nucleotides. A nucleic acid can comprise two or more barcode sequences or compliments thereof. A barcode sequence can comprise a randomly assembled sequence of nucleotides. A barcode sequence can be a degenerate sequence. A barcode sequence can be a known sequence. A barcode sequence can be a predefined sequence.

In some cases, the methods disclosed herein may comprise a nucleic acid (e.g., a first nucleic acid and/or a second nucleic acid). In some cases, the nucleic acid may encode a transgene. Generally, a transgene may refer to a linear polymer comprising multiple nucleotide subunits. A transgene may comprise any number of nucleotides. In some cases, a transgene may comprise less than about 100 nucleotides. In some cases, a transgene may comprise at least about 100 nucleotides. In some cases, a transgene may comprise at least about 200 nucleotides. In some cases, a transgene may comprise at least about 300 nucleotides. In some cases, a transgene may comprise at least about 400 nucleotides. In some cases, a transgene may comprise at least about 500 nucleotides. In some cases, a transgene may comprise at least about 1000 nucleotides. In some cases, a transgene may comprise at least about 5000 nucleotides. In some cases, a transgene may comprise at least about 10,000 nucleotides. In some cases, a transgene may comprise at least about 20,000 nucleotides. In some cases, a transgene may comprise at least about 30,000 nucleotides. In some cases, a transgene may comprise at least about 40,000 nucleotides. In some cases, a transgene may comprise at least about 50,000 nucleotides. In some cases, a transgene may comprise between about 500 and about 5000 nucleotides. In some cases, a transgene may comprise between about 5000 and about 10,000 nucleotides. In any of the cases disclosed herein, the transgene may comprise DNA, RNA, or a hybrid of DNA and RNA. In some cases, the transgene may be single stranded. In some cases, the transgene may be double stranded.

a. Random Insertion

One or more transgenes of the methods described herein can be inserted randomly into the genome of a cell. These transgenes can be functional if inserted anywhere in a genome. For instance, a transgene can encode its own promoter or can be inserted into a position where it is under the control of an endogenous promoter. Alternatively, a transgene can be inserted into a gene, such as an intron of a gene, an exon of a gene, a promoter, or a non-coding region.

A nucleic acid, e.g., RNA, encoding a transgene sequences can be randomly inserted into a chromosome of a cell. A random integration can result from any method of introducing a nucleic acid, e.g., RNA, into a cell. For example, the method can be, but is not limited to, electroporation, sonoporation, use of a gene gun, lipotransfection, calcium phosphate transfection, use of dendrimers, microinjection, and use of viral vectors including adenoviral, AAV, and retroviral vectors, and/or group II ribozymes.

A RNA encoding a transgene can also be designed to include a reporter gene so that the presence of a transgene or its expression product can be detected via activation of the reporter gene. Any reporter gene can be used, such as those disclosed above. By selecting in cell culture those cells in which a reporter gene has been activated, cells can be selected that contain a transgene.

Figure 83:
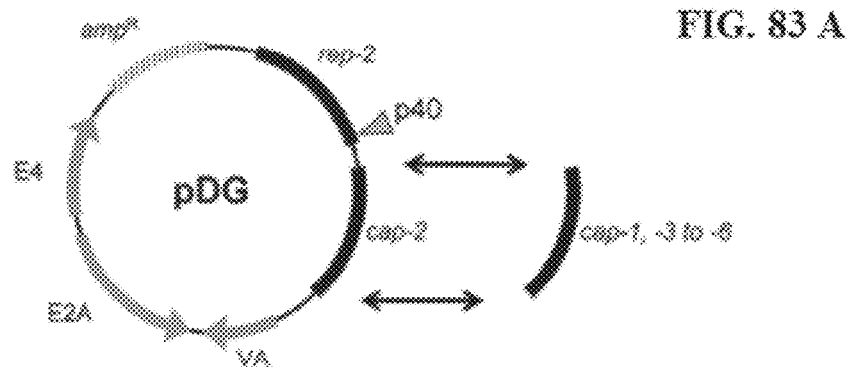
FIG. 83 A depicts a pDG6-AAV helper-free packaging plasmid for AAV TCR delivery.
Figure 83:
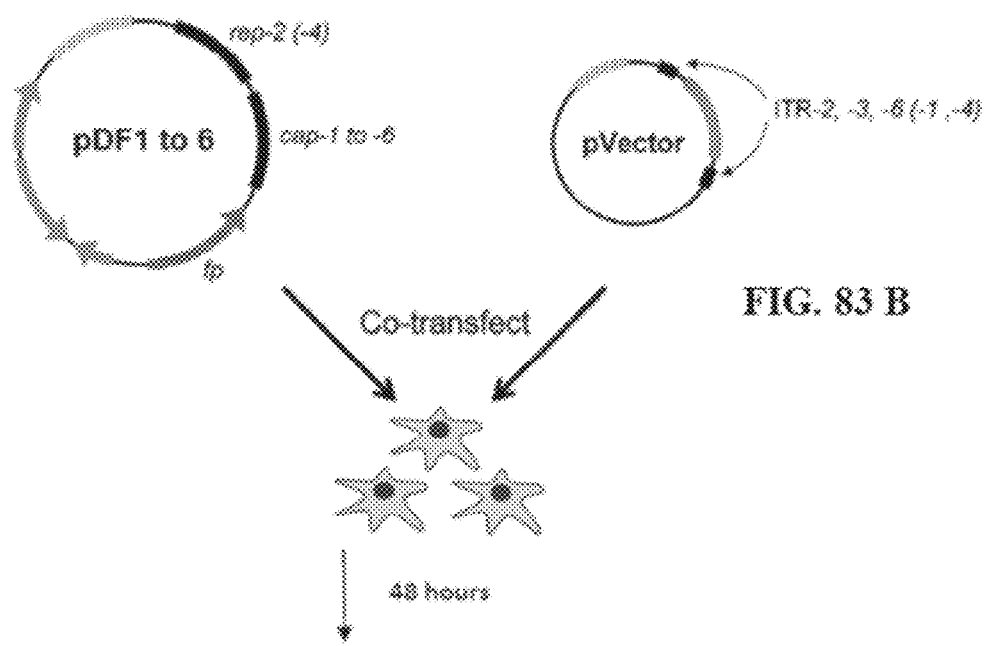
Figure 84:
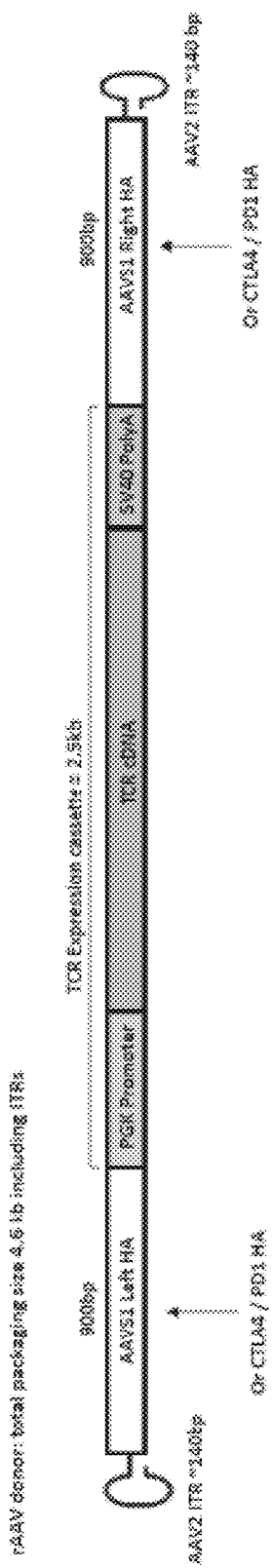
FIG. 84 shows a rAAV donor encoding an exogenous TCR flanked by 900 bp homology arms to an endogenous immune checkpoint (CTLA4 and PD1 are shown as exemplary examples).
Figure 85:
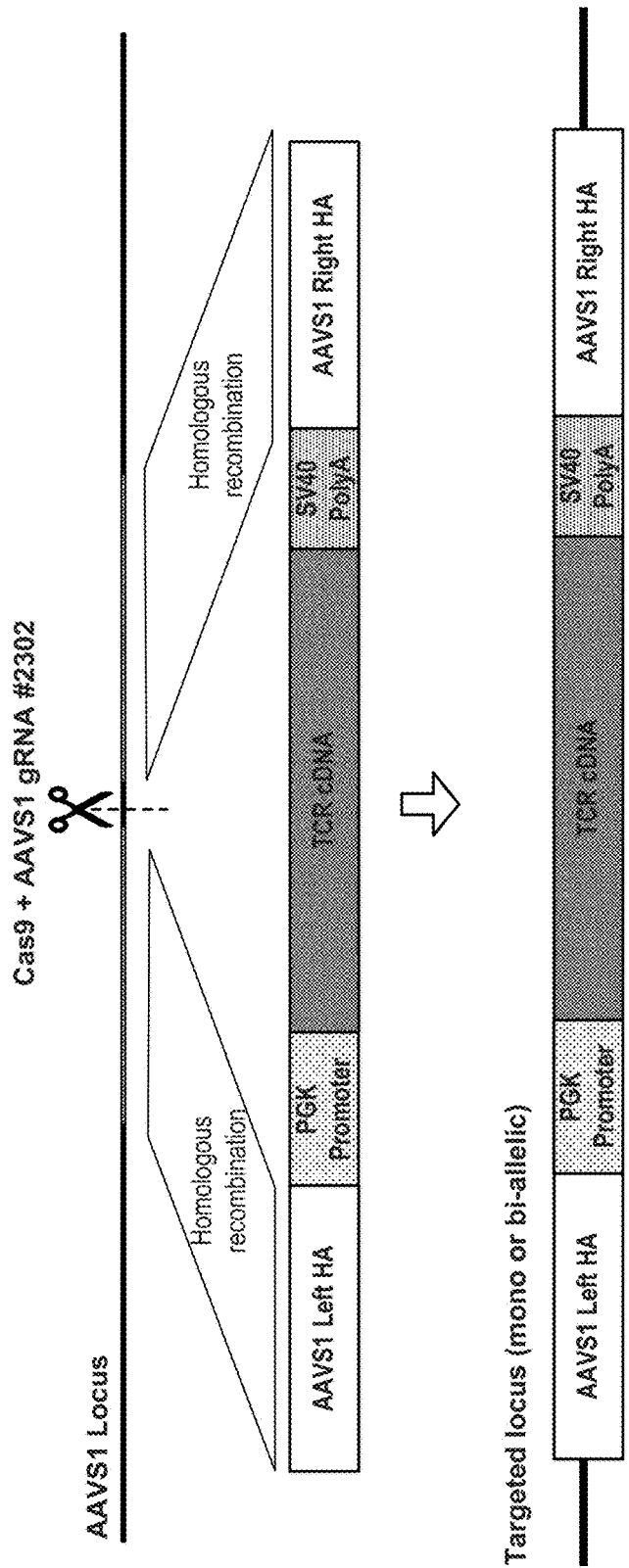
FIG. 85 shows a genomic integration schematic of a rAAV homologous recombination donor encoding an exogenous TCR flanked by homology arms to the AAVS1 gene.

A transgene to be inserted can be flanked by engineered sites analogous to a targeted double strand break site in the genome to excise the transgene from a polynucleic acid so it can be inserted at the double strand break region. A transgene can be virally introduced in some cases. For example, an AAV virus can be utilized to infect a cell with a transgene. In some cases, a modified or engineered AAV virus can be used to introduce a transgene to a cell, FIG. 83 A. and FIG. 83 B. A modified or wildtype AAV can comprise homology arms to at least one genomic location, FIG. 84 to FIG. 86 D.

A RNA encoding a transgene can be introduced into a cell via electroporation. RNA can also be introduced into a cell via lipofection, infection, or transformation. Electroporation and/or lipofection can be used to transfect primary cells. Electroporation and/or lipofection can be used to transfect primary hematopoietic cells. In some cases, RNA can be reverse transcribed within a cell into DNA. A DNA substrate can then be used in a homologous recombination reaction. A DNA can also be introduced into a cell genome without the use of homologous recombination. In some cases, a DNA can be flanked by engineered sites that are complementary to the targeted double strand break region in a genome. In some cases, a DNA can be excised from a polynucleic acid so it can be inserted at a double strand break region without homologous recombination.

Figure 94:
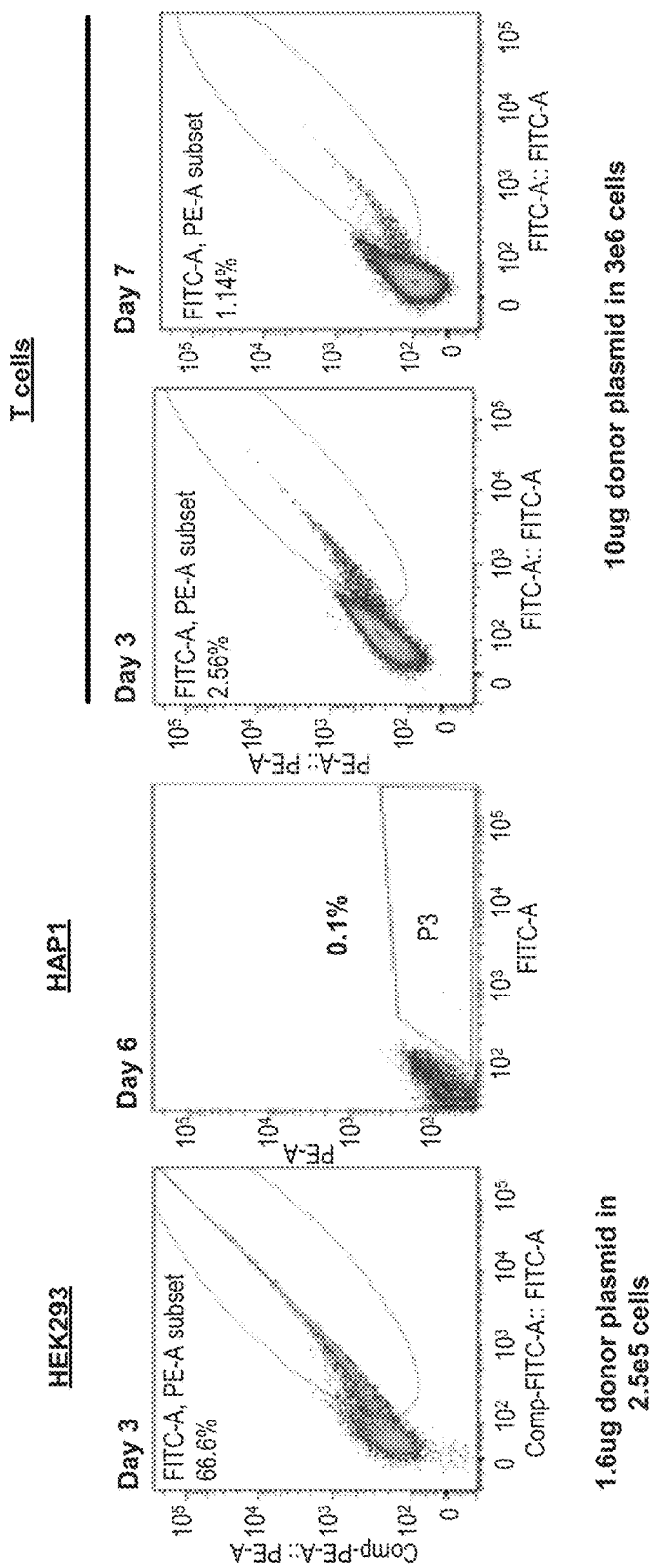
FIG. 94 shows a splice-acceptor GFP reporter assay to rapidly detect integration of an exogenous transgene (e.g., TCR).

Expression of a transgene can be verified by an expression assay, for example, qPCR or by measuring levels of RNA. Expression level can be indicative also of copy number. For example, if expression levels are extremely high, this can indicate that more than one copy of a transgene was integrated in a genome. Alternatively, high expression can indicate that a transgene was integrated in a highly transcribed area, for example, near a highly expressed promoter. Expression can also be verified by measuring protein levels, such as through Western blotting. In some cases, a splice acceptor assay can be used with a reporter system to measure transgene integration, FIG. 94.

b. Site Specific Insertion

Figure 87:
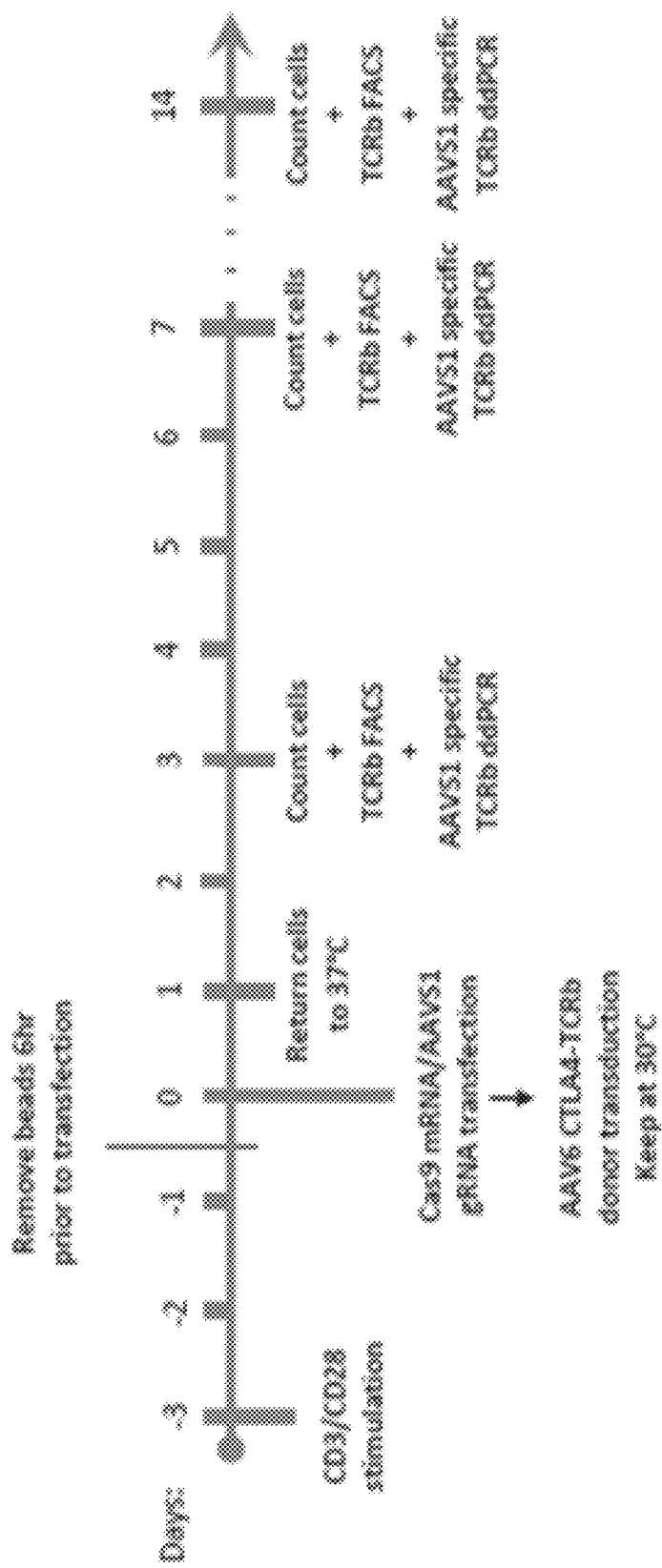
FIG. 87 shows a combined CRISPR and rAAV targeting approach of introducing a transgene encoding an exogenous TCR into an immune checkpoint gene.

Inserting one or more transgenes in any of the methods disclosed herein can be site-specific. For example, one or more transgenes can be inserted adjacent to or near a promoter. In another example, one or more transgenes can be inserted adjacent to, near, or within an exon of a gene (e.g., PD-1 gene). Such insertions can be used to knock-in a transgene (e.g., cancer-specific TCR transgene) while simultaneously disrupting another gene (e.g., PD-1 gene). In another example, one or more transgenes can be inserted adjacent to, near, or within an intron of a gene. A transgene can be introduced by an AAV viral vector and integrate into a targeted genomic location, FIG. 87.

Modification of a targeted locus of a cell can be produced by introducing DNA into cells, where the DNA has homology to the target locus. DNA can include a marker gene, allowing for selection of cells comprising the integrated construct. Complementary DNA in a target vector can recombine with a chromosomal DNA at a target locus. A marker gene can be flanked by complementary DNA sequences, a 3' recombination arm, and a 5' recombination arm. Multiple loci within a cell can be targeted. For example, transgenes with recombination arms specific to 1 or more target loci can be introduced at once such that multiple genomic modifications occur in a single step.

A variety of enzymes can catalyze insertion of foreign DNA into a host genome. For example, site-specific recombinases can be clustered into two protein families with distinct biochemical properties, namely tyrosine recombinases (in which DNA is covalently attached to a tyrosine residue) and serine recombinases (where covalent attachment occurs at a serine residue). In some cases, recombinases can comprise Cre, fC31 integrase (a serine recombinase derived from *Streptomyces* phage fC31), or bacteriophage derived site-specific recombinases (including Flp, lambda integrase, bacteriophage HK022 recombinase, bacteriophage R4 integrase and phage TP901-1 integrase).

Expression control sequences can also be used in constructs. For example, an expression control sequence can comprise a constitutive promoter, which is expressed in a wide variety of cell types. Tissue-specific promoters can also be used and can be used to direct expression to specific cell lineages.

Site specific gene editing can be achieved using non-viral gene editing such as CRISPR, TALEN (see U.S. patent application Ser. No. 14/193,037), transposon-based, ZEN, meganuclease, or Mega-TAL, or Transposon-based system. For example, PiggyBac (see Moriarty, B. S., et al., "Modular assembly of transposon integratable multigene vectors using RecWay assembly," Nucleic Acids Research (8):e92 (2013) or sleeping beauty (see Aronovich, E. L, et al., "The Sleeping Beauty transposon system: a non-viral vector for gene therapy," Hum. Mol. Genet., 20 (R1): R14-R20. (2011) transposon systems can be used.

Site specific gene editing can also be achieved without homologous recombination. An exogenous polynucleic acid can be introduced into a cell genome without the use of homologous recombination. In some cases, a transgene can be flanked by engineered sites that are complementary to a targeted double strand break region in a genome. A transgene can be excised from a polynucleic acid so it can be inserted at a double strand break region without homologous recombination.

c. Transgenes

Transgenes can be useful for expressing, e.g., overexpressing, endogenous genes at higher levels than without a transgenes. Additionally, transgenes can be used to express exogenous genes at a level greater than background, i.e., a cell that has not been transfected with a transgenes. Transgenes can also encompass other types of genes, for example, a dominant negative gene.

Transgenes can be placed into an organism, cell, tissue, or organ, in a manner which produces a product of a transgene. A polynucleic acid can comprise a transgene. A polynucleic acid can encode an exogenous receptor, FIG. 57 A, FIG. 57 B, and FIG. 57 C. For example, disclosed herein is a polynucleic acid comprising at least one exogenous T cell receptor (TCR) sequence flanked by at least two recombination arms having a sequence complementary to polynucleotides within a genomic sequence that is adenosine A2a receptor, CD276, V-set domain containing T cell activation inhibitor 1, B and T lymphocyte associated, cytotoxic T-lymphocyte-associated protein 4, indoleamine 2,3-dioxygenase 1, killer cell immunoglobulin-like receptor, three domains, long cytoplasmic tail, 1, lymphocyte-activation gene 3, programmed cell death 1, hepatitis A virus cellular receptor 2, V-domain immunoglobulin suppressor of T-cell activation, or natural killer cell receptor 2B4. One or more transgenes can be in combination with one or more disruptions.

T Cell Receptor (TCR)

Figure 22:
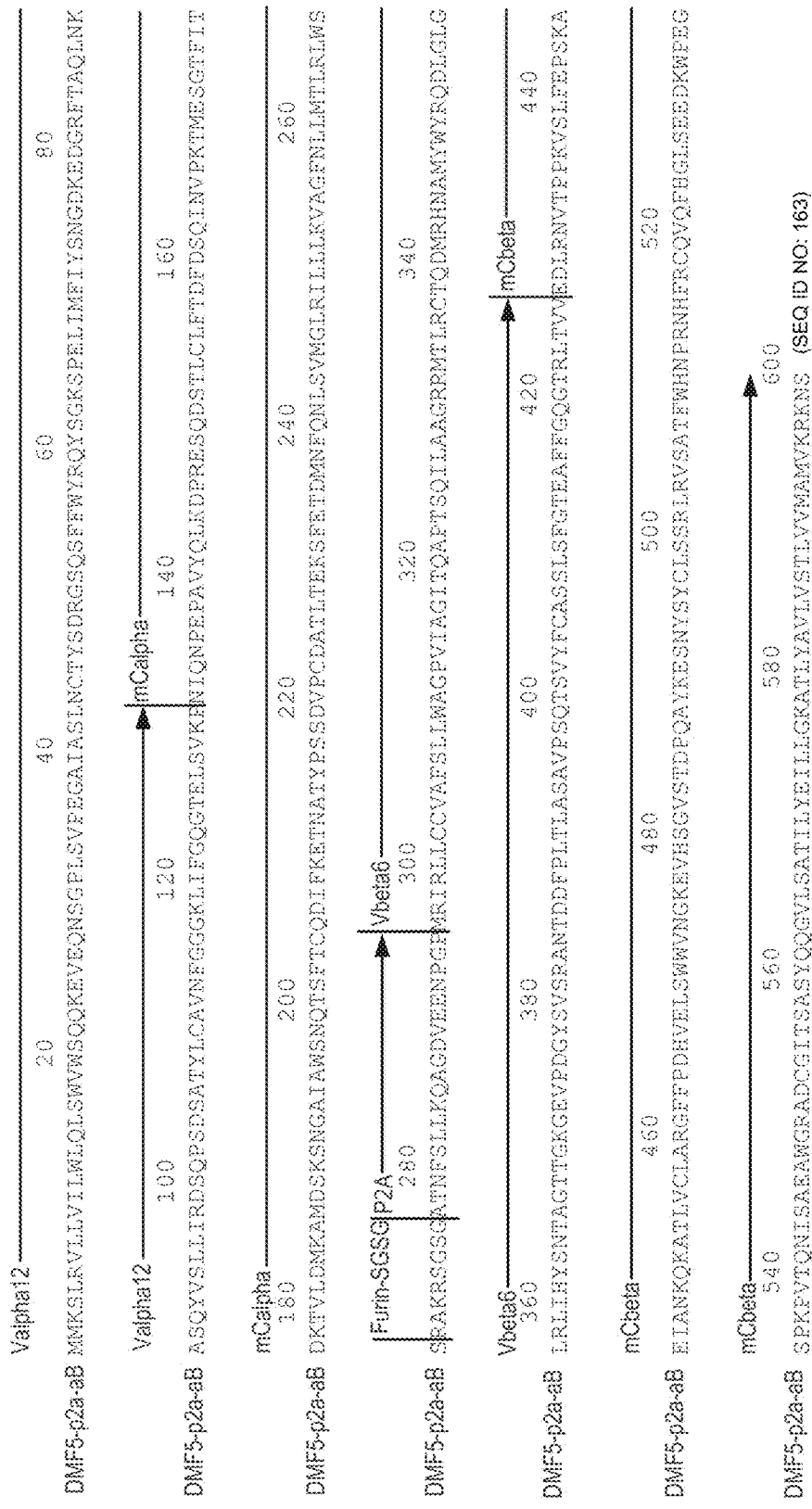
FIG. 22 shows a representative functional engineered TCR antigen receptor. This engineered TCR is highly reactive against MART-1 expressing melanoma tumor cell lines. The TCR α and β chains are linked with a furin cleavage site, followed by a 2A ribosomal skip peptide.
Figure 26:
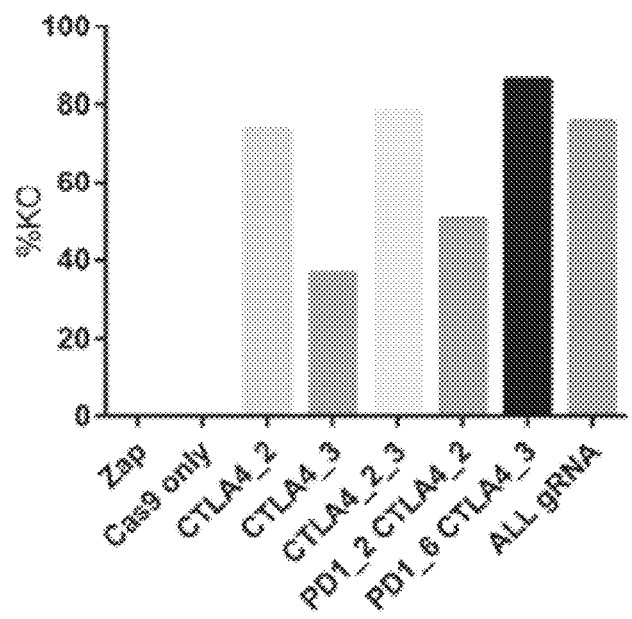
FIG. 26 A and FIG. 26 B show percent double knock out in primary human T cells post treatment with CRISPR.
Figure 26:
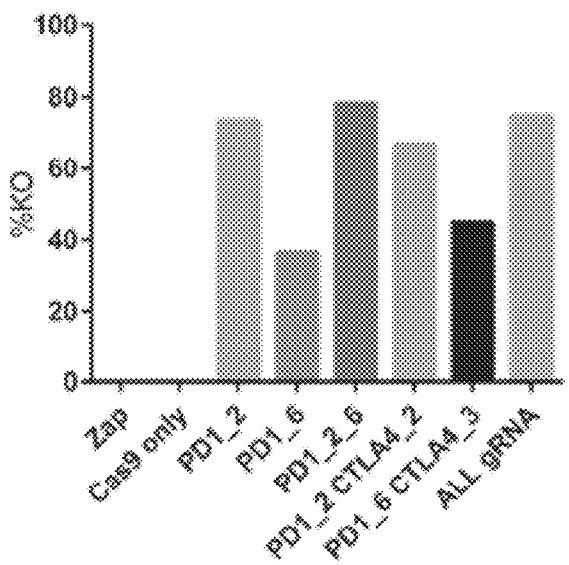
Figure 27:
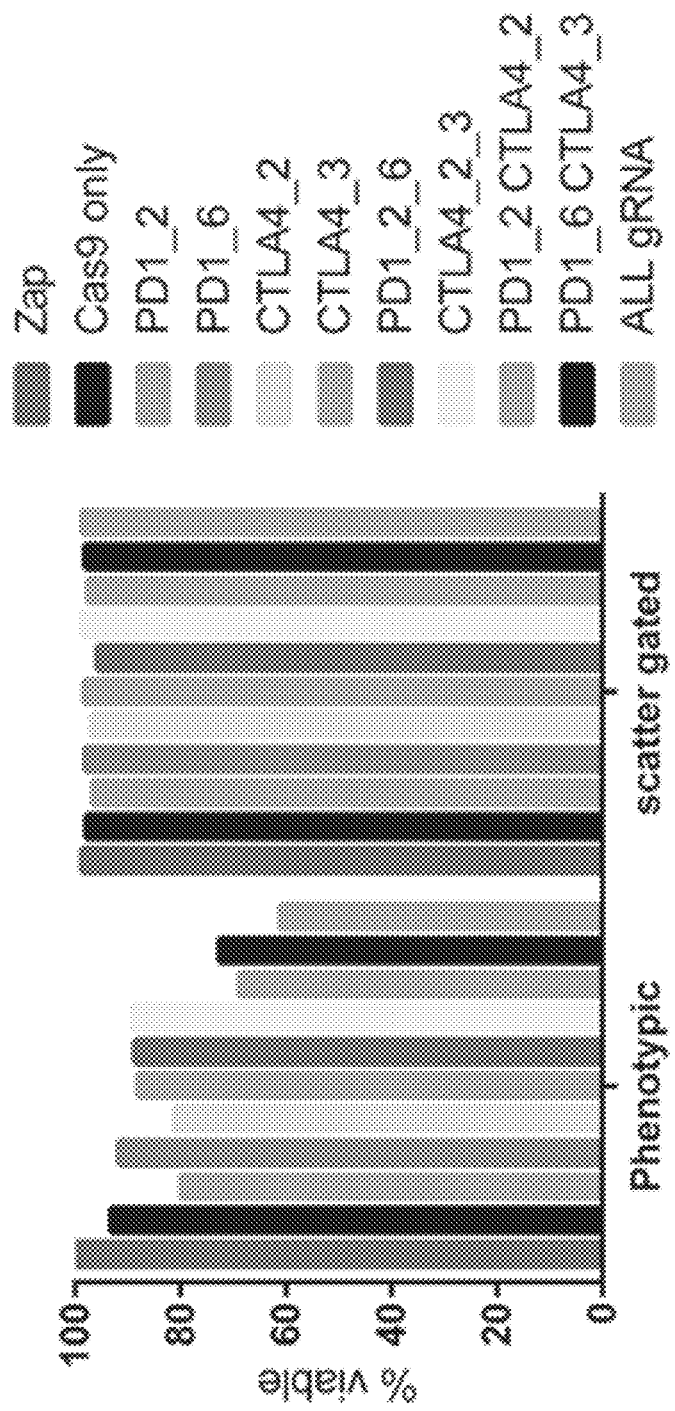
FIG. 27 shows T cell viability post electroporation with CRISPR and guide RNAs specific to CTLA-4, PD-1, or combinations.

A T cell can comprise one or more transgenes. One or more transgenes can express a TCR alpha, beta, gamma, and/or delta chain protein recognizing and binding to at least one epitope (e.g., cancer epitope) on an antigen or bind to a mutated epitope on an antigen. A TCR can bind to a cancer neo-antigen. A TCR can be a functional TCR as shown in FIG. 22 and FIG. 26. A TCR can comprise only one of the alpha chain or beta chain sequences as defined herein (e.g., in combination with a further alpha chain or beta chain, respectively) or may comprise both chains. A TCR can comprise only one of the gamma chain or delta chain sequences as defined herein (e.g., in combination with a further gamma chain or delta chain, respectively) or may comprise both chains. A functional TCR maintains at least substantial biological activity in the fusion protein. In the case of the alpha and/or beta chain of a TCR, this can mean that both chains remain able to form a T cell receptor (either with a non-modified alpha and/or beta chain or with another fusion protein alpha and/or beta chain) which exerts its biological function, in particular binding to the specific peptide-MHC complex of a TCR, and/or functional signal transduction upon peptide activation. In the case of the gamma and/or delta chain of a TCR, this can mean that both chains remain able to form a T cell receptor (either with a non-modified gamma and/or delta chain or with another fusion protein gamma and/or delta chain) which exerts its biological function, in particular binding to the specific peptide-MHC complex of a TCR, and/or functional signal transduction upon peptide activation. A T cell can also comprise one or more TCRs. A T cell can also comprise a single TCRs specific to more than one target.

A TCR can be identified using a variety of methods. In some cases a TCR can be identified using whole-exomic sequencing. For example, a TCR can target an ErbB2 interacting protein (ERBB2IP) antigen containing an E805G mutation identified by whole-exomic sequencing. Alternatively, a TCR can be identified from autologous, allogenic, or xenogeneic repertoires. Autologous and allogeneic identification can entail a multistep process. In both autologous and allogeneic identification, dendritic cells (DCs) can be generated from CD14-selected monocytes and, after maturation, pulsed or transfected with a specific peptide. Peptide-pulsed DCs can be used to stimulate autologous or allogeneic T cells. Single-cell peptide-specific T cell clones can be isolated from these peptide-pulsed T cell lines by limiting dilution. TCRs of interest can be identified and isolated. α and β chains of a TCR of interest can be cloned, codon optimized, and encoded into a vector or transgene. Portions of a TCR can be replaced. For example, constant regions of a human TCR can be replaced with the corresponding murine regions. Replacement of human constant regions with corresponding murine regions can be performed to increase TCR stability. A TCR can also be identified with high or supraphysiologic avidity ex vivo.

To generate a successful tumor-specific TCR, an appropriate target sequence should be identified. The sequence may be found by isolation of a rare tumor-reactive T cell or, where this is not possible, alternative technologies can be employed to generate highly active anti-tumor T-cell antigens. One approach can entail immunizing transgenic mice that express the human leukocyte antigen (HLA) system with human tumor proteins to generate T cells expressing TCRs against human antigens (see e.g., Stanislawski et al., Circumventing tolerance to a human MDM2-derived tumor antigen by TCR gene transfer, Nature Immunology 2, 962-970 (2001)). An alternative approach can be allogeneic TCR gene transfer, in which tumor-specific T cells are isolated from a patient experiencing tumor remission and reactive TCR sequences can be transferred to T cells from another patient who shares the disease but may be non-responsive (de Witte, M. A., et al., Targeting self-antigens through allogeneic TCR gene transfer, Blood 108, 870-877 (2006)). Finally, in vitro technologies can be employed to alter a sequence of a TCR, enhancing their tumor-killing activity by increasing the strength of the interaction (avidity) of a weakly reactive tumor-specific TCR with target antigen (Schmid, D. A., et al., Evidence for a TCR affinity threshold delimiting maximal CD8 T cell function. J. Immunol. 184, 4936-4946 (2010)). Alternatively, a TCR can be identified using whole-exomic sequencing.

The present functional TCR fusion protein can be directed against an MHC-presented epitope. The MHC can be a class I molecule, for example HLA-A. The MHC can be a class II molecule. The present functional TCR fusion protein can also have a peptide-based or peptide-guided function in order to target an antigen. The present functional TCR can be linked, for example, the present functional TCR can be linked with a 2A sequence. The present functional TCR can also be linked with furin-V5-SGSGF2A ("SGSG" disclosed as SEQ ID NO: 162) as shown in FIG. 26. The present functional TCR can also contain mammalian components. For example, the present functional TCR can contain mouse constant regions. The present functional TCR can also in some cases contain human constant regions. The peptide-guided function can in principle be achieved by introducing peptide sequences into a TCR and by targeting tumors with these peptide sequences. These peptides may be derived from phage display or synthetic peptide library (see e.g., Arap, W., et al., "Cancer Treatment by Targeted Drug Delivery to Tumor Vasculature in a Mouse Model," Science, 279, 377-380 (1998); Scott, C. P., et al., "Structural requirements for the biosynthesis of backbone cyclic peptide libraries," 8: 801-815 (2001)). Among others, peptides specific for breast, prostate and colon carcinomas as well as those specific for neo-vasculatures were already successfully isolated and may be used in the present invention (Samoylova, T. I., et al., "Peptide Phage Display: Opportunities for Development of Personalized Anti-Cancer Strategies," Anti-Cancer Agents in Medicinal Chemistry, 6 (1): 9-17 (9) (2006)). The present functional TCR fusion protein can be directed against a mutated cancer epitope or mutated cancer antigen.

Transgenes that can be used and are specifically contemplated can include those genes that exhibit a certain identity and/or homology to genes disclosed herein, for example, a TCR gene. Therefore, it is contemplated that if a gene exhibits at least or at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% homology (at the nucleic acid or protein level), it can be used as a transgene. It is also contemplated that a gene that exhibits at least or at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity (at the nucleic acid or protein level) can be used as a transgene. In some cases, the transgene can be functional.

Transgene can be incorporated into a cell. For example, a transgene can be incorporated into an organism's germ line. When inserted into a cell, a transgene can be either a complementary DNA (cDNA) segment, which is a copy of messenger RNA (mRNA), or a gene itself residing in its original region of genomic DNA (with or without introns). A transgene of protein X can refer to a transgene comprising a nucleotide sequence encoding protein X. As used herein, in some cases, a transgene encoding protein X can be a transgene encoding 100% or about 100% of the amino acid sequence of protein X. In other cases, a transgene encoding protein X can be a transgene encoding at least or at least about 99%, 98%, 97%, 96%, 95%, 94%, 93%, 92%, 91%, 90%, 85%, 80%, 75%, 70%, 65%, 60%, 55%, 50%, 40%, 30%, 20%, 10%, 5%, or 1% of the amino acid sequence of protein X. Expression of a transgene can ultimately result in a functional protein, e.g., a partially, fully, or overly functional protein. As discussed above, if a partial sequence is expressed, the ultimate result can be a nonfunctional protein or a dominant negative protein. A nonfunctional protein or dominant negative protein can also compete with a functional (endogenous or exogenous) protein. A transgene can also encode RNA (e.g., mRNA, shRNA, siRNA, or microRNA). In some cases, where a transgene encodes for an mRNA, this can in turn be translated into a polypeptide (e.g., a protein). Therefore, it is contemplated that a transgene can encode for protein. A transgene can, in some instances, encode a protein or a portion of a protein. Additionally, a protein can have one or more mutations (e.g., deletion, insertion, amino acid replacement, or rearrangement) compared to a wild-type polypeptide. A protein can be a natural polypeptide or an artificial polypeptide (e.g., a recombinant polypeptide). A transgene can encode a fusion protein formed by two or more polypeptides. A T cell can comprise or can comprise about 1, 2, 3, 4, 5, 6, 7, 8, 9, 10, 11, 12, 13, 14, 15, 16, 17, 18, 19, 20, or more transgenes. For example, a T cell can comprise one or more transgene comprising a TCR gene.

Figure 46:
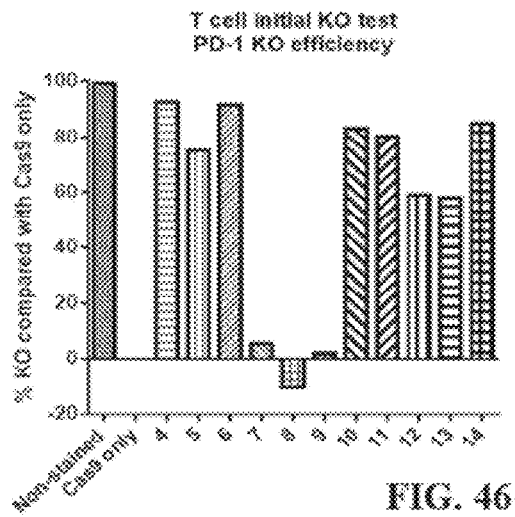
FIG. 46 A shows percent PD-1 expression post transfection with an anti-PD-1 CRISPR system.
Figure 46:
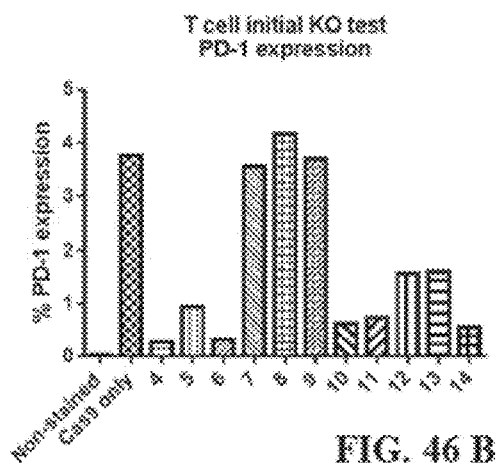
Figure 47:
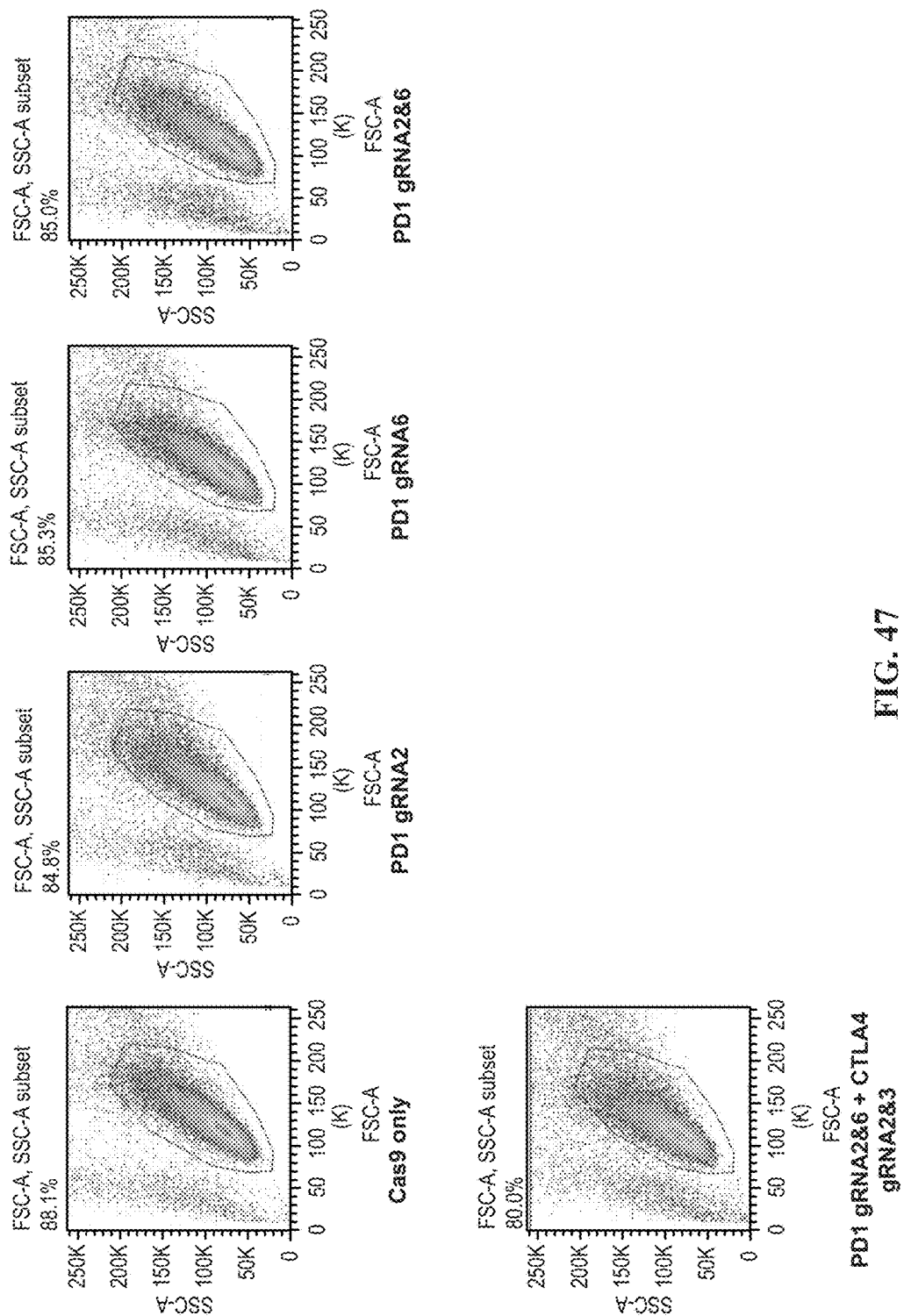
FIG. 47 shows FACs analysis of the FSC/SSC subset of human T cells transfected with CRISPR system with anti-PD-1 guide #2, anti-PD-1 guide #6, anti-PD1 guides #2 and #6, or anti-PD-1 guides #2 and #6 and anti-CTLA-4 guides #2 and #3.
Figure 48:
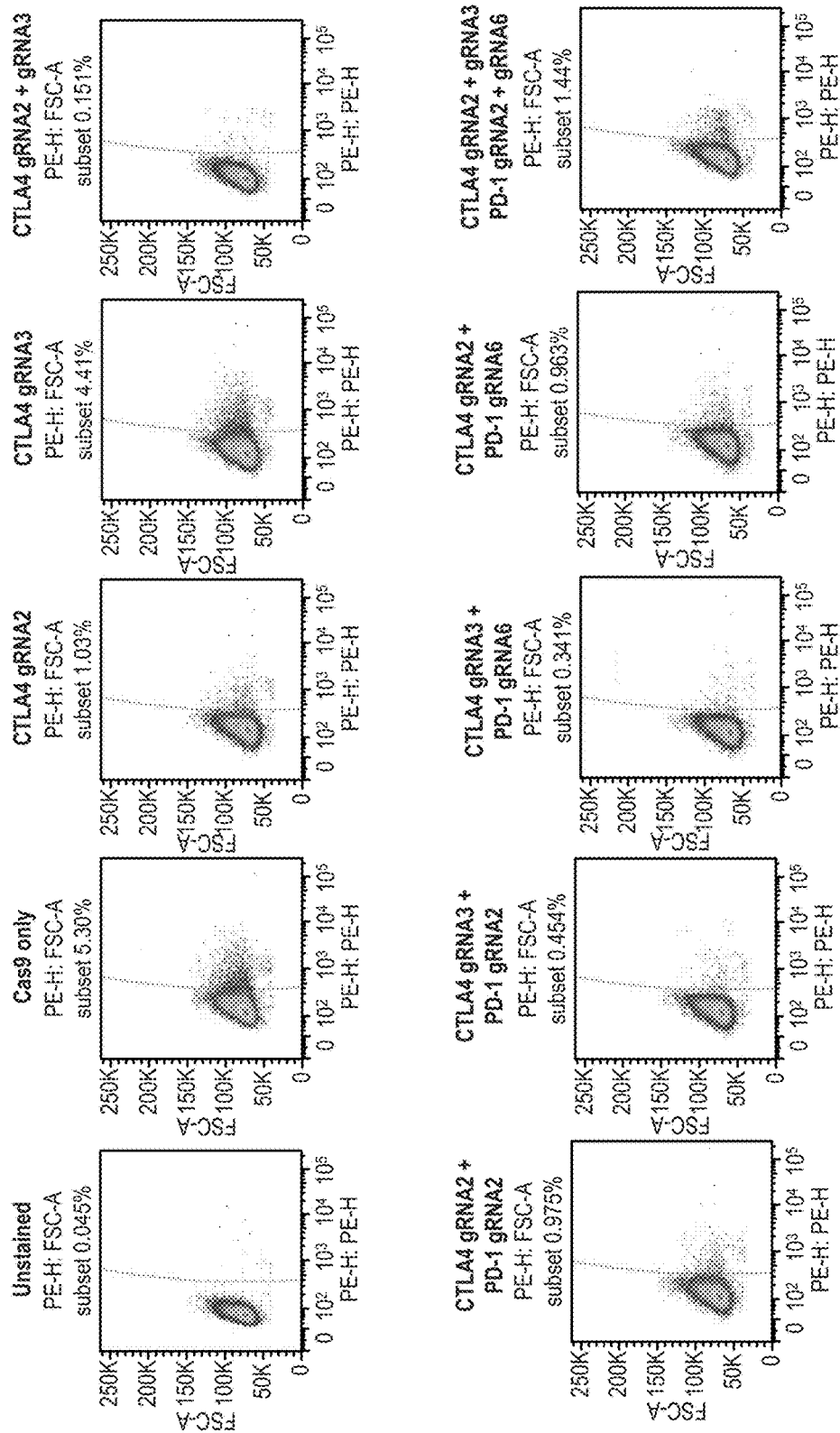
FIG. 48 shows FACs analysis of human T cells on day 6 post transfection with CRISPR and anti-CTLA-4 guide RNAs. PE is mouse anti-human CD152 (CTLA-4).
Figure 49:
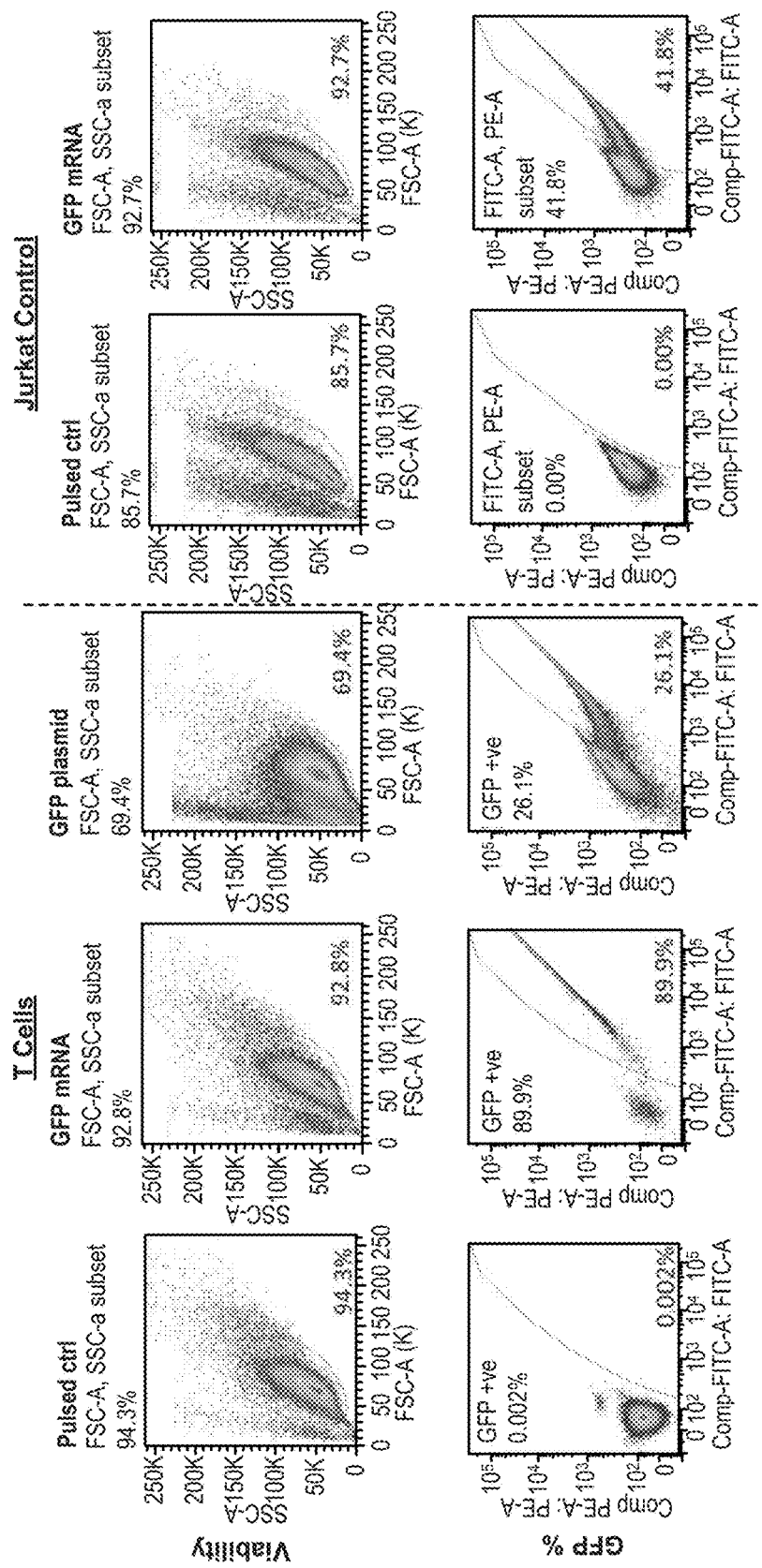
FIG. 49 shows FACs analysis of human T cells and control Jurkat cells on day 1 post transfection with CRISPR and anti-PD-1 and anti-CTLA-4 guide RNAs. Viability and transfection efficiency of human T cells is shown as compared to transfected Jurkat cells.
Figure 50:
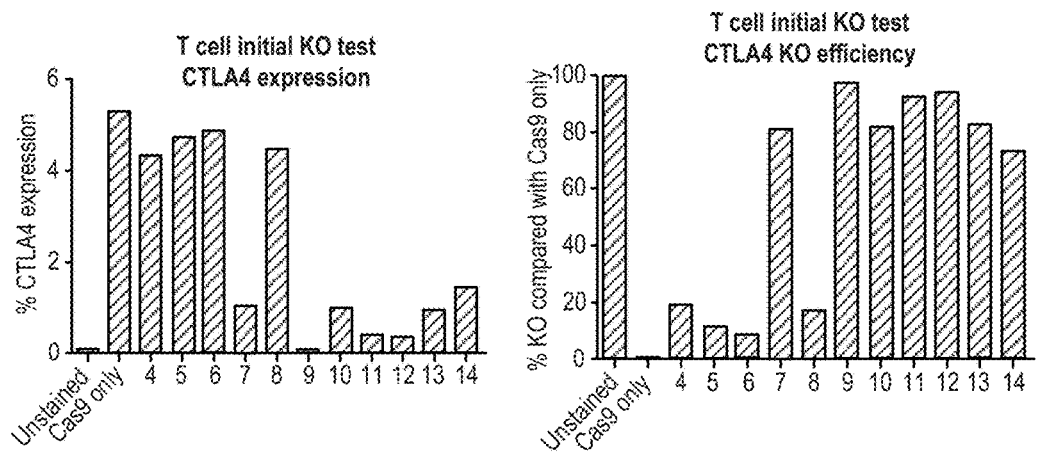
FIG. 50 depicts quantification data from a FACs analysis of CTLA-4 stained human T cells transfected with CRISPR and anti-CTLA-4 guide RNAs. Day 6 post transfection data is shown of percent CTLA-4 expression and percent knock out.
Figure 96:
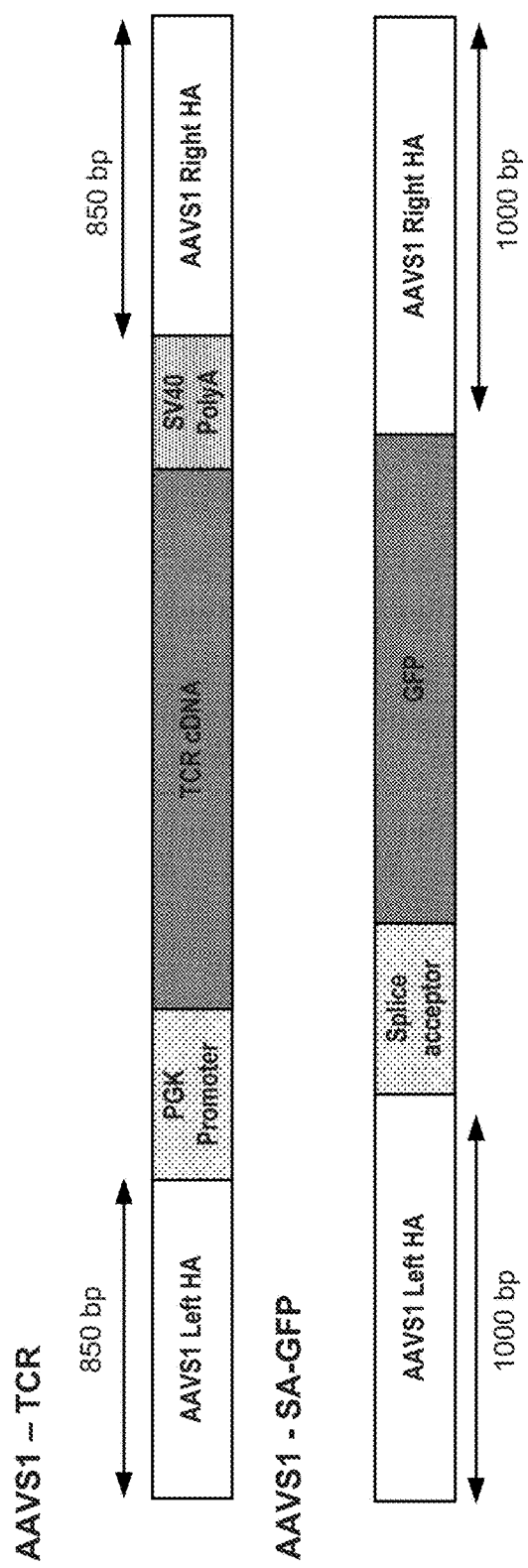
FIG. 96 shows recombinant (rAAV) donor constructs encoding for an exogenous TCR using either a PGK promoter or a splice acceptor. Each construct is flanked by 850 base pair homology arms (HA) to the AAVS1 checkpoint gene.
Figure 97:
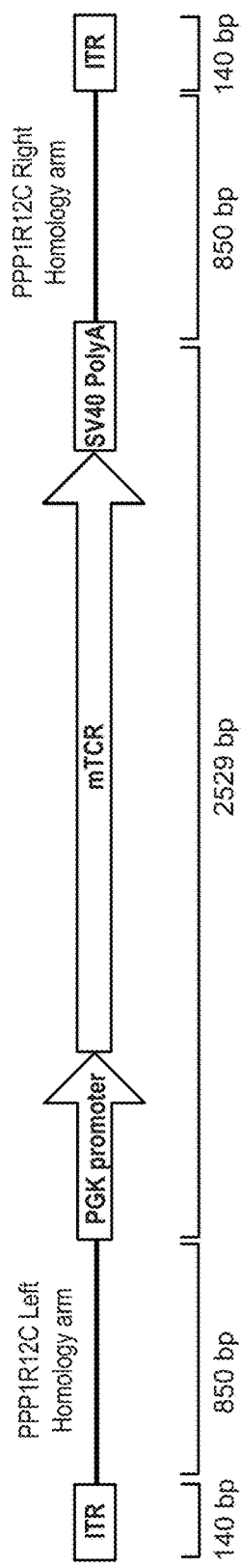
FIG. 97 shows the rAAV AAVS1-TCR gene targeting vector. The schematic depiction of the rAAV targeting vector used to insert the transgenic TCR expression cassette into the AAVS1 "safe-harbour" locus within the intronic region of the PPP1R12C gene. Major features are shown along with their sizes in numbers of nucleotides (bp). ITR: internal tandem repeat; PGK: phosphoglycerate kinase; mTCR: murine T-cell receptor beta; SV40 PolyA: Simian virus 40 polyadenylation signal.

A transgene (e.g., TCR gene) can be inserted in a safe harbor locus. A safe harbor can comprise a genomic location where a transgene can integrate and function without perturbing endogenous activity. For example, one or more transgenes can be inserted into any one of HPRT, AAVS SITE (E.G. AAVS1, AAVS2, ETC.), CCR5, hROSA26, and/or any combination thereof. A transgene (e.g., TCR gene) can also be inserted in an endogenous immune checkpoint gene. An endogenous immune checkpoint gene can be stimulatory checkpoint gene or an inhibitory checkpoint gene. A transgene (e.g., TCR gene) can also be inserted in a stimulatory checkpoint gene such as CD27, CD40, CD122, OX40, GITR, CD137, CD28, or ICOS. Immune checkpoint gene locations are provided using the Genome Reference Consortium Human Build 38 patch release 2 (GRCh38.p2) assembly. A transgene (e.g., TCR gene) can also be inserted in an endogenous inhibitory checkpoint gene such as A2AR, B7-H3, B7-H4, BTLA, CTLA-4, IDO, KIR, LAG3, PD-1, TIM-3, VISTA or CISH. For example, one or more transgene can be inserted into any one of CD27, CD40, CD122, OX40, GITR, CD137, CD28, ICOS, AZAR, B7-H3, B7-H4, BTLA, CTLA-4, IDO, KIR, LAG3, PD-1, TIM-3, VISTA, HPRT, AAVS SITE (E.G. AAVS1, AAVS2, ETC.), PHD1, PHD2, PHD3, CCR5, CISH, PPP1R12C, and/or any combination thereof. A transgene can be inserted in an endogenous TCR gene. A transgene can be inserted within a coding genomic region. A transgene can also be inserted within a noncoding genomic region. A transgene can be inserted into a genome without homologous recombination. Insertion of a transgene can comprise a step of an intracellular genomic transplant. A transgene can be inserted at a PD-1 gene, FIG. 46 A and FIG. 46 B. In some cases, more than one guide can target an immune checkpoint, FIG. 47. In other cases, a transgene can be integrated at a CTLA-4 gene, FIG. 48 and FIG. 50. In other cases, a transgene can be integrated at a CTLA-4 gene and a PD-1 gene, FIG. 49. A transgene can also be integrated into a safe harbor such as AAVS1, FIG. 96 and FIG. 97. A transgene can be inserted into an AAV integration site. An AAV integration site can be a safe harbor in some cases. Alternative AAV integration sites may exist, such as AAVS2 on chromosome 5 or AAVS3 on chromosome 3. Additional AAV integration sites such as AAVS 2, AAVS3, AAVS4, AAVS5, AAVS6, AAVS7, AAVS8, and the like are also considered to be possible integration sites for an exogenous receptor, such as a TCR. As used herein, AAVS can refer to AAVS1 as well as related adeno-associated virus (AAVS) integration sites.

A chimeric antigen receptor can be comprised of an extracellular antigen recognition domain, a transmembrane domain, and a signaling region that controls T cell activation. The extracellular antigen recognition domain can be derived from a murine, a humanized or fully human monoclonal antibody. Specifically, the extracellular antigen recognition domain is comprised of the variable regions of the heavy and light chains of a monoclonal antibody that is cloned in the form of single-chain variable fragments (scFv) and joined through a hinge and a transmembrane domain to an intracellular signaling molecule of the T-cell receptor (TCR) complex and at least one co-stimulatory molecule. In some cases a co-stimulatory domain is not used.

A CAR of the present disclosure can be present in the plasma membrane of a eukaryotic cell, e.g., a mammalian cell, where suitable mammalian cells include, but are not limited to, a cytotoxic cell, a T lymphocyte, a stem cell, a progeny of a stem cell, a progenitor cell, a progeny of a progenitor cell, and an NK cell. When present in the plasma membrane of a eukaryotic cell, a CAR can be active in the presence of its binding target. A target can be expressed on a membrane. A target can also be soluble (e.g., not bound to a cell). A target can be present on the surface of a cell such as a target cell. A target can be presented on a solid surface such as a lipid bilayer; and the like. A target can be soluble, such as a soluble antigen. A target can be an antigen. An antigen can be present on the surface of a cell such as a target cell. An antigen can be presented on a solid surface such as a lipid bilayer; and the like. In some cases, a target can be an epitope of an antigen. In some cases a target can be a cancer neo-antigen.

Some recent advances have focused on identifying tumor-specific mutations that in some cases trigger an antitumor T cell response. For example, these endogenous mutations can be identified using a whole-exomic-sequencing approach. Tran E, et al., "Cancer immunotherapy based on mutation-specific CD4+ T cells in a patient with epithelial cancer," Science 344: 641-644 (2014). Therefore, a CAR can be comprised of a scFv targeting a tumor-specific neo-antigen.

A method can identify a cancer-related target sequence from a sample obtained from a cancer patient using an in vitro assay (e.g. whole-exomic sequencing). A method can further identify a TCR transgene from a first T cell that recognizes the target sequence. A cancer-related target sequence and a TCR transgene can be obtained from samples of the same patient or different patients. A cancer-related target sequence can be encoded on a CAR transgene to render a CAR specific to a target sequence. A method can effectively deliver a nucleic acid comprising a CAR transgene across a membrane of a T cell. In some instances, the first and second T cells can be obtained from the same patient. In other instances, the first and second T cells can be obtained from different patients. In other instances, the first and second T cells can be obtained from different patients. The method can safely and efficiently integrate a CAR transgene into the genome of a T cell using a non-viral integration or a viral integration system to generate an engineered T cell and thus, a CAR transgene can be reliably expressed in the engineered T cell A T cell can comprise one or more disrupted genes and one or more transgenes. For example, one or more genes whose expression is disrupted can comprise any one of CD27, CD40, CD122, OX40, GITR, CD137, CD28, ICOS, A2AR, B7-H3, B7-H4, BTLA, CTLA-4, TDO, KIR, LAG3, PD-1, TIM-3, PHD1, PHD2, PHD3, VISTA, CISH, PPP1R12C, and/or any combination thereof. For example, solely to illustrate various combinations, one or more genes whose expression is disrupted can comprise PD-land one or more transgenes comprise TCR. In another example, one or more genes whose expression is disrupted can also comprise CTLA-4, and one or more transgenes comprise TCR.

A T cell can comprise one or more suppressed genes and one or more transgenes. For example, one or more genes whose expression is suppressed can comprise any one of CD27, CD40, CD122, OX40, GITR, CD137, CD28, ICOS, A2AR, B7-H3, B7-H4, BTLA, CTLA-4, IDO, KIR, LAG3, PD-1, TIM-3, PHD1, PHD2, PHD3, VISTA, CISH, PPP1R12C, and/or any combination thereof. For example, solely to illustrate various combinations, one or more genes whose expression is suppressed can comprise PD-1 and one or more transgenes comprise TCR. In another example, one or more genes whose expression is suppressed can also comprise CTLA-4, and one or more transgenes comprise TCR.

A T cell can also comprise or can comprise about 1, 2, 3, 4, 5, 6, 7, 8, 9, 10, 11, 12, 13, 14, 15, 16, 17, 18, 19, 20, or more dominant negative transgenes. Expression of a dominant negative transgenes can suppress expression and/or function of a wild type counterpart of the dominant negative transgene. Thus, for example, a T cell comprising a dominant negative transgene X can have similar phenotypes compared to a different T cell comprising an X gene whose expression is suppressed. One or more dominant negative transgenes can be dominant negative CD27, dominant negative CD40, dominant negative CD122, dominant negative OX40, dominant negative GITR, dominant negative CD137, dominant negative CD28, dominant negative ICOS, dominant negative A2AR, dominant negative B7-H3, dominant negative B7-H4, dominant negative BTLA, dominant negative CTLA-4, dominant negative IDO, dominant negative KIR, dominant negative LAG3, dominant negative PD-1, dominant negative TIM-3, dominant negative VISTA, dominant negative PHD1, dominant negative PHD2, dominant negative PHD3, dominant negative CISH, dominant negative CCR5, dominant negative HPRT, dominant negative AAVS SITE (E.G. AAVS1, AAVS2, ETC.), dominant negative PPP1R12C, or any combination thereof.

Also provided is a T cell comprising one or more transgenes that encodes one or more nucleic acids that can suppress genetic expression, e.g., can knockdown a gene. RNAs that suppress genetic expression can comprise, but are not limited to, shRNA, siRNA, RNAi, and microRNA. For example, siRNA, RNAi, and/or microRNA can be delivered to a T cell to suppress genetic expression. Further, a T cell can comprise one or more transgene encoding shRNAs. shRNA can be specific to a particular gene. For example, a shRNA can be specific to any gene described in the application, including but not limited to, CD27, CD40, CD122, OX40, GITR, CD137, CD28, ICOS, A2AR, B7-H3, B7-H4, BTLA, CTLA-4, IDO, KIR, LAG3, PD-1, TIM-3, VISTA, HPRT, AAVS SITE (E.G. AAVS1, AAVS2, ETC.), PHD1, PHD2, PHD3, CCR5, CISH, PPP1R12C, and/or any combination thereof.

One or more transgenes can be from different species. For example, one or more transgenes can comprise a human gene, a mouse gene, a rat gene, a pig gene, a bovine gene, a dog gene, a cat gene, a monkey gene, a chimpanzee gene, or any combination thereof. For example, a transgene can be from a human, having a human genetic sequence. One or more transgenes can comprise human genes. In some cases, one or more transgenes are not adenoviral genes.

A transgene can be inserted into a genome of a T cell in a random or site-specific manner, as described above. For example, a transgene can be inserted to a random locus in a genome of a T cell. These transgenes can be functional, e.g., fully functional if inserted anywhere in a genome. For instance, a transgene can encode its own promoter or can be inserted into a position where it is under the control of an endogenous promoter. Alternatively, a transgene can be inserted into a gene, such as an intron of a gene or an exon of a gene, a promoter, or a non-coding region. A transgene can be inserted such that the insertion disrupts a gene, e.g., an endogenous checkpoint. A transgene insertion can comprise an endogenous checkpoint region. A transgene insertion can be guided by recombination arms that can flank a transgene.

Sometimes, more than one copy of a transgene can be inserted into more than a random locus in a genome. For example, multiple copies can be inserted into a random locus in a genome. This can lead to increased overall expression than if a transgene was randomly inserted once. Alternatively, a copy of a transgene can be inserted into a gene, and another copy of a transgene can be inserted into a different gene. A transgene can be targeted so that it could be inserted to a specific locus in a genome of a T cell.

Expression of a transgene can be controlled by one or more promoters. A promoter can be a ubiquitous, constitutive (unregulated promoter that allows for continual transcription of an associated gene), tissue-specific promoter or an inducible promoter. Expression of a transgene that is inserted adjacent to or near a promoter can be regulated. For example, a transgene can be inserted near or next to a ubiquitous promoter. Some ubiquitous promoters can be a CAGGS promoter, an hCMV promoter, a PGK promoter, an SV40 promoter, or a ROSA26 promoter.

A promoter can be endogenous or exogenous. For example, one or more transgenes can be inserted adjacent or near to an endogenous or exogenous ROSA26 promoter. Further, a promoter can be specific to a T cell. For example, one or more transgenes can be inserted adjacent or near to a porcine ROSA26 promoter.

Tissue specific promoter or cell-specific promoters can be used to control the location of expression. For example, one or more transgenes can be inserted adjacent or near to a tissue-specific promoter. Tissue-specific promoters can be a FABP promoter, a Lck promoter, a CamKII promoter, a CD19 promoter, a Keratin promoter, an Albumin promoter, an aP2 promoter, an insulin promoter, an MCK promoter, an MyHC promoter, a WAP promoter, or a Col2A promoter.

Tissue specific promoter or cell-specific promoters can be used to control the location of expression. For example, one or more transgenes can be inserted adjacent or near to a tissue-specific promoter. Tissue-specific promoters can be a FABP promoter, an Lck promoter, a CamKII promoter, a CD19 promoter, a Keratin promoter, an Albumin promoter, an aP2 promoter, an insulin promoter, an MCK promoter, a MyHC promoter, a WAP promoter, or a Col2A promoter.

Inducible promoters can be used as well. These inducible promoters can be turned on and off when desired, by adding or removing an inducing agent. It is contemplated that an inducible promoter can be, but is not limited to, a Lac, tac, trc, trp, araBAD, phoA, recA, proU, cst-1, tetA, cadA, nar, PL, cspA, T7, VHB, Mx, and/or Trex.

A cell can be engineered to knock out endogenous genes. Endogenous genes that can be knocked out can comprise immune checkpoint genes. An immune checkpoint gene can be stimulatory checkpoint gene or an inhibitory checkpoint gene. Immune checkpoint gene locations can be provided using the Genome Reference Consortium Human Build 38 patch release 2 (GRCh38.p2) assembly.

A gene to be knocked out can be selected using a database. In some cases, certain endogenous genes are more amendable to genomic engineering. A database can comprise epigenetically permissive target sites. A database can be ENCODE (encyclopedia of DNA Elements) (world wide web address genome.gov/10005107) in some cases. A database can identify regions with open chromatin that can be more permissive to genomic engineering.

A T cell can comprise one or more disrupted genes. For example, one or more genes whose expression is disrupted can comprise any one of adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS SITE (E.G. AAVS1, AAVS2, ETC.)), or chemokine (C—C motif) receptor 5 (gene/pseudogene) (CCR5), CD160 molecule (CD160), T-cell immunoreceptor with Ig and ITIM domains (TIGIT), CD96 molecule (CD96), cytotoxic and regulatory T-cell molecule (CRTAM), leukocyte associated immunoglobulin like receptor 1 (LAIR1), sialic acid binding Ig like lectin 7 (SIGLEC7), sialic acid binding Ig like lectin 9 (SIGLEC9), tumor necrosis factor receptor superfamily member 10b (TNFRSF10B), tumor necrosis factor receptor superfamily member 10a (TNFRSF10A), caspase 8 (CASP8), caspase 10 (CASP10), caspase 3 (CASP3), caspase 6 (CASP6), caspase 7 (CASP7), Fas associated via death domain (FADD), Fas cell surface death receptor (FAS), transforming growth factor beta receptor II (TGFBRII), transforming growth factor beta receptor I (TGFBR1), SMAD family member 2 (SMAD2), SMAD family member 3 (SMAD3), SMAD family member 4 (SMAD4), SKI proto-oncogene (SKI), SKI-like proto-oncogene (SKIL), TGFB induced factor homeobox 1 (TGIF1), interleukin 10 receptor subunit alpha (IL10RA), interleukin 10 receptor subunit beta (IL10RB), heme oxygenase 2 (HMOX2), interleukin 6 receptor (IL6R), interleukin 6 signal transducer (IL6ST), c-src tyrosine kinase (CSK), phosphoprotein membrane anchor with glycosphingolipid microdomains 1 (PAG1), signaling threshold regulating transmembrane adaptor 1 (SIT1), forkhead box P3 (FOXP3), PR domain 1 (PRDM1), basic leucine zipper transcription factor, ATF-like (BATF), guanylate cyclase 1, soluble, alpha 2 (GUCY1A2), guanylate cyclase 1, soluble, alpha 3 (GUCY1A3), guanylate cyclase 1, soluble, beta 2 (GUCY1B2), guanylate cyclase 1, soluble, beta 3 (GUCY1B3), cytokine inducible SH2-containing protein (CISH), prolyl hydroxylase domain (PHD1, PHD2, PHD3) family of proteins, or any combination thereof. In some cases an endogenous TCR can also be knocked out. For example, solely to illustrate various combinations, one or more genes whose expression is disrupted can comprise PD-1, CLTA-4, and CISH.

A T cell can comprise one or more suppressed genes. For example, one or more genes whose expression is suppressed can comprise any one of adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS SITE (E.G. AAVS1, AAVS2, ETC.)), or chemokine (C—C motif) receptor 5 (gene/pseudogene) (CCR5), CD160 molecule (CD160), T-cell immunoreceptor with Ig and ITIM domains (TIGIT), CD96 molecule (CD96), cytotoxic and regulatory T-cell molecule (CRTAM), leukocyte associated immunoglobulin like receptor 1 (LAIR1), sialic acid binding Ig like lectin 7 (SIGLEC7), sialic acid binding Ig like lectin 9 (SIGLEC9), tumor necrosis factor receptor superfamily member 10b (TNFRSF10B), tumor necrosis factor receptor superfamily member 10a (TNFRSF10A), caspase 8 (CASP8), caspase 10 (CASP10), caspase 3 (CASP3), caspase 6 (CASP6), caspase 7 (CASP7), Fas associated via death domain (FADD), Fas cell surface death receptor (FAS), transforming growth factor beta receptor II (TGF-BRII), transforming growth factor beta receptor I (TGFBR1), SMAD family member 2 (SMAD2), SMAD family member 3 (SMAD3), SMAD family member 4 (SMAD4), SKI proto-oncogene (SKI), SKI-like proto-oncogene (SKIL), TGFB induced factor homeobox 1 (TGIF1), interleukin 10 receptor subunit alpha (IL10RA), interleukin 10 receptor subunit beta (IL10RB), heme oxygenase 2 (HMOX2), interleukin 6 receptor (IL6R), interleukin 6 signal transducer (IL6ST), c-src tyrosine kinase (CSK), phosphoprotein membrane anchor with glycosphingolipid microdomains 1 (PAG1), signaling threshold regulating transmembrane adaptor 1 (SIT1), forkhead box P3 (FOXP3), PR domain 1 (PRDM1), basic leucine zipper transcription factor, ATF-like (BATF), guanylate cyclase 1, soluble, alpha 2 (GUCY1A2), guanylate cyclase 1, soluble, alpha 3 (GUCY1A3), guanylate cyclase 1, soluble, beta 2 (GUCY1B2), guanylate cyclase 1, soluble, beta 3 (GUCY1B3), prolyl hydroxylase domain (PHD1, PHD2, PHD3) family of proteins, cytokine inducible SH2-containing protein (CISH), or any combination thereof. For example, solely to illustrate various combinations, one or more genes whose expression is suppressed can comprise PD-1, CLTA-4, and CISH.

d. Cancer Target

An engineered cell can target an antigen. An engineered cell can also target an epitope. An antigen can be a tumor cell antigen. An epitope can be a tumor cell epitope. Such a tumor cell epitope may be derived from a wide variety of tumor antigens such as antigens from tumors resulting from mutations (neo antigens or neo epitopes), shared tumor specific antigens, differentiation antigens, and antigens overexpressed in tumors. Those antigens, for example, may be derived from alpha-actinin-4, ARTC1, BCR-ABL fusion protein (b3a2), B-RAF, CASP-5, CASP-8, beta-catenin, Cdc27, CDK4, CDKN2A, COA-1, dek-can fusion protein, EFTUD2, Elongation factor 2, ETV6-AML1 fusion protein, FLT3-ITD, FN1, GPNMB, LDLR-fucosyltransferase fusion protein, HLA-A2d, HLA-Al ld, hsp70-2, KIAAO205, MART2, ME1, MUM-1f, MUM-2, MUM-3, neo-PAP, Myosin class I, NFYC, OGT, OS-9, p53, pml-RARalpha fusion protein, PRDX5, PTPRK, K-ras, N-ras, RBAF600, SIRT2, SNRPD1, SYT-SSX1- or -SSX2 fusion protein, TGF-betaRII, triosephosphate isomerase, BAGE-1, GAGE-1, 2, 8, Gage 3, 4, 5, 6, 7, GnTVf, HERV-K-MEL, KK-LC-1, KM-HN-1, LAGE-1, MAGE-A1, MAGE-A2, MAGE-A3, MAGE-A4, MAGE-A6, MAGE-A9, MAGE-A10, MAGE-Al2, MAGE-C2, mucink, NA-88, NY-ESO-1/LAGE-2, SAGE, Sp17, SSX-2, SSX-4, TAG-1, TAG-2, TRAG-3, TRP2-INT2g, XAGE-1b, CEA, gp100/Pmel17, Kallikrein 4, mammaglobin-A, Melan-A/MART-1, NY-BR-1, OA1, PSA, RAB38/NY-MEL-1, TRP-1/gp75, TRP-2, tyrosinase, adipophilin, AIM-2, ALDH1A1, BCLX (L), BCMA, BING-4, CPSF, cyclin D1, DKK1, ENAH (hMena), EP-CAM, EphA3, EZH2, FGF5, G250/MN/CAIX, HER-2/neu, IL13Ralpha2, intestinal carboxyl esterase, alpha fetoprotein, M-CSFT, MCSP, mdm-2, MMP-2, MUC1, p53, PBF, PRAME, PSMA, RAGE-1, RGS5, RNF43, RU2AS, secernin 1, SOX10, STEAP1, survivin, Telomerase, VEGF, and/or WT1, just to name a few. Tumor-associated antigens may be antigens not normally expressed by the host; they can be mutated, truncated, misfolded, or otherwise abnormal manifestations of molecules normally expressed by the host; they can be identical to molecules normally expressed but expressed at abnormally high levels; or they can be expressed in a context or environment that is abnormal. Tumor-associated antigens may be, for example, proteins or protein fragments, complex carbohydrates, gangliosides, haptens, nucleic acids, other biological molecules or any combinations thereof.

In some cases, a target is a neo antigen or neo epitope. For example, a neo antigen can be a E805G mutation in ERBB2IP. Neo antigen and neo epitopes can be identified by whole-exome sequencing in some cases. A neo antigen and neo epitope target can be expressed by a gastrointestinal cancer cell in some cases. A neo antigen and neo epitope can be expressed on an epithelial carcinoma.

e. Other Targets

An epitope can be a stromal epitope. Such an epitope can be on the stroma of the tumor microenvironment. The antigen can be a stromal antigen. Such an antigen can be on the stroma of the tumor microenvironment. Those antigens and those epitopes, for example, can be present on tumor endothelial cells, tumor vasculature, tumor fibroblasts, tumor pericytes, tumor stroma, and/or tumor mesenchymal cells, just to name a few. Those antigens, for example, can comprise CD34, MCSP, FAP, CD31, PCNA, CD117, CD40, MMP4, and/or Tenascin.

f. Disruption of Genes

The insertion of transgene can be done with or without the disruption of a gene. A transgene can be inserted adjacent to, near, or within a gene such as CD27, CD40, CD122, OX40, GITR, CD137, CD28, ICOS, A2AR, B7-H3, B7-H4, BTLA, CTLA-4, IDO, KIR, LAG3, PD-1, TIM-3, VISTA, HPRT, AAVS SITE (E.G. AAVS1, AAVS2, ETC.), CCR5, PPP1R12C, or CISH to reduce or eliminate the activity or expression of the gene. For example, a cancer-specific TCR transgene can be inserted adjacent to, near, or within a gene (e.g., PD-1) to reduce or eliminate the activity or expression of the gene. The insertion of a transgene can be done at an endogenous TCR gene.

The disruption of genes can be of any particular gene. It is contemplated that genetic homologues (e.g., any mammalian version of the gene) of the genes within this applications are covered. For example, genes that are disrupted can exhibit a certain identity and/or homology to genes disclosed herein, e.g., CD27, CD40, CD122, OX40, GITR, CD137, CD28, ICOS, A2AR, B7-H3, B7-H4, BTLA, CTLA-4, IDO, KIR, LAG3, PD-1, TIM-3, VISTA, HPRT, CCR5, AAVS SITE (E.G. AAVS1, AAVS2, ETC.), PPP1R12C, or CISH. Therefore, it is contemplated that a gene that exhibits or exhibits about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% homology (at the nucleic acid or protein level) can be disrupted. It is also contemplated that a gene that exhibits or exhibits about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity (at the nucleic acid or protein level) can be disrupted. Some genetic homologues are known in the art, however, in some cases, homologues are unknown. However, homologous genes between mammals can be found by comparing nucleic acid (DNA or RNA) sequences or protein sequences using publically available databases such as NCBI BLAST.

A gene that can be disrupted can be a member of a family of genes. For example, a gene that can be disrupted can improve therapeutic potential of cancer immunotherapy. In some instances, a gene can be CISH. A CISH gene can be a member of a cytokine-induced STAT inhibitor (CIS), also known as suppressor of cytokine signaling (SOCS) or STAT-induced STAT inhibitor (SSI), protein family (see e.g., Palmer et al., Cish actively silences TCR signaling in CD8+ T cells to maintain tumor tolerance, The Journal of Experimental Medicine 202 (12), 2095-2113 (2015)). A gene can be part of a SOCS family of proteins that can form part of a classical negative feedback system that can regulate cytokine signal transduction. A gene to be disrupted can be CISH. CISH can be involved in negative regulation of cytokines that signal through the JAK-STAT5 pathway such as erythropoietin, prolactin or interleukin 3 (IL-3) receptor. A gene can inhibit STAT5 trans-activation by suppressing its tyrosine phosphorylation. CISH family members are known to be cytokine-inducible negative regulators of cytokine signaling. Expression of a gene can be induced by IL2, IL3, GM-CSF or EPO in hematopoietic cells. Proteasome-mediated degradation of a gene protein can be involved in the inactivation of an erythropoietin receptor. In some cases, a gene to be targeted can be expressed in tumor-specific T cells. A gene to be targeted can increase infiltration of an engineered cell into antigen-relevant tumors when disrupted. In some cases, a gene to be targeted can be CISH.

A gene that can be disrupted can be involved in attenuating TCR signaling, functional avidity, or immunity to cancer. In some cases, a gene to be disrupted is upregulated when a TCR is stimulated. A gene can be involved in inhibiting cellular expansion, functional avidity, or cytokine polyfunctionality. A gene can be involved in negatively regulating cellular cytokine production. For example, a gene can be involved in inhibiting production of effector cytokines, IFN-gamma and/or TNF for example. A gene can also be involved in inhibiting expression of supportive cytokines such as IL-2 after TCR stimulation. Such a gene can be CISH.

Gene suppression can also be done in a number of ways. For example, gene expression can be suppressed by knock out, altering a promoter of a gene, and/or by administering interfering RNAs. This can be done at an organism level or at a tissue, organ, and/or cellular level. If one or more genes are knocked down in a cell, tissue, and/or organ, the one or more genes can be suppressed by administrating RNA interfering reagents, e.g., siRNA, shRNA, or microRNA. For example, a nucleic acid which can express shRNA can be stably transfected into a cell to knockdown expression. Furthermore, a nucleic acid which can express shRNA can be inserted into the genome of a T cell, thus knocking down a gene within the T cell.

Disruption methods can also comprise overexpressing a dominant negative protein. This method can result in overall decreased function of a functional wild-type gene. Additionally, expressing a dominant negative gene can result in a phenotype that is similar to that of a knockout and/or knockdown.

Sometimes a stop codon can be inserted or created (e.g., by nucleotide replacement), in one or more genes, which can result in a nonfunctional transcript or protein (sometimes referred to as knockout). For example, if a stop codon is created within the middle of one or more genes, the resulting transcription and/or protein can be truncated, and can be nonfunctional. However, in some cases, truncation can lead to an active (a partially or overly active) protein. If a protein is overly active, this can result in a dominant negative protein.

This dominant negative protein can be expressed in a nucleic acid within the control of any promoter. For example, a promoter can be a ubiquitous promoter. A promoter can also be an inducible promoter, tissue specific promoter, cell specific promoter, and/or developmental specific promoter.

The nucleic acid that codes for a dominant negative protein can then be inserted into a cell. Any method can be used. For example, stable transfection can be used. Additionally, a nucleic acid that codes for a dominant negative protein can be inserted into a genome of a T cell.

One or more genes in a T cell can be knocked out or disrupted using any method. For example, knocking out one or more genes can comprise deleting one or more genes from a genome of a T cell. Knocking out can also comprise removing all or a part of a gene sequence from a T cell. It is also contemplated that knocking out can comprise replacing all or a part of a gene in a genome of a T cell with one or more nucleotides. Knocking out one or more genes can also comprise inserting a sequence in one or more genes thereby disrupting expression of the one or more genes. For example, inserting a sequence can generate a stop codon in the middle of one or more genes. Inserting a sequence can also shift the open reading frame of one or more genes.

Knockout can be done in any cell, organ, and/or tissue, e.g., in a T cell, hematopoietic stem cell, in the bone marrow, and/or the thymus. For example, knockout can be whole body knockout, e.g., expression of one or more genes is suppressed in all cells of a human. Knockout can also be specific to one or more cells, tissues, and/or organs of a human. This can be achieved by conditional knockout, where expression of one or more genes is selectively suppressed in one or more organs, tissues or types of cells. Conditional knockout can be performed by a Cre-lox system, wherein cre is expressed under the control of a cell, tissue, and/or organ specific promoter. For example, one or more genes can be knocked out (or expression can be suppressed) in one or more tissues, or organs, where the one or more tissues or organs can include brain, lung, liver, heart, spleen, pancreas, small intestine, large intestine, skeletal muscle, smooth muscle, skin, bones, adipose tissues, hairs, thyroid, trachea, gall bladder, kidney, ureter, bladder, aorta, vein, esophagus, diaphragm, stomach, rectum, adrenal glands, bronchi, ears, eyes, retina, genitals, hypothalamus, larynx, nose, tongue, spinal cord, or ureters, uterus, ovary, testis, and/or any combination thereof. One or more genes can also be knocked out (or expression can be suppressed) in one types of cells, where one or more types of cells include trichocytes, keratinocytes, gonadotropes, corticotropes, thyrotropes, somatotropes, lactotrophs, chromaffin cells, parafollicular cells, *glomus* cells melanocytes, nevus cells, merkel cells, odontoblasts, cementoblasts corneal keratocytes, retina muller cells, retinal pigment epithelium cells, neurons, glias (e.g., oligodendrocyte astrocytes), ependymocytes, pinealocytes, pneumocytes (e.g., type I pneumocytes, and type II pneumocytes), clara cells, goblet cells, G cells, D cells, Enterochromaffin-like cells, gastric chief cells, parietal cells, foveolar cells, K cells, D cells, I cells, goblet cells, paneth cells, enterocytes, microfold cells, hepatocytes, hepatic stellate cells (e.g., Kupffer cells from mesoderm), cholecystocytes, centroacinar cells, pancreatic stellate cells, pancreatic α cells, pancreatic β cells, pancreatic δ cells, pancreatic F cells, pancreatic ε cells, thyroid (e.g., follicular cells), parathyroid (e.g., parathyroid chief cells), oxyphil cells, urothelial cells, osteoblasts, osteocytes, chondroblasts, chondrocytes, fibroblasts, fibrocytes, myoblasts, myocytes, myosatellite cells, tendon cells, cardiac muscle cells, lipoblasts, adipocytes, interstitial cells of cajal, angioblasts, endothelial cells, mesangial cells (e.g., intraglomerular mesangial cells and extraglomerular mesangial cells), juxtaglomerular cells, macula *densa* cells, stromal cells, interstitial cells, telocytes simple epithelial cells, podocytes, kidney proximal tubule brush border cells, sertoli cells, leydig cells, granulosa cells, peg cells, germ cells, spermatozoon ovums, lymphocytes, myeloid cells, endothelial progenitor cells, endothelial stem cells, angioblasts, mesoangioblasts, pericyte mural cells, and/or any combination thereof.

In some embodiments, the methods of the present disclosure may comprise obtaining one or more cells from a subject. A cell may generally refer to any biological structure comprising cytoplasm, proteins, nucleic acids, and/or organelles enclosed within a membrane. In some embodiments, a cell may be a mammalian cell. In some embodiments, a cell may refer to an immune cell. Non-limiting examples of a cell can include a B cell, a basophil, a dendritic cell, an eosinophil, a gamma delta T cell, a granulocyte, a helper T cell, a Langerhans cell, a lymphoid cell, an innate lymphoid cell (ILC), a macrophage, a mast cell, a megakaryocyte, a memory T cell, a monocyte, a myeloid cell, a natural killer T cell, a neutrophil, a precursor cell, a plasma cell, a progenitor cell, a regulatory T-cell, a T cell, a thymocyte, any differentiated or de-differentiated cell thereof, or any mixture or combination of cells thereof.

In some embodiments, the cell may be an ILC, and the ILC is a group 1 ILC, a group 2 ILC, or a group 3 ILC. Group 1 ILCs may generally be described as cells controlled by the T-bet transcription factor, secreting type-1 cytokines such as IFN-gamma and TNF-alpha in response to intracellular pathogens. Group 2 ILCs may generally be described as cells relying on the GATA-3 and ROR-alpha transcription factors, producing type-2 cytokines in response to extracellular parasite infections. Group 3 ILCs may generally be described as cells controlled by the ROR-gamma t transcription factor, and produce IL-17 and/or IL-22.

In some embodiments, the cell may be a cell that is positive or negative for a given factor. In some embodiments, a cell may be a CD3+ cell, CD3− cell, a CD5+ cell, CD5− cell, a CD7+ cell, CD7− cell, a CD14+ cell, CD14− cell, CD8+ cell, a CD8− cell, a CD103+ cell, CD103− cell, CD11b+ cell, CD11b− cell, a BDCA1+ cell, a BDCA1− cell, an L-selectin+ cell, an L-selectin− cell, a CD25+, a CD25− cell, a CD27+, a CD27− cell, a CD28+ cell, CD28− cell, a CD44+ cell, a CD44− cell, a CD56+ cell, a CD56− cell, a CD57+ cell, a CD57− cell, a CD62L+ cell, a CD62L− cell, a CD69+ cell, a CD69− cell, a CD45RO+ cell, a CD45RO− cell, a CD127+ cell, a CD127− cell, a CD132+ cell, a CD132− cell, an IL-7+ cell, an IL-7− cell, an IL-15+ cell, an IL-15− cell, a lectin-like receptor G1 positive cell, a lectin-like receptor G1 negative cell, or an differentiated or de-differentiated cell thereof. The examples of factors expressed by cells is not intended to be limiting, and a person having skill in the art will appreciate that a cell may be positive or negative for any factor known in the art. In some embodiments, a cell may be positive for two or more factors. For example, a cell may be CD4+ and CD8+. In some embodiments, a cell may be negative for two or more factors. For example, a cell may be CD25-, CD44-, and CD69-. In some embodiments, a cell may be positive for one or more factors, and negative for one or more factors. For example, a cell may be CD4+ and CD8-. The selected cells can then be infused into a subject. In some embodiments, the cells may be selected for having or not having one or more given factors (e.g., cells may be separated based on the presence or absence of one or more factors). Separation efficiency can affect the viability of cells, and the efficiency with which a transgene may be integrated into the genome of a cell and/or expressed. In some embodiments, the selected cells can also be expanded in vitro. The selected cells can be expanded in vitro prior to infusion. It should be understood that cells used in any of the methods disclosed herein may be a mixture (e.g., two or more different cells) of any of the cells disclosed herein. For example, a method of the present disclosure may comprise cells, and the cells are a mixture of CD4+ cells and CD8+ cells. In another example, a method of the present disclosure may comprise cells, and the cells are a mixture of CD4+ cells and naïve cells.

Naïve cells retain several properties that may be particularly useful for the methods disclosed herein. For example, naïve cells are readily capable of in vitro expansion and T-cell receptor transgene expression, they exhibit fewer markers of terminal differentiation (a quality which may be associated with greater efficacy after cell infusion), and retain longer telomeres, suggestive of greater proliferative potential (Hinrichs, C. S., et al., "Human effector CD8+ T cells derived from naive rather than memory subsets possess superior traits for adoptive immunotherapy," Blood, 117 (3):808-14 (2011)). The methods disclosed herein may comprise selection or negative selection of markers specific for naïve cells. In some embodiments, the cell may be a naïve cell. A naïve cell may generally refer to any cell that has not been exposed to an antigen. Any cell in the present disclosure may be a naïve cell. In one example, a cell may be a naïve T cell. A naïve T cell may generally be described a cell that has differentiated in bone marrow, and successfully undergone the positive and negative processes of central selection in the thymus, and/or may be characterized by the expression or absence of specific markers (e.g., surface expression of L-selectin, the absence of the activation markers CD25, CD44 or CD69, and the absence of memory CD45RO isoform).

In some embodiments, cells may comprise cell lines (e.g., immortalized cell lines). Non-limiting examples of cell lines include human BC-1 cells, human BJAB cells, human IM-9 cells, human Jiyoye cells, human K-562 cells, human LCL cells, mouse MPC-11 cells, human Raji cells, human Ramos cells, mouse Ramos cells, human RPMI8226 cells, human RS4-11 cells, human SKW6.4 cells, human Dendritic cells, mouse P815 cells, mouse RBL-2H3 cells, human HL-60 cells, human NAMALWA cells, human Macrophage cells, mouse RAW 264.7 cells, human KG-1 cells, mouse MI cells, human PBMC cells, mouse BW5147 (T200-A)5.2 cells, human CCRF-CEM cells, mouse EL4 cells, human Jurkat cells, human SCID.adh cells, human U-937 cells or any combination of cells thereof.

Stem cells can give rise to a variety of somatic cells and thus have in principle the potential to serve as an endless supply of therapeutic cells of virtually any type. The reprogrammability of stem cells also allows for additional engineering to enhance the therapeutic value of the reprogrammed cell. In any of the methods of the present disclosure, one or more cells may be derived from a stem cell. Non-limiting examples of stem cells include embryonic stem cells, adult stem cells, tissue-specific stem cells, neural stem cells, allogenic stem cells, totipotent stem cells, multipotent stem cells, pluripotent stem cells, induced pluripotent stem cells, hematopoietic stem cells, epidermal stem cells, umbilical cord stem cells, epithelial stem cells, or adipose-derived stem cells. In one example, a cell may be hematopoietic stem cell-derived lymphoid progenitor cells. In another example, a cell may be embryonic stem cell-derived T cell. In yet another example, a cell may be an induced pluripotent stem cell (iPSC)-derived T cell.

Conditional knockouts can be inducible, for example, by using tetracycline inducible promoters, development specific promoters. This can allow for eliminating or suppressing expression of a gene/protein at any time or at a specific time. For example, with the case of a tetracycline inducible promoter, tetracycline can be given to a T cell any time after birth. A cre/lox system can also be under the control of a developmental specific promoter. For example, some promoters are turned on after birth, or even after the onset of puberty. These promoters can be used to control cre expression, and therefore can be used in developmental specific knockouts.

It is also contemplated that any combinations of knockout technology can be combined. For example, tissue specific knockout or cell specific knockout can be combined with inducible technology, creating a tissue specific or cell specific, inducible knockout. Furthermore, other systems such developmental specific promoter, can be used in combination with tissues specific promoters, and/or inducible knockouts.

Knocking out technology can also comprise gene editing. For example, gene editing can be performed using a nuclease, including CRISPR associated proteins (Cas proteins, e.g., Cas9), Zinc finger nuclease (ZFN), Transcription Activator-Like Effector Nuclease (TALEN), and meganucleases. Nucleases can be naturally existing nucleases, genetically modified, and/or recombinant. Gene editing can also be performed using a transposon-based system (e.g. PiggyBac, Sleeping beauty). For example, gene editing can be performed using a transposase.

CRISPR System

Methods described herein can take advantage of a CRISPR system. There are at least five types of CRISPR systems which all incorporate RNAs and Cas proteins. Types I, III, and IV assemble a multi-Cas protein complex that is capable of cleaving nucleic acids that are complementary to the crRNA. Types I and III both require pre-crRNA processing prior to assembling the processed crRNA into the multi-Cas protein complex. Types II and V CRISPR systems comprise a single Cas protein complexed with at least one guiding RNA.

The general mechanism and recent advances of CRISPR system is discussed in Cong, L. et al., "Multiplex genome engineering using CRISPR systems," Science, 339 (6121): 819-823 (2013); Fu, Y. et al., "High-frequency off-target mutagenesis induced by CRISPR-Cas nucleases in human cells," Nature Biotechnology, 31, 822-826 (2013); Chu, V T et al. "Increasing the efficiency of homology-directed repair for CRISPR-Cas9-induced precise gene editing in mammalian cells," Nature Biotechnology 33, 543-548 (2015); Shmakov, S. et al., "Discovery and functional characterization of diverse Class 2 CRISPR-Cas systems," Molecular Cell, 60, 1-13 (2015); Makarova, K S et al., "An updated evolutionary classification of CRISPR-Cas systems,", Nature Reviews Microbiology, 13, 1-15 (2015). Site-specific cleavage of a target DNA occurs at locations determined by both 1) base-pairing complementarity between the guide RNA and the target DNA (also called a protospacer) and 2) a short motif in the target DNA referred to as the protospacer adjacent motif (PAM). For example, an engineered cell can be generated using a CRISPR system, e.g., a type II CRISPR system. A Cas enzyme used in the methods disclosed herein can be Cas9, which catalyzes DNA cleavage. Enzymatic action by Cas9 derived from *Streptococcus pyogenes* or any closely related Cas9 can generate double stranded breaks at target site sequences which hybridize to 20 nucleotides of a guide sequence and that have a protospacer-adjacent motif (PAM) following the 20 nucleotides of the target sequence.

a. Cas Protein

A vector can be operably linked to an enzyme-coding sequence encoding a CRISPR enzyme, such as a Cas protein (CRISPR-associated protein). Non-limiting examples of Cas proteins can include Cas1, Cas1B, Cas2, Cas3, Cas4, Cas5, Cas6, Cas7, Cas8, Cas9 (also known as Csn1 or Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, homologues thereof, or modified versions thereof. An unmodified CRISPR enzyme can have DNA cleavage activity, such as Cas9. A CRISPR enzyme can direct cleavage of one or both strands at a target sequence, such as within a target sequence and/or within a complement of a target sequence. For example, a CRISPR enzyme can direct cleavage of one or both strands within or within about 1, 2, 3, 4, 5, 6, 7, 8, 9, 10, 15, 20, 25, 50, 100, 200, 500, or more base pairs from the first or last nucleotide of a target sequence. A vector that encodes a CRISPR enzyme that is mutated with respect to a corresponding wild-type enzyme such that the mutated CRISPR enzyme lacks the ability to cleave one or both strands of a target polynucleotide containing a target sequence can be used. A Cas protein can be a high fidelity cas protein such as Cas9HiFi.

A vector that encodes a CRISPR enzyme comprising one or more nuclear localization sequences (NLSs), such as more than or more than about 1, 2, 3, 4, 5, 6, 7, 8, 9, 10, NLSs can be used. For example, a CRISPR enzyme can comprise more than or more than about 1, 2, 3, 4, 5, 6, 7, 8, 9, 10, NLSs at or near the ammo-terminus, more than or more than about 1, 2, 3, 4, 5, 6, 7, 8, 9, 10, NLSs at or near the carboxyl-terminus, or any combination of these (e.g., one or more NLS at the ammo-terminus and one or more NLS at the carboxyl terminus). When more than one NLS is present, each can be selected independently of others, such that a single NLS can be present in more than one copy and/or in combination with one or more other NLSs present in one or more copies.

Cas9 can refer to a polypeptide with at least or at least about 50%, 60%, 70%, 80%, 90%, 100% sequence identity and/or sequence similarity to a wild type exemplary Cas9 polypeptide (e.g., Cas9 from *S. pyogenes*). Cas9 can refer to a polypeptide with at most or at most about 50%, 60%, 70%, 80%, 90%, 100% sequence identity and/or sequence similarity to a wild type exemplary Cas9 polypeptide (e.g., from *S. pyogenes*). Cas9 can refer to the wild type or a modified form of the Cas9 protein that can comprise an amino acid change such as a deletion, insertion, substitution, variant, mutation, fusion, chimera, or any combination thereof.

A polynucleotide encoding an endonuclease (e.g., a Cas protein such as Cas9) can be codon optimized for expression in particular cells, such as eukaryotic cells. This type of optimization can entail the mutation of foreign-derived (e.g., recombinant) DNA to mimic the codon preferences of the intended host organism or cell while encoding the same protein.

CRISPR enzymes used in the methods can comprise NLSs. The NLS can be located anywhere within the polypeptide chain, e.g., near the N- or C-terminus. For example, the NLS can be within or within about 1, 2, 3, 4, 5, 10, 15, 20, 25, 30, 40, 50 amino acids along a polypeptide chain from the N- or C-terminus. Sometimes the NLS can be within or within about 50 amino acids or more, e.g., 100, 200, 300, 400, 500, 600, 700, 800, 900, or 1000 amino acids from the N- or C-terminus.

An endonuclease can comprise an amino acid sequence having at least or at least about 50%, 60%, 70%, 75%, 80%, 85%, 90%, 95%, 99%, or 100%, amino acid sequence identity to the nuclease domain of a wild type exemplary site-directed polypeptide (e.g., Cas9 from *S. pyogenes*).

While *S. pyogenes* Cas9 (SpCas9), Table 11, is commonly used as a CRISPR endonuclease for genome engineering, it may not be the best endonuclease for every target excision site. For example, the PAM sequence for SpCas9 (5' NGG 3') is abundant throughout the human genome, but a NGG sequence may not be positioned correctly to target a desired gene for modification. In some cases, a different endonuclease may be used to target certain genomic targets. In some cases, synthetic SpCas9-derived variants with non-NGG PAM sequences may be used. Additionally, other Cas9 orthologues from various species have been identified and these "non-SpCas9s" bind a variety of PAM sequences that could also be useful for the present invention. For example, the relatively large size of SpCas9 (approximately 4 kb coding sequence) means that plasmids carrying the SpCas9 cDNA may not be efficiently expressed in a cell. Conversely, the coding sequence for *Staphylococcus aureus* Cas9 (SaCas9) is approximately 1 kilo base shorter than SpCas9, possibly allowing it to be efficiently expressed in a cell. Similar to SpCas9, the SaCas9 endonuclease is capable of modifying target genes in mammalian cells in vitro and in mice in vivo.

Alternatives to *S. pyogenes* Cas9 may include RNA-guided endonucleases from the Cpf1 family that display cleavage activity in mammalian cells. Unlike Cas9 nucleases, the result of Cpf1-mediated DNA cleavage is a double-strand break with a short 3' overhang. Cpf1's staggered cleavage pattern may open up the possibility of directional gene transfer, analogous to traditional restriction enzyme cloning, which may increase the efficiency of gene editing. Like the Cas9 variants and orthologues described above, Cpf1 may also expand the number of sites that can be targeted by CRISPR to AT-rich regions or AT-rich genomes that lack the NGG PAM sites favored by SpCas9.

Any functional concentration of Cas protein can be introduced to a cell. For example, 15 micrograms of Cas mRNA can be introduced to a cell. In other cases, a Cas mRNA can be introduced from 0.5 micrograms to 100 micrograms. A Cas mRNA can be introduced from 0.5, 5, 10, 15, 20, 25, 30, 35, 40, 45, 50, 55, 60, 65, 70, 75, 80, 85, 90, 95, or 100 micrograms.

b. Guide RNA

As used herein, the term "guide RNA (gRNA)", and its grammatical equivalents can refer to an RNA which can be specific for a target DNA and can form a complex with a Cas protein. A guide RNA can comprise a guide sequence, or spacer sequence, that specifies a target site and guides an RNA/Cas complex to a specified target DNA for cleavage. For example, FIG. 15, demonstrates that guide RNA can target a CRISPR complex to three genes and perform a targeted double strand break. Site-specific cleavage of a target DNA occurs at locations determined by both 1) base-pairing complementarity between a guide RNA and a target DNA (also called a protospacer) and 2) a short motif in a target DNA referred to as a protospacer adjacent motif (PAM).

A method disclosed herein also can comprise introducing into a cell or embryo at least one guide RNA or nucleic acid, e.g., DNA encoding at least one guide RNA. A guide RNA can interact with a RNA-guided endonuclease to direct the endonuclease to a specific target site, at which site the 5' end of the guide RNA base pairs with a specific protospacer sequence in a chromosomal sequence.

A guide RNA can comprise two RNAs, e.g., CRISPR RNA (crRNA) and transactivating crRNA (tracrRNA). A guide RNA can sometimes comprise a single-guide RNA (sgRNA) formed by fusion of a portion (e.g., a functional portion) of crRNA and tracrRNA. A guide RNA can also be a dual RNA comprising a crRNA and a tracrRNA. A guide RNA can comprise a crRNA and lack a tracrRNA. Furthermore, a crRNA can hybridize with a target DNA or protospacer sequence.

As discussed above, a guide RNA can be an expression product. For example, a DNA that encodes a guide RNA can be a vector comprising a sequence coding for the guide RNA. A guide RNA can be transferred into a cell or organism by transfecting the cell or organism with an isolated guide RNA or plasmid DNA comprising a sequence coding for the guide RNA and a promoter. A guide RNA can also be transferred into a cell or organism in other way, such as using virus-mediated gene delivery.

A guide RNA can be isolated. For example, a guide RNA can be transfected in the form of an isolated RNA into a cell or organism. A guide RNA can be prepared by in vitro transcription using any in vitro transcription system. A guide RNA can be transferred to a cell in the form of isolated RNA rather than in the form of plasmid comprising encoding sequence for a guide RNA.

A guide RNA can comprise a DNA-targeting segment and a protein binding segment. A DNA-targeting segment (or DNA-targeting sequence, or spacer sequence) comprises a nucleotide sequence that can be complementary to a specific sequence within a target DNA (e.g., a protospacer). A protein-binding segment (or protein-binding sequence) can interact with a site-directed modifying polypeptide, e.g. an RNA-guided endonuclease such as a Cas protein. By "segment" it is meant a segment/section/region of a molecule, e.g., a contiguous stretch of nucleotides in an RNA. A segment can also mean a region/section of a complex such that a segment may comprise regions of more than one molecule. For example, in some cases a protein-binding segment of a DNA-targeting RNA is one RNA molecule and the protein-binding segment therefore comprises a region of that RNA molecule. In other cases, the protein-binding segment of a DNA-targeting RNA comprises two separate molecules that are hybridized along a region of complementarity.

A guide RNA can comprise two separate RNA molecules or a single RNA molecule. An exemplary single molecule guide RNA comprises both a DNA-targeting segment and a protein-binding segment.

An exemplary two-molecule DNA-targeting RNA can comprise a crRNA-like ("CRISPR RNA" or "targeter-RNA" or "crRNA" or "crRNA repeat") molecule and a corresponding tracrRNA-like ("trans-acting CRISPR RNA" or "activator-RNA" or "tracrRNA") molecule. A first RNA molecule can be a crRNA-like molecule (targeter-RNA), that can comprise a DNA-targeting segment (e.g., spacer) and a stretch of nucleotides that can form one half of a double-stranded RNA (dsRNA) duplex comprising the protein-binding segment of a guide RNA. A second RNA molecule can be a corresponding tracrRNA-like molecule (activator-RNA) that can comprise a stretch of nucleotides that can form the other half of a dsRNA duplex of a protein-binding segment of a guide RNA. In other words, a stretch of nucleotides of a crRNA-like molecule can be complementary to and can hybridize with a stretch of nucleotides of a tracrRNA-like molecule to form a dsRNA duplex of a protein-binding domain of a guide RNA. As such, each crRNA-like molecule can be said to have a corresponding tracrRNA-like molecule. A crRNA-like molecule additionally can provide a single stranded DNA-targeting segment, or spacer sequence. Thus, a crRNA-like and a tracrRNA-like molecule (as a corresponding pair) can hybridize to form a guide RNA. A subject two-molecule guide RNA can comprise any corresponding crRNA and tracrRNA pair.

A DNA-targeting segment or spacer sequence of a guide RNA can be complementary to sequence at a target site in a chromosomal sequence, e.g., protospacer sequence) such that the DNA-targeting segment of the guide RNA can base pair with the target site or protospacer. In some cases, a DNA-targeting segment of a guide RNA can comprise from or from about 10 nucleotides to from or from about 25 nucleotides or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more than 25 nucleotides in length. Sometimes, a first region of a guide RNA can be or can be about 19, 20, or 21 nucleotides in length.

A guide RNA can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30 or more nucleotides. A target nucleic acid can be at most or at most about 5, 10, 15, 16, 17, 18, 19, 20, 21, 22, 23, 24, 25, 30 or more nucleotides. A target nucleic acid sequence can be or can be about 20 bases immediately 5' of the first nucleotide of the PAM. A guide RNA can target the nucleic acid sequence.

A guide nucleic acid, for example, a guide RNA, can refer to a nucleic acid that can hybridize to another nucleic acid, for example, the target nucleic acid or protospacer in a genome of a cell. A guide nucleic acid can be RNA. A guide nucleic acid can be DNA. The guide nucleic acid can be programmed or designed to bind to a sequence of nucleic acid site-specifically. A guide nucleic acid can comprise a polynucleotide chain and can be called a single guide nucleic acid. A guide nucleic acid can comprise two polynucleotide chains and can be called a double guide nucleic acid.

A guide nucleic acid can comprise one or more modifications to provide a nucleic acid with a new or enhanced feature. A guide nucleic acid can comprise a nucleic acid affinity tag. A guide nucleic acid can comprise synthetic nucleotide, synthetic nucleotide analog, nucleotide derivatives, and/or modified nucleotides.

A guide nucleic acid can comprise a nucleotide sequence (e.g., a spacer), for example, at or near the 5' end or 3' end, that can hybridize to a sequence in a target nucleic acid (e.g., a protospacer). A spacer of a guide nucleic acid can interact with a target nucleic acid in a sequence-specific manner via hybridization (i.e., base pairing). A spacer sequence can hybridize to a target nucleic acid that is located 5' or 3' of a protospacer adjacent motif (PAM). The length of a spacer sequence can be at least or at least about 5, 10, 15, 16, 17, 18, 19, 20, 21, 22, 23, 24, 25, 30 or more nucleotides. The length of a spacer sequence can be at most or at most about 5, 10, 15, 16, 17, 18, 19, 20, 21, 22, 23, 24, 25, 30 or more nucleotides.

A guide RNA can also comprises a dsRNA duplex region that forms a secondary structure. For example, a secondary structure formed by a guide RNA can comprise a stem (or hairpin) and a loop. A length of a loop and a stem can vary. For example, a loop can range from about 3 to about 10 nucleotides in length, and a stem can range from about 6 to about 20 base pairs in length. A stem can comprise one or more bulges of 1 to about 10 nucleotides. The overall length of a second region can range from about 16 to about 60 nucleotides in length. For example, a loop can be or can be about 4 nucleotides in length and a stem can be or can be about 12 base pairs. A dsRNA duplex region can comprise a protein-binding segment that can form a complex with an RNA-binding protein, such as a RNA-guided endonuclease, e.g. Cas protein.

A guide RNA can also comprise a tail region at the 5' or 3' end that can be essentially single-stranded. For example, a tail region is sometimes not complementarity to any chromosomal sequence in a cell of interest and is sometimes not complementarity to the rest of a guide RNA. Further, the length of a tail region can vary. A tail region can be more than or more than about 4 nucleotides in length. For example, the length of a tail region can range from or from about 5 to from or from about 60 nucleotides in length.

A guide RNA can be introduced into a cell or embryo as an RNA molecule. For example, a RNA molecule can be transcribed in vitro and/or can be chemically synthesized. A guide RNA can then be introduced into a cell or embryo as an RNA molecule. A guide RNA can also be introduced into a cell or embryo in the form of a non-RNA nucleic acid molecule, e.g., DNA molecule. For example, a DNA encoding a guide RNA can be operably linked to promoter control sequence for expression of the guide RNA in a cell or embryo of interest. A RNA coding sequence can be operably linked to a promoter sequence that is recognized by RNA polymerase III (Pol III).

A DNA molecule encoding a guide RNA can also be linear. A DNA molecule encoding a guide RNA can also be circular.

A DNA sequence encoding a guide RNA can also be part of a vector. Some examples of vectors can include plasmid vectors, phagemids, cosmids, artificial/mini-chromosomes, transposons, and viral vectors. For example, a DNA encoding a RNA-guided endonuclease is present in a plasmid vector. Other non-limiting examples of suitable plasmid vectors include pUC, pBR322, pET, pBluescript, and variants thereof. Further, a vector can comprise additional expression control sequences (e.g., enhancer sequences, Kozak sequences, polyadenylation sequences, transcriptional termination sequences, etc.), selectable marker sequences (e.g., antibiotic resistance genes), origins of replication, and the like.

When both a RNA-guided endonuclease and a guide RNA are introduced into a cell as DNA molecules, each can be part of a separate molecule (e.g., one vector containing fusion protein coding sequence and a second vector containing guide RNA coding sequence) or both can be part of a same molecule (e.g., one vector containing coding (and regulatory) sequence for both a fusion protein and a guide RNA).

A Cas protein, such as a Cas9 protein or any derivative thereof, can be pre-complexed with a guide RNA to form a ribonucleoprotein (RNP) complex. The RNP complex can be introduced into primary immune cells. Introduction of the RNP complex can be timed. The cell can be synchronized with other cells at G1, S, and/or M phases of the cell cycle. The RNP complex can be delivered at a cell phase such that HDR is enhanced. The RNP complex can facilitate homology directed repair.

A guide RNA can also be modified. The modifications can comprise chemical alterations, synthetic modifications, nucleotide additions, and/or nucleotide subtractions. The modifications can also enhance CRISPR genome engineering. A modification can alter chirality of a gRNA. In some cases, chirality may be uniform or stereopure after a modification. A guide RNA can be synthesized. The synthesized guide RNA can enhance CRISPR genome engineering. A guide RNA can also be truncated. Truncation can be used to reduce undesired off-target mutagenesis. The truncation can comprise any number of nucleotide deletions. For example, the truncation can comprise 1, 2, 3, 4, 5, 10, 15, 20, 25, 30, 40, 50 or more nucleotides. A guide RNA can comprise a region of target complementarity of any length. For example, a region of target complementarity can be less than 20 nucleotides in length. A region of target complementarity can be more than 20 nucleotides in length.

In some cases, a dual nickase approach may be used to introduce a double stranded break. Cas proteins can be mutated at known amino acids within either nuclease domains, thereby deleting activity of one nuclease domain and generating a nickase Cas protein capable of generating a single strand break. A nickase along with two distinct guide RNAs targeting opposite strands may be utilized to generate a DSB within a target site (often referred to as a "double nick" or "dual nickase" CRISPR system). This approach may dramatically increase target specificity, since it is unlikely that two off-target nicks will be generated within close enough proximity to cause a DSB.

In some cases, a GUIDE-Seq analysis can be performed to determine the specificity of engineered guide RNAs. The general mechanism and protocol of GUIDE-Seq profiling of off-target cleavage by CRISPR system nucleases is discussed in Tsai, S. et al., "GUIDE-Seq enables genome-wide profiling of off-target cleavage by CRISPR system nucleases," Nature, 33: 187-197 (2015).

A gRNA can be introduced at any functional concentration. For example, a gRNA can be introduced to a cell at 10 micrograms. In other cases, a gRNA can be introduced from 0.5 micrograms to 100 micrograms. A gRNA can be introduced from 0.5, 5, 10, 15, 20, 25, 30, 35, 40, 45, 50, 55, 60, 65, 70, 75, 80, 85, 90, 95, or 100 micrograms.

In some cases, a method can comprise an endonuclease selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, homologues thereof or modified versions thereof. A Cas protein can be Cas9. In some cases, a method can further comprise at least one guide RNA (gRNA). A gRNA can comprise at least one modification. An exogenous TCR can bind a cancer neo-antigen.

Disclosed herein is a method of making an engineered cell comprising: introducing at least one polynucleic acid encoding at least one exogenous T cell receptor (TCR) receptor sequence; introducing at least one guide RNA (gRNA) comprising at least one modification; and introducing at least one endonuclease; wherein the gRNA comprises at least one sequence complementary to at least one endogenous genome. In some cases, a modification is on a 5' end, a 3' end, from a 5' end to a 3' end, a single base modification, a 2'-ribose modification, or any combination thereof. A modification can be selected from a group consisting of base substitutions, insertions, deletions, chemical modifications, physical modifications, stabilization, purification, and any combination thereof.

Figure 98:
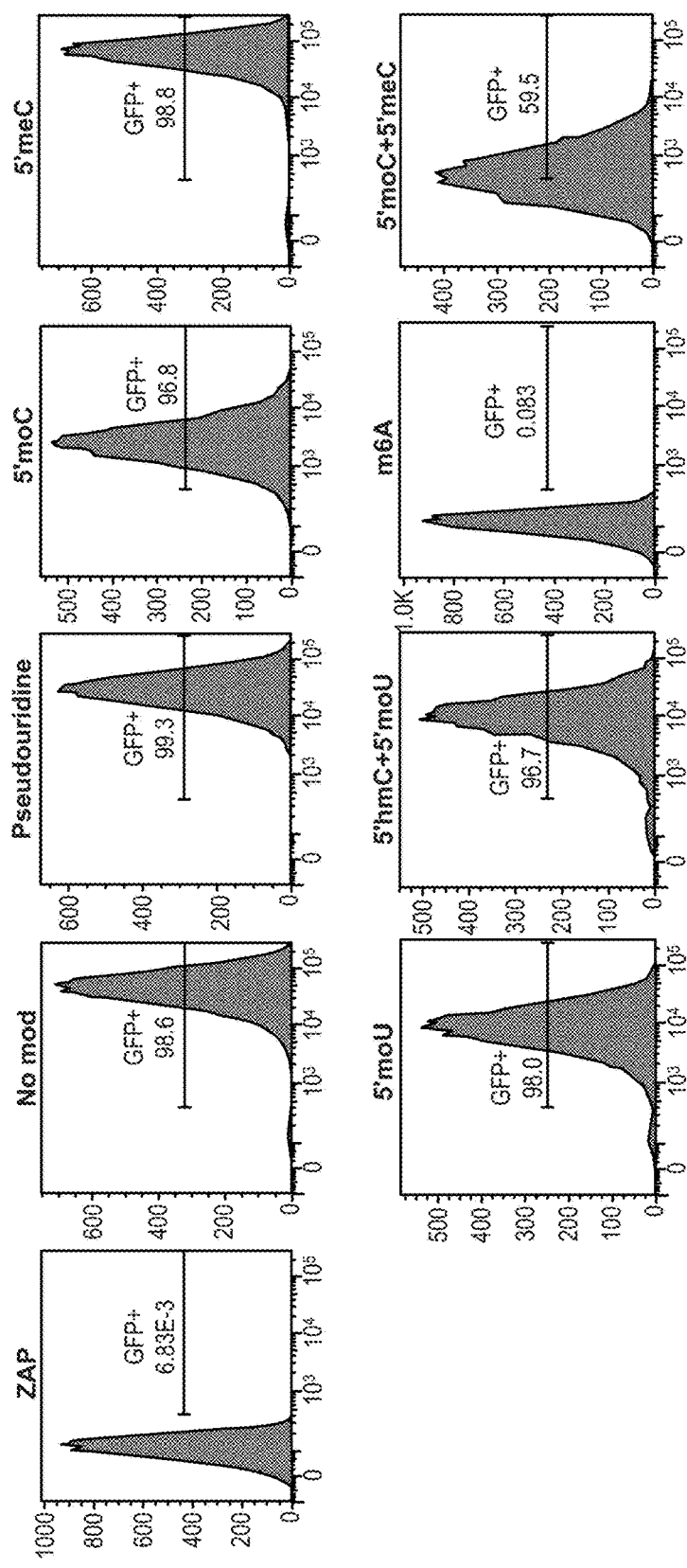
FIG. 98 shows T cells electroporated with a GFP+ transgene 48 hours post stimulation with modified gRNAs. gRNAs were modified with pseudouridine, 5'moC, 5'meC, 5'moU, 5'hmC+5'moU, m6A, or 5'moC+5'meC.
Figure 99:
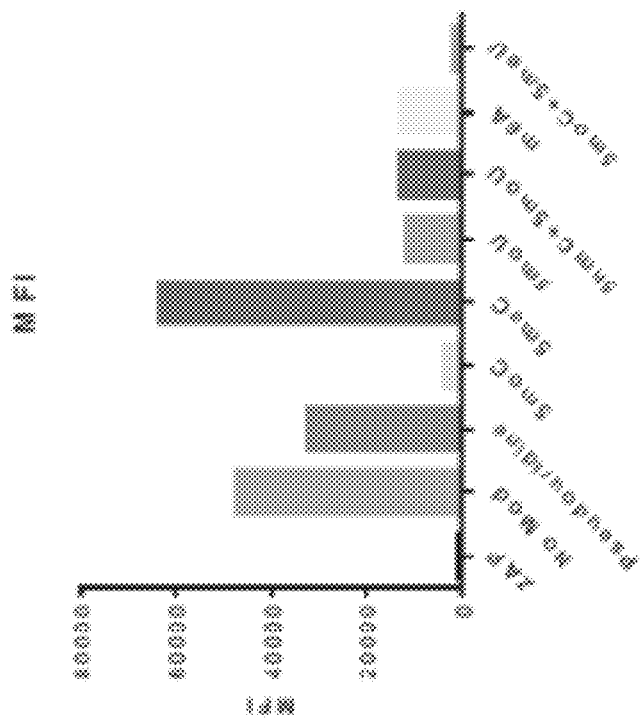
FIG. 99 A shows viability and FIG. 99 B shows MFI of GFP expressing cells for T cells electroporated with a GFP+ transgene 48 hours post stimulation with modified gRNAs. gRNAs were modified with pseudouridine, 5'moC, 5'meC, 5'moU, 5'hmC+5'moU, m6A, or 5'moC+5'meC.
Figure 99:
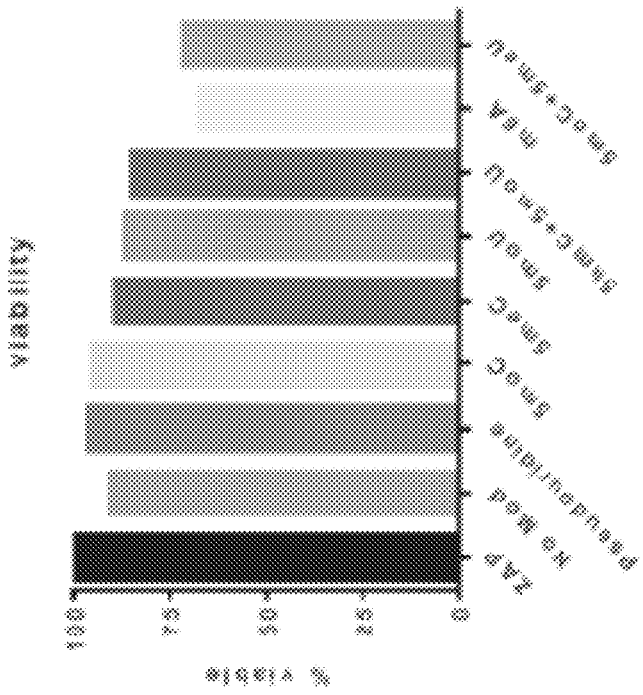

In some cases, a modification is a chemical modification. A modification can be selected from 5' adenylate, 5' guanosine-triphosphate cap, 5'N7-Methylguanosine-triphosphate cap, 5' triphosphate cap, 3' phosphate, 3' thiophosphate, 5' phosphate, 5' thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2' deoxyribonucleoside analog purine, 2' deoxyribonucleoside analog pyrimidine, ribonucleoside analog, 2'-O-methyl ribonucleoside analog, sugar modified analogs, wobble/universal bases, fluorescent dye label, 2' fluoro RNA, 2' O-methyl RNA, methylphosphonate, phosphodiester DNA, phosphodiester RNA, phosphothioate DNA, phosphorothioate RNA, UNA, pseudouridine-5'-triphosphate, 5-methylcytidine-5'-triphosphate, 2-O-methyl 3phosphorothioate or any combinations thereof. A modification can be a pseudouride modification as shown in FIG. 98. In some cases, a modification may not affect viability, FIG. 99 A and FIG. 99B.

In some cases, a modification is a 2-O-methyl 3 phosphorothioate addition. A 2-O-methyl 3 phosphorothioate addition can be performed from 1 base to 150 bases. A 2-O-methyl 3 phosphorothioate addition can be performed from 1 base to 4 bases. A 2-O-methyl 3 phosphorothioate addition can be performed on 2 bases. A 2-O-methyl 3 phosphorothioate addition can be performed on 4 bases. A modification can also be a truncation. A truncation can be a 5 base truncation.

Figure 100:
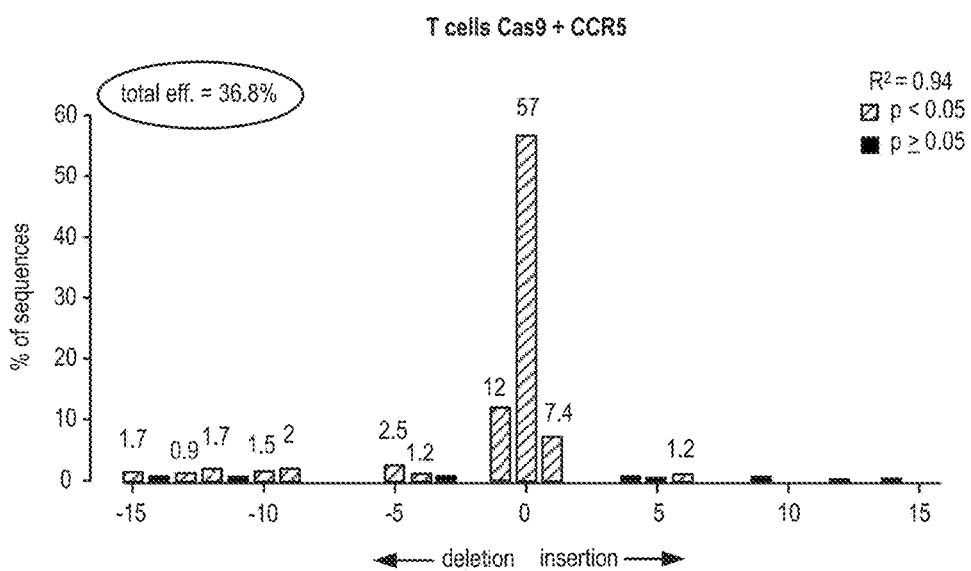
FIG. 100 A and FIG. 100 B show TIDE results of a comparison of a FIG. 100 A modified clean cap Cas9 protein or a FIG. 100 B unmodified Cas9 protein. Genomic integration was measured at the CCR5 locus of T cells electroporated with unmodified Cas9 or clean cap Cas9 at 15 micrograms of Cas9 and 10 micrograms of a chemically modified gRNA.
Figure 100:
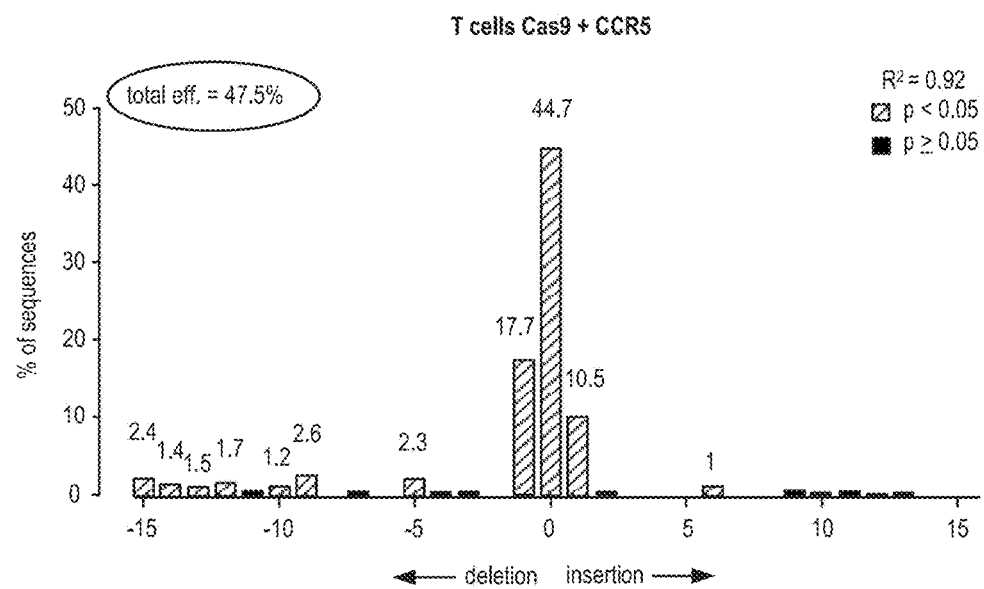

In some cases, a 5 base truncation can prevent a Cas protein from performing a cut. An endonuclease can be selected from the group consisting of a CRISPR system, TALEN, Zinc Finger, transposon-based, ZEN, meganuclease, Mega-TAL, and any combination. An endonuclease can be a Cas endonuclease. A Cas endonuclease can be selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, homologues thereof or modified versions thereof. A modified version of a Cas can be a clean cas, as shown in FIGS. 100 A and B. A Cas protein can be Cas9. A Cas9 can create a double strand break in said at least one endogenous genome. In some cases, an endogenous genome comprises at least one gene. A gene can be CISH, PD-1, TRA, TRB, or a combination thereof. In some cases, a double strand break can be repaired using homology directed repair (HR), non-homologous end joining (NHEJ), microhomology-mediated end joining (MMEJ), or any combination or derivative thereof. A TCR can be integrated into a double strand break.

c. Transgene

Insertion of a transgene (e.g., exogenous sequence) can be used, for example, for expression of a polypeptide, correction of a mutant gene or for increased expression of a wild-type gene. A transgene is typically not identical to the genomic sequence where it is placed. A donor transgene can contain a non-homologous sequence flanked by two regions of homology to allow for efficient HDR at the location of interest. Additionally, transgene sequences can comprise a vector molecule containing sequences that are not homologous to the region of interest in cellular chromatin. A transgene can contain several, discontinuous regions of homology to cellular chromatin. For example, for targeted insertion of sequences not normally present in a region of interest, a sequence can be present in a donor nucleic acid molecule and flanked by regions of homology to sequence in the region of interest.

A transgene polynucleic acid can be DNA or RNA, single-stranded or double-stranded and can be introduced into a cell in linear or circular form. A transgene sequence(s) can be contained within a DNA minicircle, which may be introduced into the cell in circular or linear form. If introduced in linear form, the ends of a transgene sequence can be protected (e.g., from exonucleolytic degradation) by any method. For example, one or more dideoxynucleotide residues can be added to the 3' terminus of a linear molecule and/or self-complementary oligonucleotides can be ligated to one or both ends. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues.

A transgene can be flanked by recombination arms. In some instances, recombination arms can comprise complementary regions that target a transgene to a desired integration site. A transgene can also be integrated into a genomic region such that the insertion disrupts an endogenous gene. A transgene can be integrated by any method, e.g., non-recombination end joining and/or recombination directed repair. A transgene can also be integrated during a recombination event where a double strand break is repaired. A transgene can also be integrated with the use of a homologous recombination enhancer. For example, an enhancer can block non-homologous end joining so that homology directed repair is performed to repair a double strand break.

Figure 16:
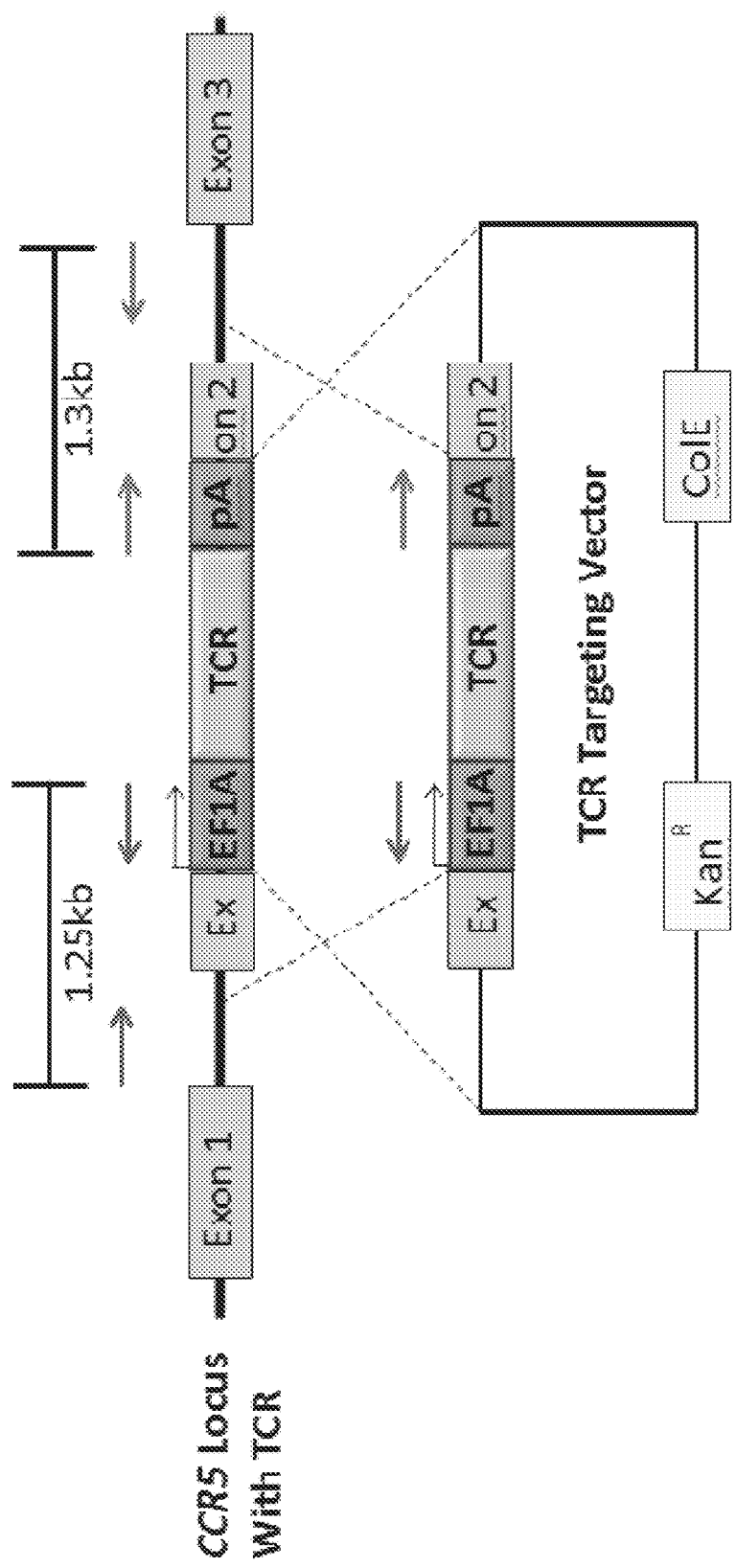
FIG. 16 shows a representation of TCR integration at CCR5. Exemplary design of a plasmid targeting vector with 1 kb recombination arms to CCR5. The 3 kb TCR expression transgene can be inserted into a similar vector with recombination arms to a different gene in order to target other genes of interest using homologous recombination. Analysis by PCR using primers outside of the recombination arms can demonstrate successful TCR integration at a gene.

A transgene can be flanked by recombination arms where the degree of homology between the arm and its complementary sequence is sufficient to allow homologous recombination between the two. For example, the degree of homology between the arm and its complementary sequence can be 50% or greater. Two homologous non-identical sequences can be any length and their degree of non-homology can be as small as a single nucleotide (e.g., for correction of a genomic point mutation by targeted homologous recombination) or as large as 10 or more kilobases (e.g., for insertion of a gene at a predetermined ectopic site in a chromosome). Two polynucleotides comprising the homologous non-identical sequences need not be the same length. For example, a representative transgene with recombination arms to CCR5 is shown in FIG. 16. Any other gene, e.g., the genes described herein, can be used to generate a recombination arm.

A transgene can be flanked by engineered sites that are complementary to the targeted double strand break region in a genome. In some cases, engineered sites are not recombination arms. Engineered sites can have homology to a double strand break region. Engineered sites can have homology to a gene. Engineered sites can have homology to a coding genomic region. Engineered sites can have homology to a non-coding genomic region. In some cases, a transgene can be excised from a polynucleic acid so it can be inserted at a double strand break region without homologous recombination. A transgene can integrate into a double strand break without homologous recombination.

A polynucleotide can be introduced into a cell as part of a vector molecule having additional sequences such as, for example, replication origins, promoters and genes encoding antibiotic resistance. Moreover, transgene polynucleotides can be introduced as naked nucleic acid, as nucleic acid complexed with an agent such as a liposome or poloxamer, or can be delivered by viruses (e.g., adenovirus, AAV, herpesvirus, retrovirus, lentivirus and integrase defective lentivirus (IDLV)). A virus that can deliver a transgene can be an AAV virus.

A transgene is generally inserted so that its expression is driven by the endogenous promoter at the integration site, namely the promoter that drives expression of the endogenous gene into which a transgene is inserted (e.g., AAVS SITE (E.G. AAVS1, AAVS2, ETC.), CCR5, HPRT). A transgene may comprise a promoter and/or enhancer, for example a constitutive promoter or an inducible or tissue/cell specific promoter. A minicircle vector can encode a transgene.

Targeted insertion of non-coding nucleic acid sequence may also be achieved. Sequences encoding antisense RNAs, RNAi, shRNAs and micro RNAs (miRNAs) may also be used for targeted insertions.

Figure 17:
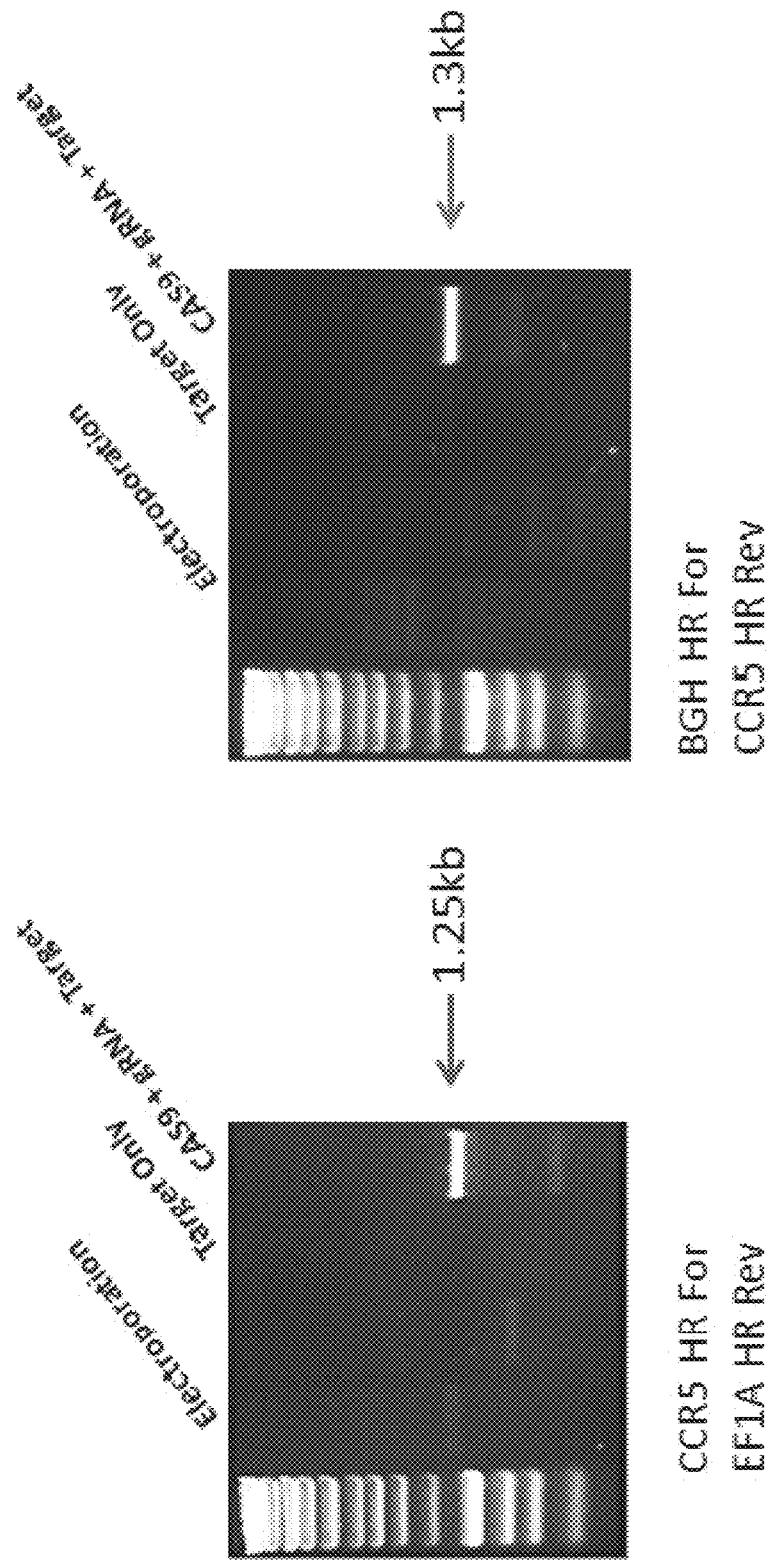
FIG. 17 depicts TCR integration at the CCR5 gene in stimulated T cells. Positive PCR results demonstrate successful homologous recombination at CCR5 gene at 72 hours post transfection.

A transgene may be inserted into an endogenous gene such that all, some or none of the endogenous gene is expressed. For example, a transgene as described herein can be inserted into an endogenous locus such that some (N-terminal and/or C-terminal to a transgene) or none of the endogenous sequences are expressed, for example as a fusion with a transgene. In other cases, a transgene (e.g., with or without additional coding sequences such as for the endogenous gene) is integrated into any endogenous locus, for example a safe-harbor locus. For example, a TCR transgene can be inserted into an endogenous TCR gene. For example, FIG. 17, shows that a transgene can be inserted into an endogenous CCR5 gene. A transgene can be inserted into any gene, e.g., the genes as described herein.

When endogenous sequences (endogenous or part of a transgene) are expressed with a transgene, the endogenous sequences can be full-length sequences (wild-type or mutant) or partial sequences. The endogenous sequences can be functional. Non-limiting examples of the function of these full length or partial sequences include increasing the serum half-life of the polypeptide expressed by a transgene (e.g., therapeutic gene) and/or acting as a carrier.

Furthermore, although not required for expression, exogenous sequences may also include transcriptional or translational regulatory sequences, for example, promoters, enhancers, insulators, internal ribosome entry sites, sequences encoding 2A peptides and/or polyadenylation signals.

In some cases, the exogenous sequence (e.g., transgene) comprises a fusion of a protein of interest and, as its fusion partner, an extracellular domain of a membrane protein, causing the fusion protein to be located on the surface of the cell. In some instances, a transgene encodes a TCR wherein a TCR encoding sequence is inserted into a safe harbor such that a TCR is expressed. In some instances, a TCR encoding sequence is inserted into a PD1 and/or a CTLA-4 locus. In other cases, a TCR is delivered to the cell in a lentivirus for random insertion while the PD1- or CTLA-4 specific nucleases can be supplied as mRNAs. In some instances, a TCR is delivered via a viral vector system such as a retrovirus, AAV or adenovirus along with mRNA encoding nucleases specific for a safe harbor (e.g. AAVS SITE (E.G. AAVS1, AAVS2, ETC.), CCR5, albumin or HPRT). The cells can also be treated with mRNAs encoding PD1 and/or CTLA-4 specific nucleases. In some cases, the polynucleotide encoding a TCR is supplied via a viral delivery system together with mRNA encoding HPRT specific nucleases and PD 1- or CTLA-4 specific nucleases. Cells comprising an integrated TCR-encoding nucleotide at the HPRT locus can be selected for using 6-thioguanine, a guanine analog that can result in cell arrest and/or initiate apoptosis in cells with an intact HPRT gene. TCRs that can be used with the methods and compositions of the invention include all types of these chimeric proteins, including first, second and third generation designs. TCRs comprising specificity domains derived from antibodies can be particularly useful, although specificity domains derived from receptors, ligands and engineered polypeptides can be also envisioned by the invention. The intercellular signaling domains can be derived from TCR chains such as zeta and other members of the CD3 complex such as the γ and E chains. In some cases, a TCRs may comprise additional co-stimulatory domains such as the intercellular domains from CD28, CD137 (also known as 4-1BB) or CD134. In still further cases, two types of co-stimulator domains may be used simultaneously (e.g., CD3 zeta used with CD28+CD137).

In some cases, the engineered cell can be a stem memory $T_{SCM}$ cell comprised of CD45RO (−), CCR7(+), CD45RA (+), CD62L+(L-selectin), CD27+, CD28+ and IL-7Rα+, stem memory cells can also express CD95, IL-2Rβ, CXCR3, and LFA-1, and show numerous functional attributes distinctive of stem memory cells. Engineered cells can also be central memory $T_{CM}$ cells comprising L-selectin and CCR7, where the central memory cells can secrete, for example, IL-2, but not IFNγ or IL-4. Engineered cells can also be effector memory $T_{EM}$ cells comprising L-selectin or CCR7 and produce, for example, effector cytokines such as IFNγ and IL-4, In some cases a population of cells can be introduced to a subject. For example, a population of cells can be a combination of T cells and NK cells. In other cases, a population can be a combination of naïve cells and effector cells.

Delivery of Homologous Recombination HR Enhancer

In some cases, a homologous recombination HR enhancer can be used to suppress non-homologous end-joining (NHEJ). Non-homologous end-joining can result in the loss of nucleotides at the end of double stranded breaks; non-homologous end-joining can also result in frameshift. Therefore, homology-directed repair can be a more attractive mechanism to use when knocking in genes. To suppress non-homologous end-joining, a HR enhancer can be delivered. In some cases, more than one HR enhancer can be delivered. A HR enhancer can inhibit proteins involved in non-homologous end-joining, for example, KU70, KU80, and/or DNA Ligase IV. In some cases a Ligase IV inhibitor, such as Scr7, can be delivered. In some cases the HR enhancer can be L755507. In some cases, a different Ligase IV inhibitor can be used. In some cases, a HR enhancer can be an adenovirus 4 protein, for example, E1B55K and/or E4orf6. In some cases a chemical inhibitor can be used.

Non-homologous end-joining molecules such as KU70, KU80, and/or DNA Ligase IV can be suppressed by using a variety of methods. For example, non-homologous end-joining molecules such as KU70, KU80, and/or DNA Ligase IV can be suppressed by gene silencing. For example, non-homologous end-joining molecules KU70, KU80, and/or DNA Ligase IV can be suppressed by gene silencing during transcription or translation of factors. Non-homologous end-joining molecules KU70, KU80, and/or DNA Ligase IV can also be suppressed by degradation of factors. Non-homologous end-joining molecules KU70, KU80, and/or DNA Ligase IV can be also be inhibited. Inhibitors of KU70, KU80, and/or DNA Ligase IV can comprise E1B55K and/or E4orf6. Non-homologous end-joining molecules KU70, KU80, and/or DNA Ligase IV can also be inhibited by sequestration. Gene expression can be suppressed by knock out, altering a promoter of a gene, and/or by administering interfering RNAs directed at the factors.

A HR enhancer that suppresses non-homologous end-joining can be delivered with plasmid DNA. Sometimes, the plasmid can be a double stranded DNA molecule. The plasmid molecule can also be single stranded DNA. The plasmid can also carry at least one gene. The plasmid can also carry more than one gene. At least one plasmid can also be used. More than one plasmid can also be used. A HR enhancer that suppresses non-homologous end-joining can be delivered with plasmid DNA in conjunction with CRISPR-Cas, primers, and/or a modifier compound. A modifier compound can reduce cellular toxicity of plasmid DNA and improve cellular viability. An HR enhancer and a modifier compound can be introduced to a cell before genomic engineering. The HR enhancer can be a small molecule. In some cases, the HR enhancer can be delivered to a T cell suspension. An HR enhancer can improve viability of cells transfected with double strand DNA. In some cases, introduction of double strand DNA can be toxic, FIG. 81 A. and FIG. 81 B.

Figure 10:
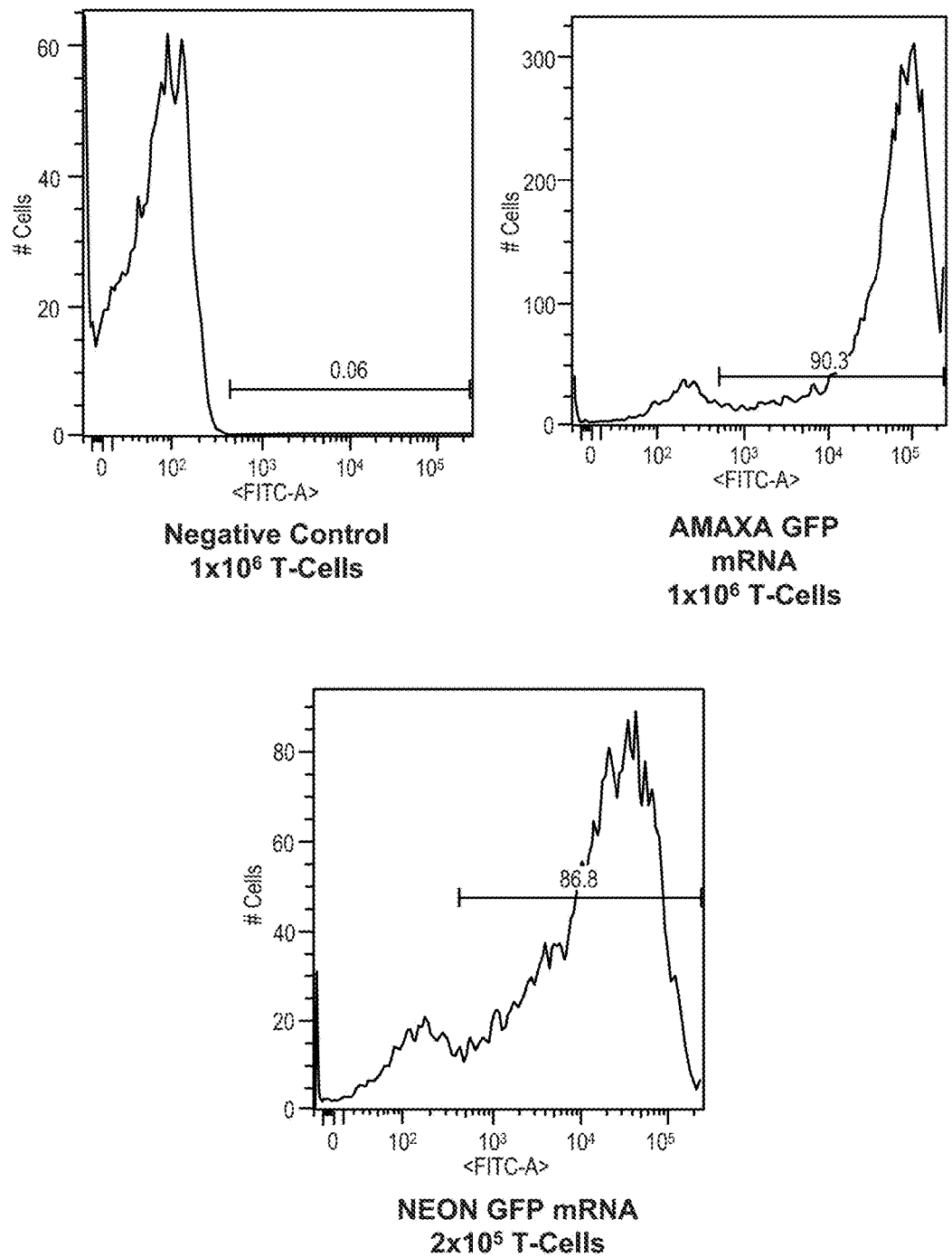
FIG. 10 shows successful T cell transfection efficiency using two platforms.
Figure 11:
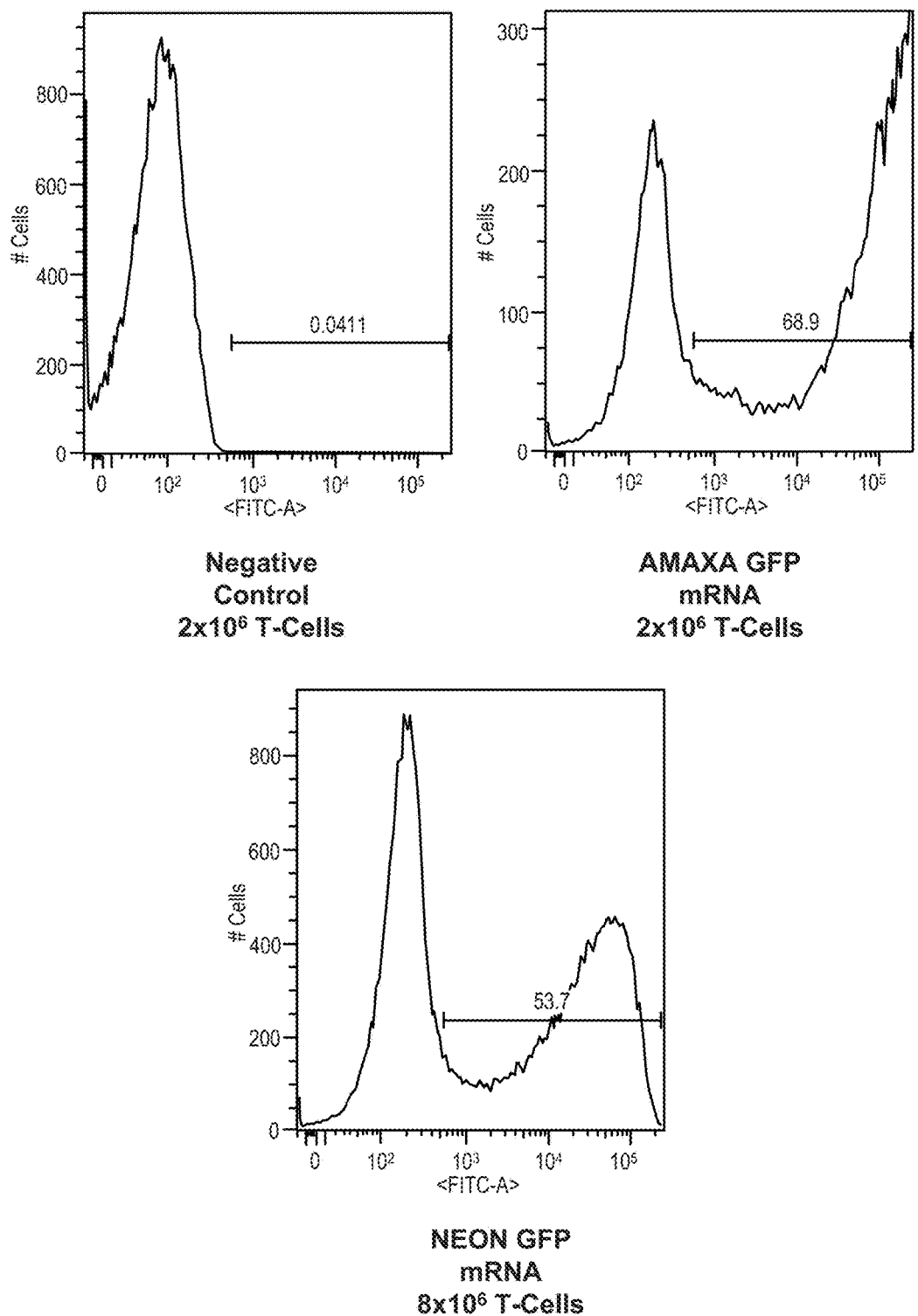
FIG. 11 shows efficient transfection as T cell number is scaled up, e.g., as T cell number increases.
Figure 13:
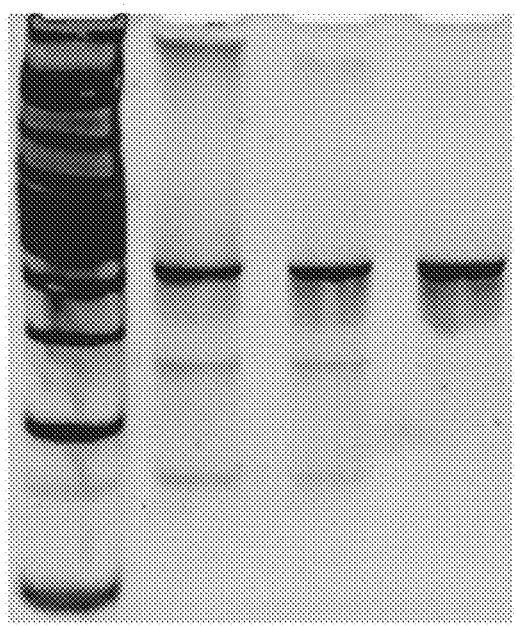
FIG. 13 demonstrates CRISPR-induced DSBs in stimulated T cells.
Figure 14:
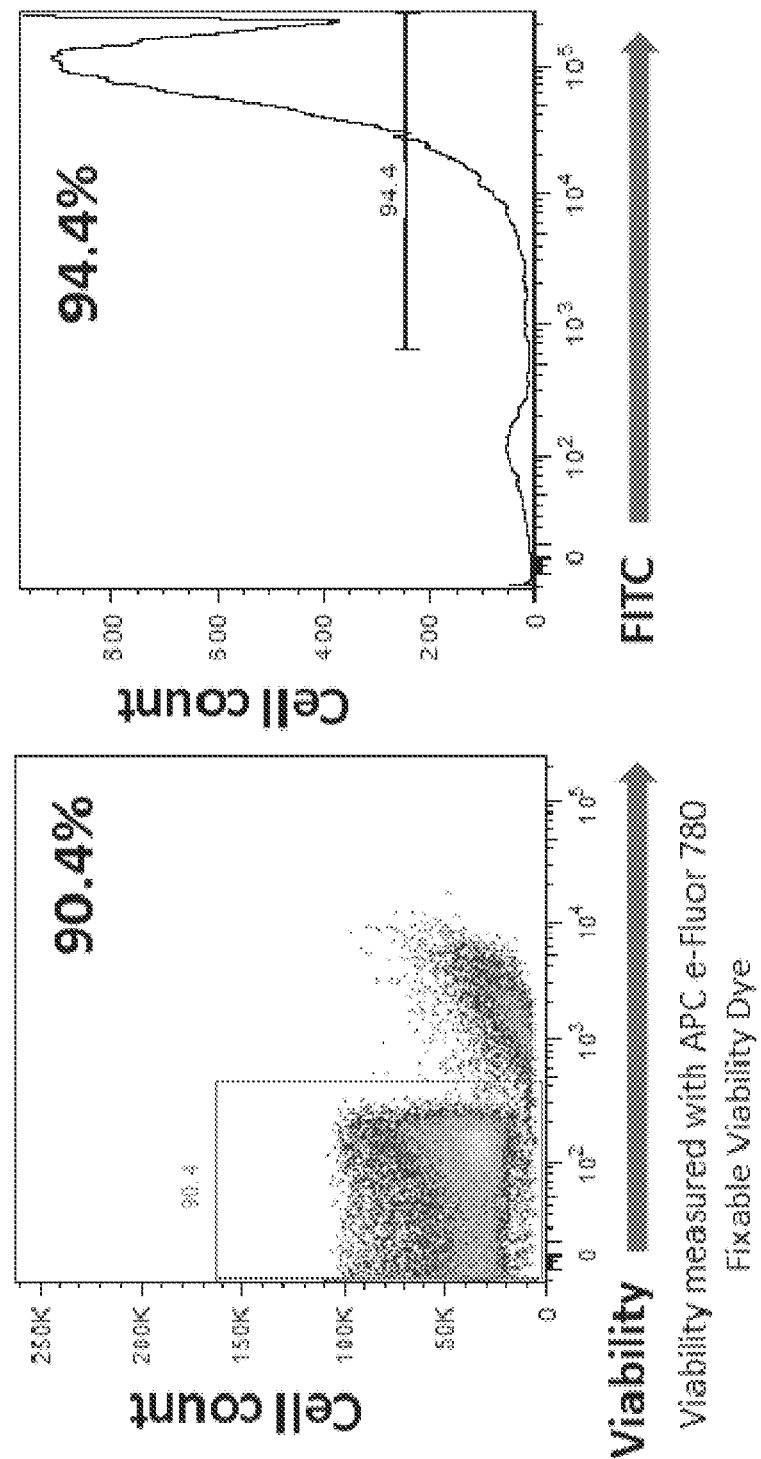
FIG. 14 shows optimization of RNA delivery.

A HR enhancer that suppresses non-homologous end-joining can be delivered with an HR substrate to be integrated. A substrate can be a polynucleic acid. A polynucleic acid can comprise a TCR transgene. A polynucleic acid can be delivered as mRNA (see FIG. 10 and FIG. 14). A polynucleic acid can comprise recombination arms to an endogenous region of the genome for integration of a TCR transgene. A polynucleic acid can be a vector. A vector can be inserted into another vector (e.g., viral vector) in either the sense or anti-sense orientation. Upstream of the 5' LTR region of the viral genome a T7, T3, or other transcriptional start sequence can be placed for in vitro transcription of the viral cassette (see FIG. 3). This vector cassette can be then used as a template for in vitro transcription of mRNA. For example, when this mRNA is delivered to any cell with its cognate reverse transcription enzyme, delivered also as mRNA or protein, then the single stranded mRNA cassette can be used as a template to generate hundreds to thousands of copies in the form of double stranded DNA (dsDNA) that can be used as a HR substrate for the desired homologous recombination event to integrate a transgene cassette at an intended target site in the genome. This method can circumvent the need for delivery of toxic plasmid DNA for CRISPR mediated homologous recombination. Additionally, as each mRNA template can be made into hundreds or thousands of copies of dsDNA, the amount of homologous recombination template available within the cell can be very high. The high amount of homologous recombination template can drive the desired homologous recombination event. Further, the mRNA can also generate single stranded DNA. Single stranded DNA can also be used as a template for homologous recombination, for example with recombinant AAV (rAAV) gene targeting. mRNA can be reverse transcribed into a DNA homologous recombination HR enhancer in situ. This strategy can avoid the toxic delivery of plasmid DNA. Additionally, mRNA can amplify the homologous recombination substrate to a higher level than plasmid DNA and/or can improve the efficiency of homologous recombination.

A HR enhancer that suppresses non-homologous end-joining can be delivered as a chemical inhibitor. For example, a HR enhancer can act by interfering with Ligase IV-DNA binding. A HR enhancer can also activate the intrinsic apoptotic pathway. A HR enhancer can also be a peptide mimetic of a Ligase IV inhibitor. A HR enhancer can also be co-expressed with the Cas9 system. A HR enhancer can also be co-expressed with viral proteins, such as E1B55K and/or E4orf6. A HR enhancer can also be SCR7, L755507, or any derivative thereof. A HR enhancer can be delivered with a compound that reduces toxicity of exogenous DNA insertion.

In the event that only robust reverse transcription of the single stranded DNA occurs in a cell, mRNAs encoding both the sense and anti-sense strand of the viral vector can be introduced (see FIG. 3). In this case, both mRNA strands can be reverse transcribed within the cell and/or naturally anneal to generate dsDNA.

The HR enhancer can be delivered to primary cells. A homologous recombination HR enhancer can be delivered by any suitable means. A homologous recombination HR enhancer can also be delivered as an mRNA. A homologous recombination HR enhancer can also be delivered as plasmid DNA. A homologous recombination HR enhancer can also be delivered to immune cells in conjunction with CRISPR-Cas. A homologous recombination HR enhancer can also be delivered to immune cells in conjunction with CRISPR-Cas, a polynucleic acid comprising a TCR sequence, and/or a compound that reduces toxicity of exogenous DNA insertion.

A homologous recombination HR enhancer can be delivered to any cells, e.g., to immune cells. For instance, a homologous recombination HR enhancer can be delivered to a primary immune cell. A homologous recombination HR enhancer can also be delivered to a T cell, including but not limited to T cell lines and to a primary T cell. A homologous recombination HR enhancer can also be delivered to a CD4+ cell, a CD8+ cell, and/or a tumor infiltrating cell (TIL). A homologous recombination HR enhancer can also be delivered to immune cells in conjunction with CRISPR-Cas.

In some cases, a homologous recombination HR enhancer can be used to suppress non-homologous end-joining. In some cases, a homologous recombination HR enhancer can be used to promote homologous directed repair. In some cases, a homologous recombination HR enhancer can be used to promote homologous directed repair after a CRISPR-Cas double stranded break. In some cases, a homologous recombination HR enhancer can be used to promote homologous directed repair after a CRISPR-Cas double stranded break and the knock-in and knock-out of one of more genes. The genes that are knocked-in can be a TCR. The genes that are knocked-out can also be any number of endogenous checkpoint genes. For example, the endogenous checkpoint gene can be selected from the group consisting of A2AR, B7-H3, B7-H4, BTLA, CTLA-4, IDO, KIR, LAG3, PD-1, TIM-3, VISTA, AAVS SITE (E.G. AAVS1, AAVS2, ETC.), CCR5, HPRT, PPP1R12C, or CISH. In some cases, the gene can be PD-1. In some cases, the gene can be an endogenous TCT. In some cases, the gene can comprise a coding region. In some cases, the gene can comprise a non-coding region.

Increase in HR efficiency with an HR enhancer can be or can be about 10%, 20%, 30%, 40%, 50%, 60%, 70%, 80%, 90%, or 100%.

Decrease in NHEJ with an HR enhancer can be or can be about 10%, 20%, 30%, 40%, 50%, 60%, 70%, 80%, 90%, or 100%.

Low Toxicity Engineering of Cells

Cellular toxicity to exogenous polynucleic acids can be mitigated to improve the engineering of cell, including T cells. For example, cellular toxicity can be reduced by altering a cellular response to polynucleic acid.

Figure 18:
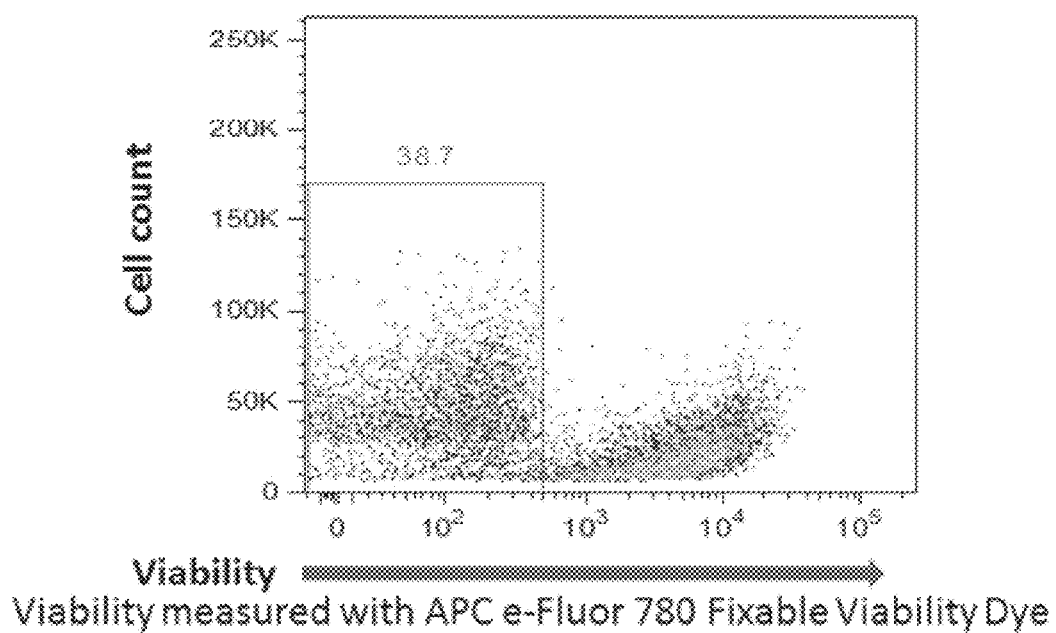
FIG. 18 shows T death in response to plasmid DNA transfection.
Figure 19:
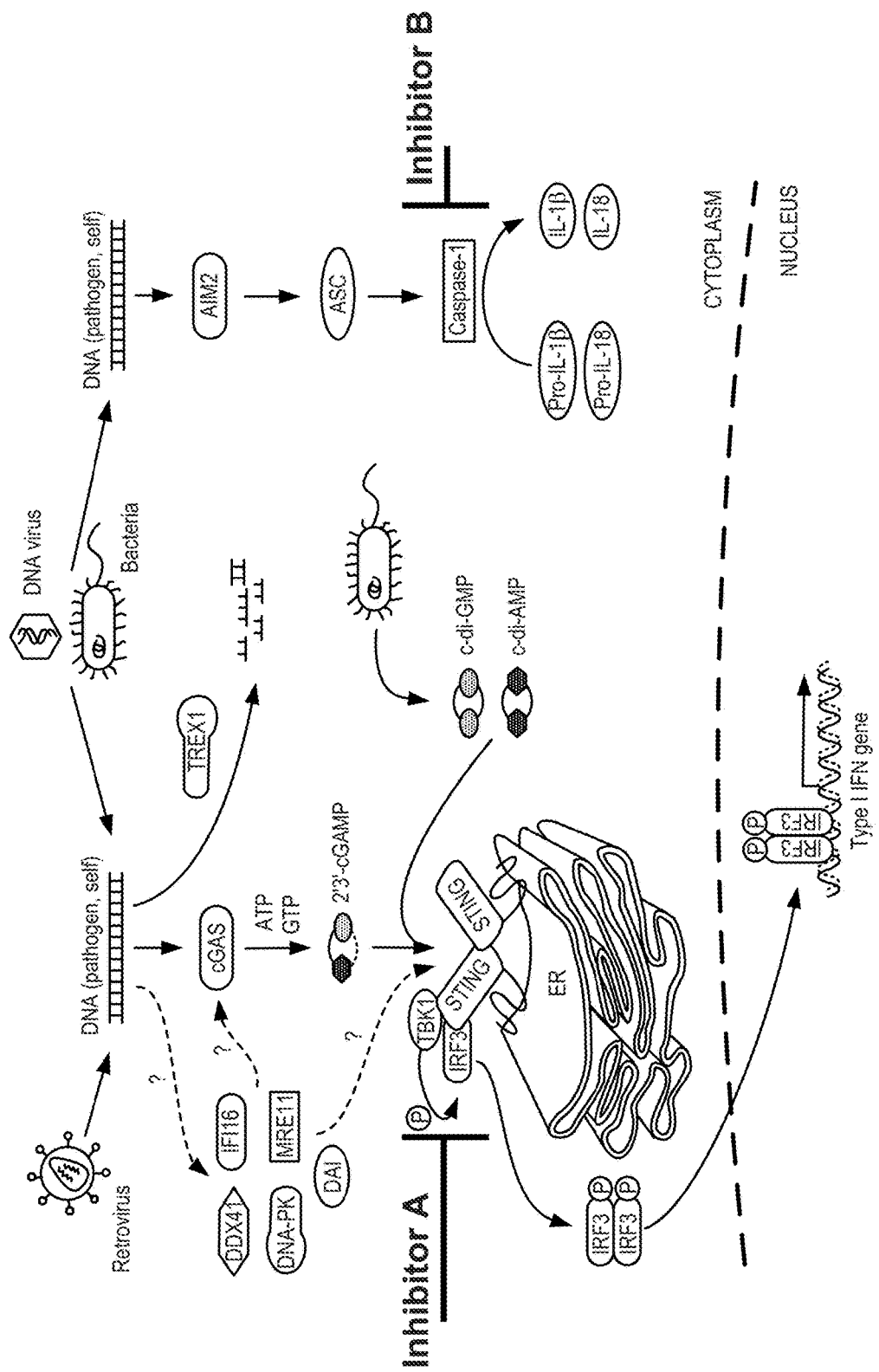
FIG. 19 is schematic of the innate immune sensing pathway of cytosolic DNA present in different types of cells, including but not limited to T cells. T cells express both pathways for detecting foreign DNA. The cellular toxicity can result from activation of these pathways during genome engineering.

A polynucleic acid can contact a cell. The polynucleic acids can then be introduced into a cell. In some cases, a polynucleic acid is utilized to alter a genome of a cell. After insertion of the polynucleic acid, the cell can die. For example, insertion of a polynucleic acid can cause apoptosis of a cell as shown in FIG. 18. Toxicity induced by a polynucleic acid can be reduced by using a modifier compound. For example, a modifier compound can disrupt an immune sensing response of a cell. A modifier compound can also reduce cellular apoptosis and pyropoptosis. Depending on the situation, a modifier compound can be an activator or an inhibitor. The modifier compound can act on any component of the pathways shown in FIG. 19. For example, the modifier compound can act on Caspase-1, TBK1, IRF3, STING, DDX41, DNA-PK, DAI, IFI16, MRE11, cGAS, 2'3'-cGAMP, TREX1, AIM2, ASC, or any combination thereof. The modifier compound can also act on the innate signaling system, thus, it can be an innate signaling modifier.

Reducing toxicity to exogenous polynucleic acids can be performed by contacting a compound and a cell. In some cases, a cell can be pre-treated with a compound prior to contact with a polynucleic acid. In some cases, a compound and a polynucleic acid are simultaneously introduced to a cell. In some cases, a compound can be introduced as a cocktail comprising a polynucleic acid, an HR enhancer, and/or CRISPR-Cas.

A compound that can be used in the methods and compositions described herein, can have one or more of the following characteristics and can have one or more of the function described herein. Despite its one or more functions, a compound described herein can decrease toxicity of exogenous polynucleotides. For example, a compound can modulate a pathway that results in toxicity from exogenously introduced polynucleic acid. In some cases, a polynucleic acid can be DNA. A polynucleic acid can also be RNA. A polynucleic acid can be single strand. A polynucleic acid can also be double strand. A polynucleic acid can be a vector. A polynucleic acid can also be a naked polynucleic acid. A polynucleic acid can encode for a protein. A polynucleic acid can also have any number of modifications. A polynucleic acid modification can be demethylation, addition of CpG methylation, removal of bacterial methylation, and/or addition of mammalian methylation. A polynucleic acid can also be introduced to a cell as a reagent cocktail comprising additional polynucleic acids, any number of HR enhancers, and/or CRISPR-Cas. A polynucleic acid can also comprise a transgene. A polynucleic acid can comprise a transgene that as a TCR sequence.

A compound can also modulate a pathway involved in initiating toxicity to exogenous DNA. A pathway can contain any number of factors. For example, a factor can comprise DNA-dependent activator of IFN regulatory factors (DAT), IFN inducible protein 16 (IFI16), DEAD box polypeptide 41 (DDX41) ("DEAD" disclosed as SEQ ID NO: 160), absent in melanoma 2 (AIM2), DNA-dependent protein kinase, cyclic guanosine monophosphate-adenosine monophosphate synthase (cGAS), stimulator of IFN genes (STING), TANK-binding kinase (TBK1), interleukin-1 β (IL-1β), MRE11, meiotic recombination 11, Trex1, cysteine protease with aspartate specificity (Caspase-1), three prime repair exonuclease, DNA-dependent activator of IRFs (DAI), IFI16, DDX41, DNA-dependent protein kinase (DNA-PK), meiotic recombination 11 homolog A (MRE11), and IFN regulatory factor (IRF) 3 and 7, and/or any derivative thereof.

In some cases, a DNA sensing pathway may generally refer to any cellular signaling pathway that comprises one or more proteins (e.g., DNA sensing proteins) involved in the detection of intracellular nucleic acids, and in some instances, exogenous nucleic acids. In some cases, a DNA sensing pathway may comprise stimulator of interferon (STING). In some cases, a DNA sensing pathway may comprise the DNA-dependent activator of IFN-regulatory factor (DAI). Non-limiting examples of a DNA sensing protein include three prime repair exonuclease 1 (TREX1), DEAD-box helicase 41 (DDX41) ("DEAD" disclosed as SEQ ID NO: 160), DNA-dependent activator of IFN-regulatory factor (DAI), Z-DNA-binding protein 1 (ZBP1), interferon gamma inducible protein 16 (IFI16), leucine rich repeat (In FLII) interacting protein 1 (LRRFIP1), DEAH-box helicase 9 (DHX9) ("DEAH" disclosed as SEQ ID NO: 182), DEAH-box helicase 36 (DHX36) ("DEAH" disclosed as SEQ ID NO: 182), Lupus Ku autoantigen protein p70 (Ku70), X-ray repair complementing defective repair in chinese hamster cells 6 (XRCC6), stimulator of interferon gene (STING), transmembrane protein 173 (TMEM173), tripartite motif containing 32 (TRIM32), tripartite motif containing 56 (TRIM56), β-catenin (CTNNB1), myeloid differentiation primary response 88 (MyD88), absent in melanoma 2 (AIM2), apoptosis-associated speck-like protein containing a CARD (ASC), pro-caspase-1 (pro-CASP1), caspase-1 (CASP1), pro-interleukin 1 beta (pro-IL-1β), pro-interleukin 18 (pro-IL-18), interleukin 1 beta (IL-1β), interleukin 18 (IL-18), interferon regulatory factor 1 (IRF1), interferon regulatory Factor 3 (IRF3), interferon regulatory factor 7 (IRF7), interferon-stimulated response element 7 (ISRE7), interferon-stimulated response element 1/7 (ISRE1/7), nuclear factor kappa B (NF-κB), RNA polymerase III (RNA Pol III), melanoma differentiation-associated protein 5 (MDA-5), Laboratory of Genetics and Physiology 2 (LGP2), retinoic acid-inducible gene 1 (RIG-I), mitochondrial antiviral-signaling protein (IPS-1), TNF receptor associated factor 3 (TRAF3), TRAF family member associated NFKB activator (TANK), nucleosome assembly protein 1 (NAP1), TANK binding kinase 1 (TBK1), autophagy related 9A (Atg9a), tumor necrosis factor alpha (TNF-α), interferon lamba-1 (IFNλ1), cyclic GMP-AMP Synthase (cGAS), AMP, GMP, cyclic GMP-AMP (cGAMP), a phosphorylated form of a protein thereof, or any combination or derivative thereof. In one example of a DNA sensing pathway, DAI activates the IRF and NF-κB transcription factors, leading to production of type I interferon and other cytokines. In another example of a DNA sensing pathway, upon sensing exogenous intracellular DNA, AIM2 triggers the assembly of the inflammasome, culminating in interleukin maturation and pyroptosis. In yet another example of a DNA sensing pathway, RNA PolIII may convert exogenous DNA into RNA for recognition by the RNA sensor RIG-I.

In some aspects, the methods of the present disclosure comprise introducing into one or more cells a nucleic acid comprising a first transgene encoding at least one anti-DNA sensing protein.

An anti-DNA sensing protein may generally refer to any protein that alters the activity or expression level of a protein corresponding to a DNA sensing pathway (e.g., a DNA sensing protein). In some cases, an anti-DNA sensing protein may degrade (e.g., reduce overall protein level) of one or more DNA sensing proteins. In some cases, an anti-DNA sensing protein may fully inhibit one or more DNA sensing proteins. In some cases, an anti-DNA sensing protein may partially inhibit one or more DNA sensing proteins. In some cases, an anti-DNA sensing protein may inhibit the activity of at least one DNA sensing protein by at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10%, or at least about 5%. In some cases, an anti-DNA sensing protein may decrease the amount of at least one DNA sensing protein by at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10%, or at least about 5%.

Cell viability may be increased by introducing viral proteins during a genomic engineering procedure, which can inhibit the cells ability to detect exogenous DNA. In some cases, an anti-DNA sensing protein may promote the translation (e.g., increase overall protein level) of one or more DNA sensing proteins. In some cases, an anti-DNA sensing protein may protect or increase the activity of one or more DNA sensing proteins. In some cases, an anti-DNA sensing protein may increase the activity of at least one DNA sensing protein by at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10%, or at least about 5%. In some cases, an anti-DNA sensing protein may increase the amount of at least one DNA sensing protein by at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10%, or at least about 5%. In some cases, an anti-DNA sensing inhibitor may be a competitive inhibitor or activator of one or more DNA sensing proteins. In some cases, an anti-DNA sensing protein may be a non-competitive inhibitor or activator of a DNA sensing protein.

Figure 104A:
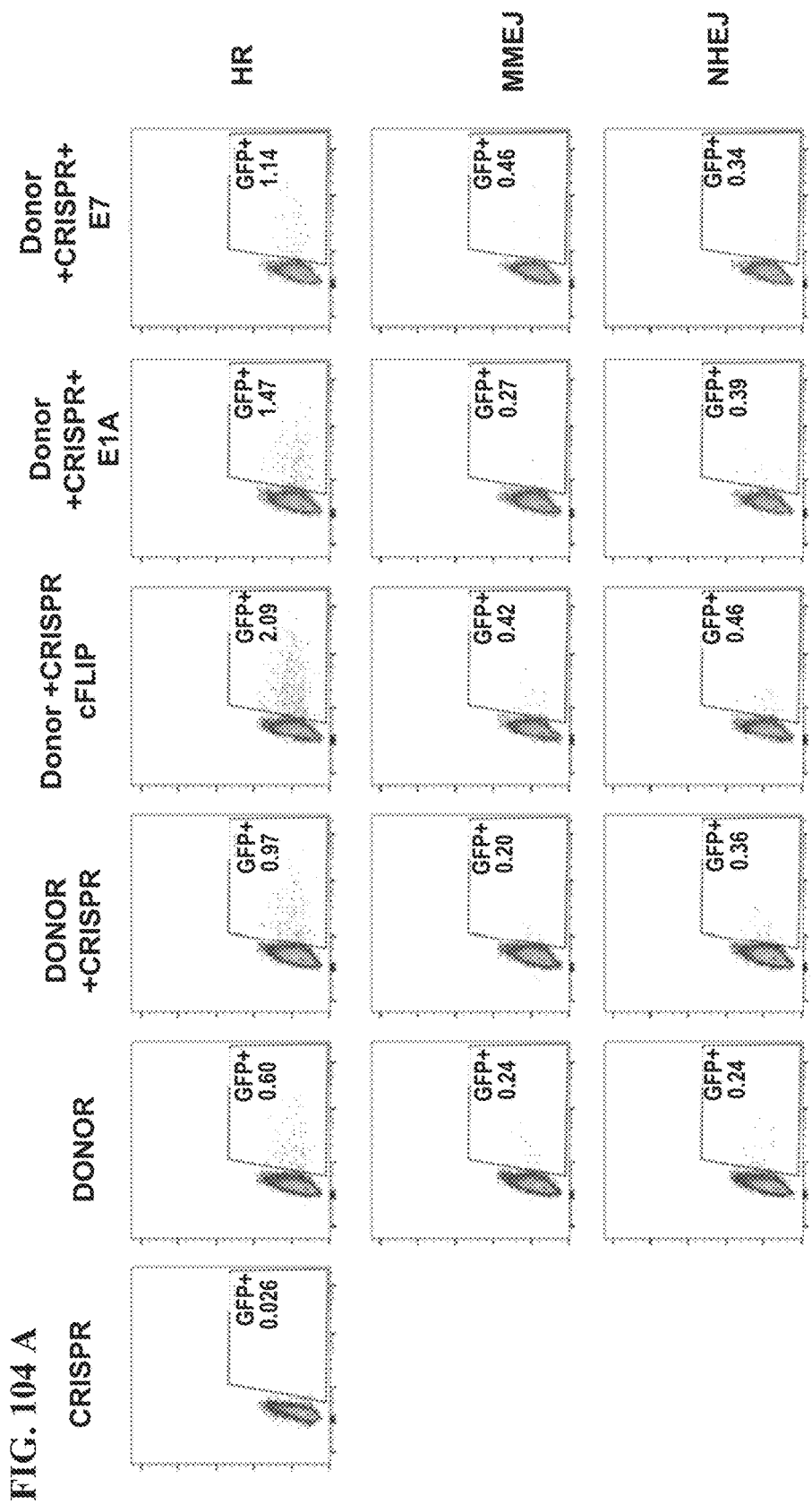
FIG. 104A and FIG. 104 B show human T cells electroporated with the CRISPR system alone (control); GFP plasmid (donor) alone (control); donor and CRISPR system; donor, CRISPR, and cFLP protein; donor, CRISPR, and hAd5 E1A (E1A) protein; or donor, CRISPR, and HPV18 E7 (E7) protein. FACs analysis of GFP was measured at FIG. 104 A 48 hours or FIG. 104 B 8 days post electroporation.
Figure 104:
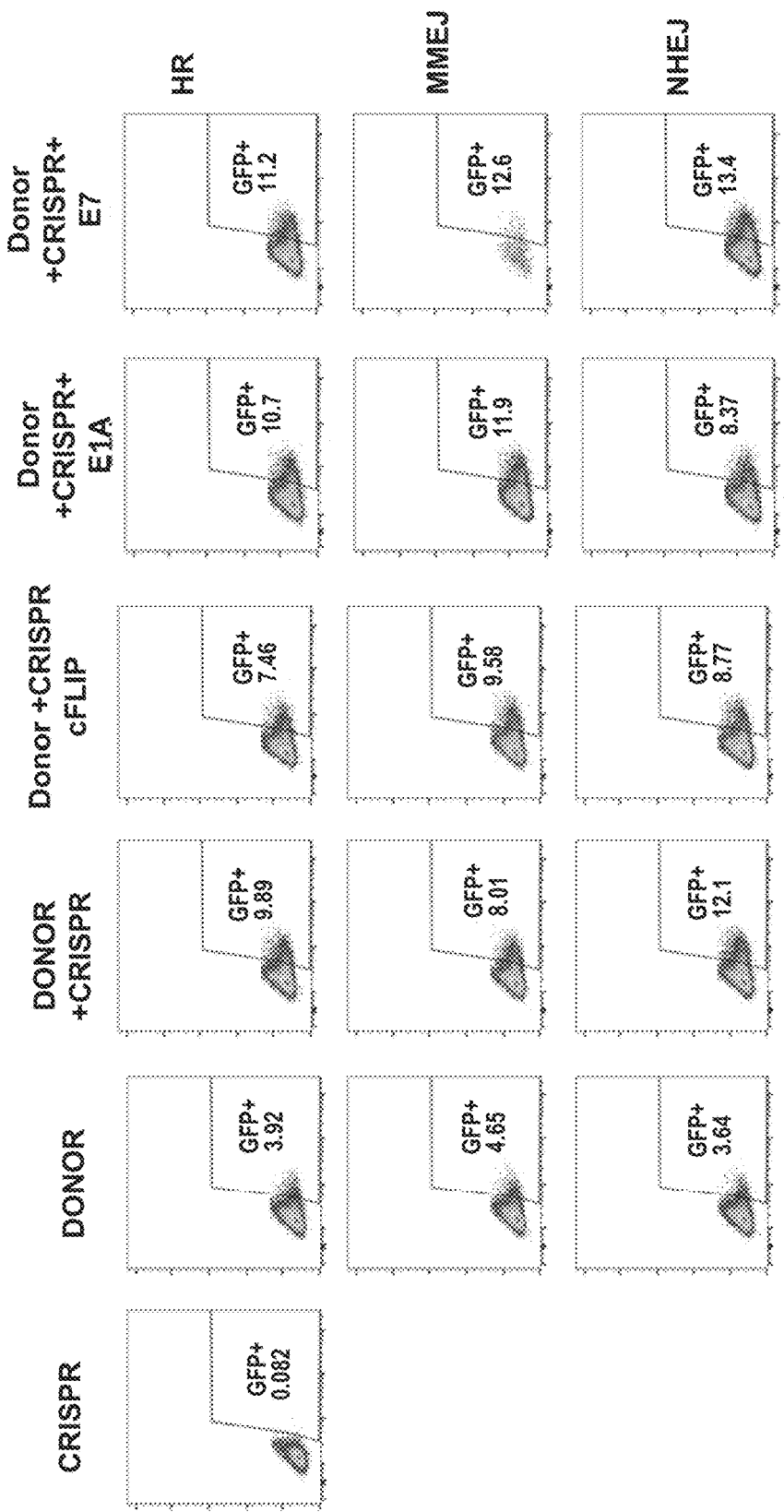

In some cases of the present disclosure, an anti-DNA sensing protein may also be a DNA sensing protein (e.g., TREX1). Non-limiting examples of anti-DNA sensing proteins include cellular FLICE-inhibitory protein (c-FLiP), Human cytomegalovirus tegument protein (HCMV pUL83), dengue virus specific NS2B-NS3 (DENV NS2B-NS3), Protein E7-Human papillomavirus type 18 (HPV18 E7), hAd5 E1A, Herpes simplex virus immediate-early protein ICP0 (HSV1 ICP0), Vaccinia virus B13 (VACV B13), Vaccinia virus C16 (VACV C16), three prime repair exonuclease 1 (TREX1), human coronavirus NL63 (HCoV-NL63), severe acute respiratory syndrome coronavirus (SARS-CoV), hepatitis B virus DNA polymerase (HBV Pol), porcine epidemic diarrhea virus (PEDV), adenosine deaminase (ADAR1), E3L, p202, a phosphorylated form of a protein thereof, and any combination or derivative thereof. In some cases, HCMV pUL83 may disrupt a DNA sensing pathway by inhibiting activation of the STING-TBK1-IRF3 pathway by interacting with the pyrin domain on IFI16 (e.g., nuclear IFI16) and blocking its oligomerization and subsequent downstream activation. In some cases, DENV Ns2B-NS3 may disrupt a DNA sensing pathway by degrading STING. In some cases, HPV18 E7 may disrupt a DNA sensing pathway by blocking the cGAS/STING pathway signaling by binding to STING. In some cases, hAd5 E1A may disrupt a DNA sensing pathway by blocking the cGAS/STING pathway signaling by binding to STING. For example, FIG. 104 A and FIG. 104B show cells transfected with a CRISPR system, an exogenous polynucleic acid, and an hAd5 E1A (E1A) or HPV18 E7 protein. In some cases, HSV1 ICP0 may disrupt a DNA sensing pathway by degradation of IFI16 and/or delaying recruitment of IFI16 to the viral genome. In some cases, VACV B13 may disrupt a DNA sensing pathway by blocking Caspase 1-dependant inflammasome activation and Caspase 8-dependent extrinsic apoptosis. In some cases, VACV C16 may disrupt a DNA sensing pathway by blocking innate immune responses to DNA, leading to decreased cytokine expression.

Figure 20:
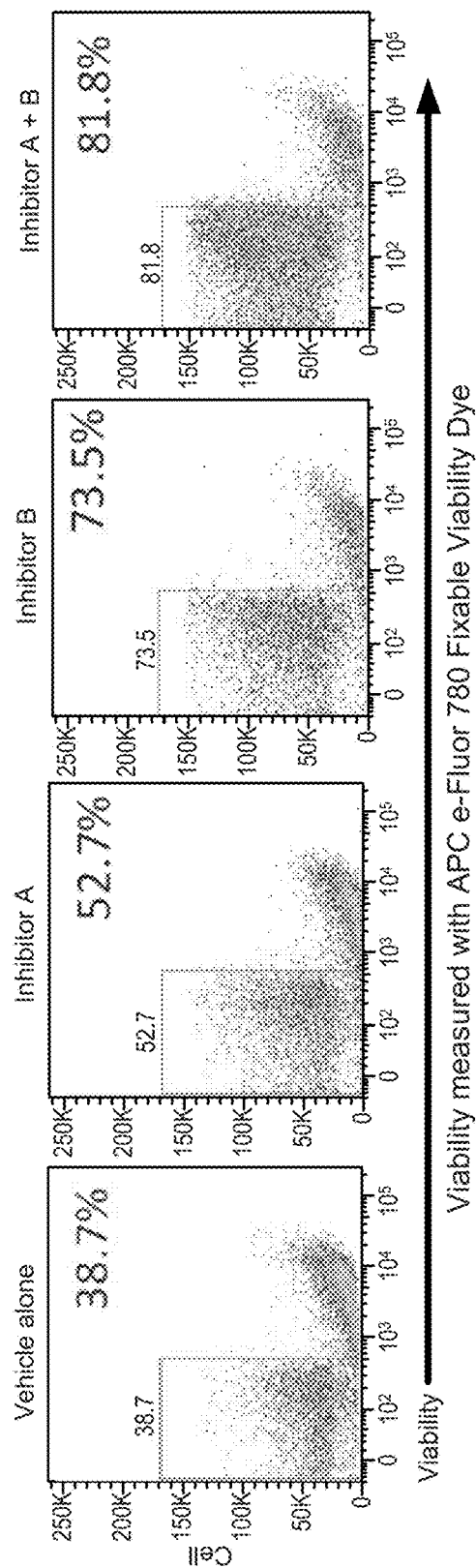
FIG. 20 demonstrates that the inhibitors of FIG. 19 block apoptosis and pyropoptosis.

A compound can be an inhibitor. A compound can also be an activator. A compound can be combined with a second compound. A compound can also be combined with at least one compound. In some cases, one or more compounds can behave synergistically. For example, one or more compounds can reduce cellular toxicity when introduced to a cell at once as shown in FIG. 20.

A compound can be Pan Caspase Inhibitor Z-VAD-FMK and/or Z-VAD-FMK. A compound can be a derivative of any number of known compounds that modulate a pathway involved in initiating toxicity to exogenous DNA. A compound can also be modified. A compound can be modified by any number of means, for example, a modification to a compound can comprise deuteration, lipidization, glycosylation, alkylation, PEGylation, oxidation, phosphorylation, sulfation, amidation, biotinylation, citrullination, isomerization, ubiquitylation, protonation, small molecule conjugations, reduction, dephosphorylation, nitrosylation, and/or proteolysis. A modification can also be post-translational. A modification can be pre-translation. A modification can occur at distinct amino acid side chains or peptide linkages and can be mediated by enzymatic activity.

A modification can occur at any step in the synthesis of a compound. For example, in proteins, many compounds are modified shortly after translation is ongoing or completed to mediate proper compound folding or stability or to direct the nascent compound to distinct cellular compartments. Other modifications occur after folding and localization are completed to activate or inactivate catalytic activity or to otherwise influence the biological activity of the compound. Compounds can also be covalently linked to tags that target a compound for degradation. Besides single modifications, compounds are often modified through a combination of post-translational cleavage and the addition of functional groups through a step-wise mechanism of compound maturation or activation.

Figure 88A:
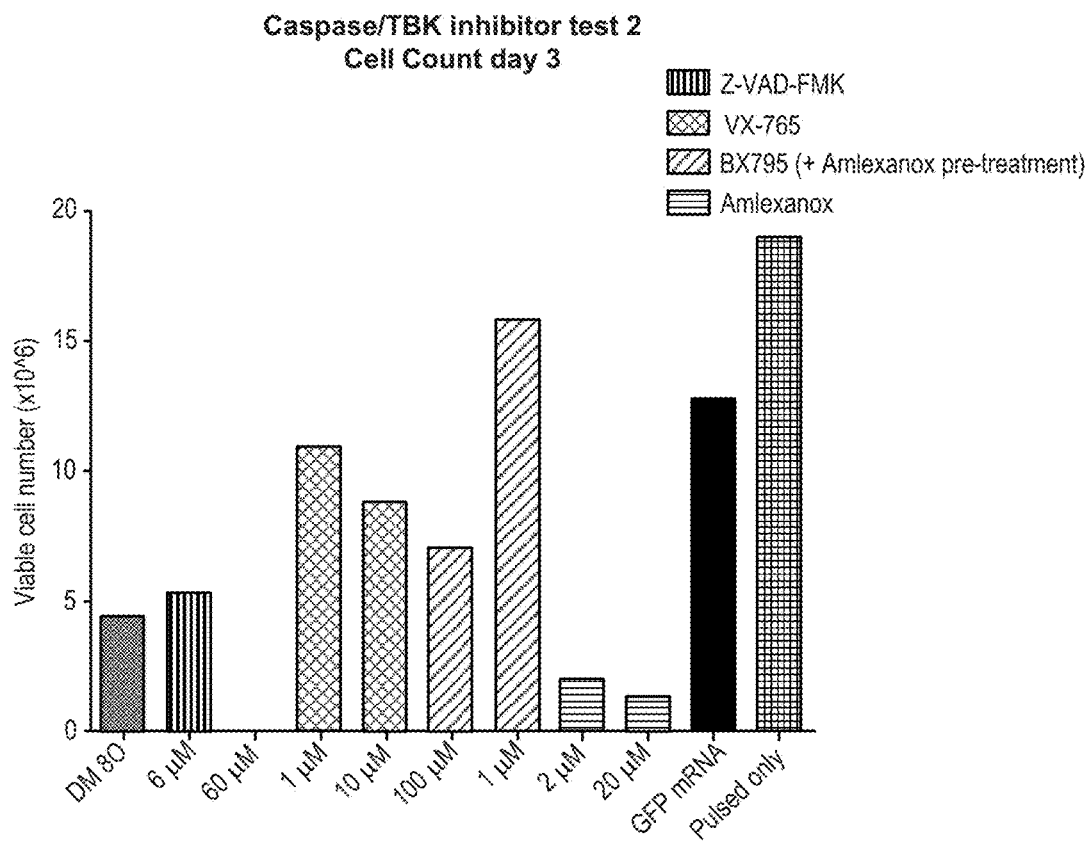
FIG. 88 A and FIG. 88 B show day 3 data FIG. 88 A CRISPR electroporation experiment in which caspase and TBK inhibitors were used during the electroporation of a 7.5 microgram minicircle donor encoding an exogenous TCR. Viability is plotted in comparison to concentration of inhibitor used.
Figure 88B:
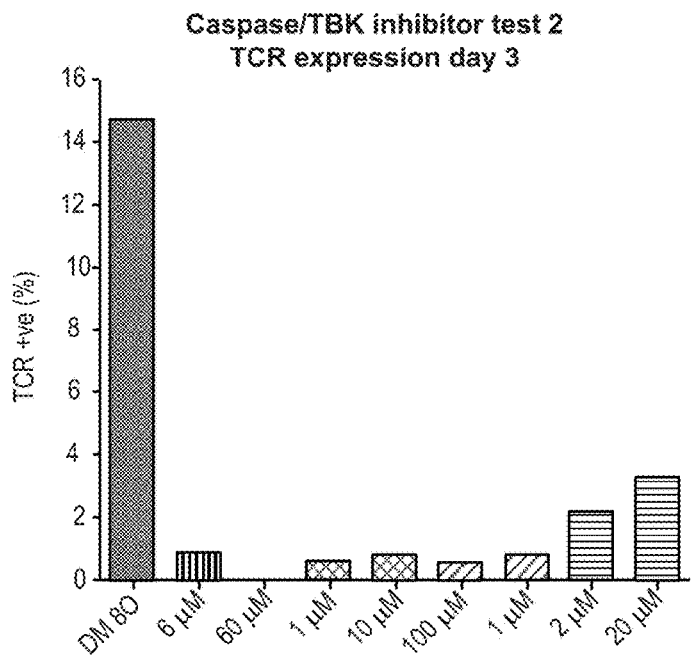
Figure 89:
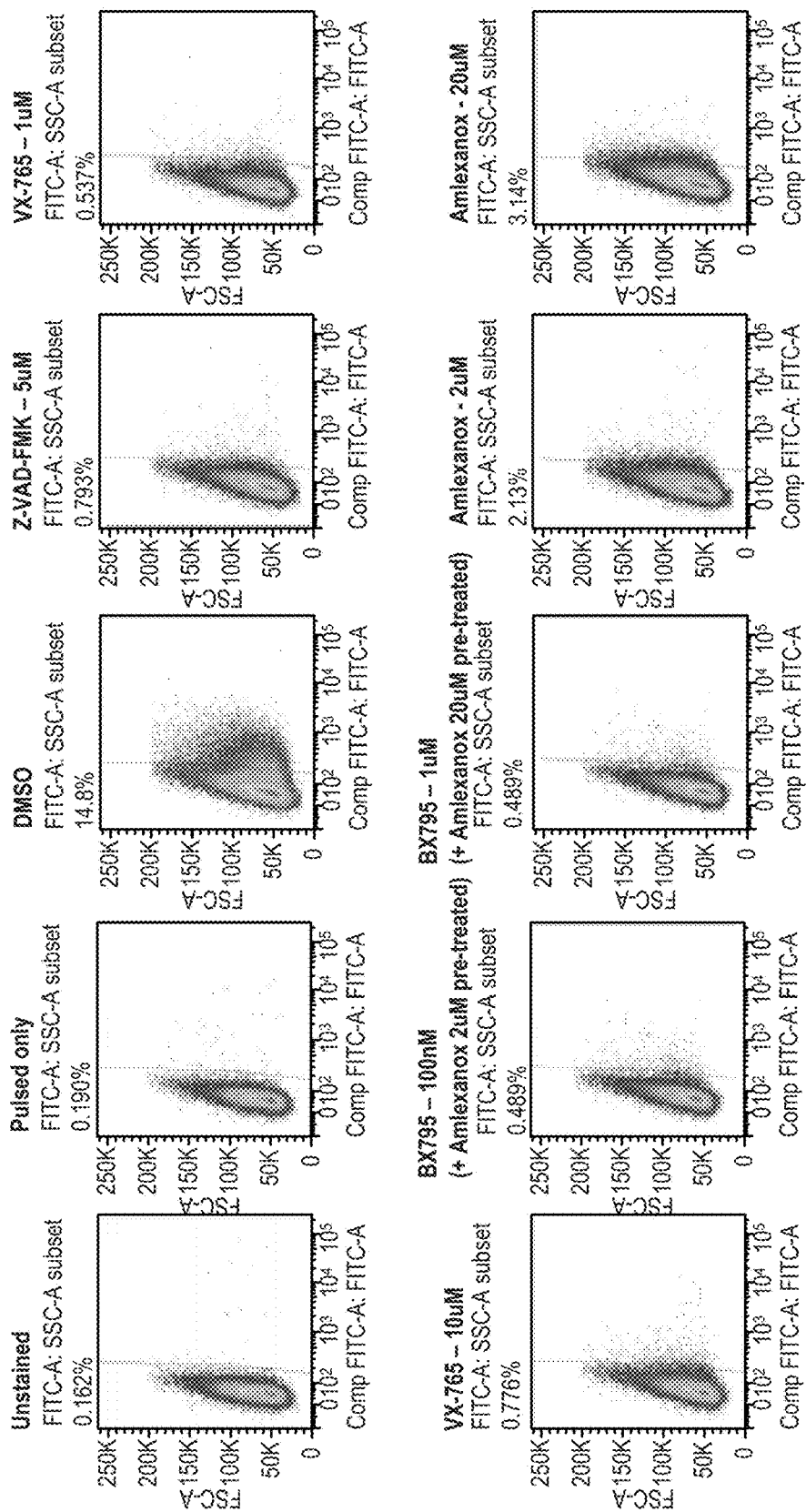
FIG. 89 shows FACs data of human T cells electroporated with CRISPR and minicircle DNA (7.5 microgram) encoding an exogenous TCR. Caspase and TBK inhibitors were added during the electroporation.

A compound can reduce production of type I interferons (IFNs), for example, IFN-$\alpha$, and/or IFN-$\beta$. A compound can also reduce production of proinflammatory cytokines such as tumor necrosis factor-$\alpha$ (TNF-$\alpha$) and/or interleukin-1$\beta$ (IL-1$\beta$). A compound can also modulate induction of antiviral genes through the modulation of the Janus kinase (JAK)-signal transducer and activator of transcription (STAT) pathway. A compound can also modulate transcription factors nuclear factor $\kappa$-light-chain enhancer of activated B cells (NF-$\kappa$B), and the IFN regulatory factors IRF3 and IRF7. A compound can also modulate activation of NF-$\kappa$B, for example modifying phosphorylation of I$\kappa$B by the I$\kappa$B kinase (IKK) complex. A compound can also modulate phosphorylation or prevent phosphorylation of I$\kappa$B. A compound can also modulate activation of IRF3 and/or IRF7. For example, a compound can modulate activation of IRF3 and/or IRF7. A compound can activate TBK1 and/or IKK$\epsilon$. A compound can also inhibit TBK1 and/or IKK$\epsilon$. A compound can prevent formation of an enhanceosome complex comprised of IRF3, IRF7, NF-$\kappa$B and other transcription factors to turn on the transcription of type I IFN genes. A modifying compound can be a TBK1 compound and at least one additional compound, FIG. 88 A and FIG. 88 B. In some cases, a TBK1 compound and a Caspase inhibitor compound can be used to reduce toxicity of double strand DNA, FIG. 89.

A compound can prevent cellular apoptosis and/or pyropoptosis. A compound can also prevent activation of an inflammasome. An inflammasome can be an intracellular multiprotein complex that mediates the activation of the proteolytic enzyme caspase-1 and the maturation of IL-1$\beta$. A compound can also modulate AIM2 (absent in melanoma 2). For example, a compound can prevent AIM2 from associating with the adaptor protein ASC (apoptosis-associated speck-like protein containing a CARD). A compound can also modulate a homotypic PYD:PYD interaction. A compound can also modulate a homotypic CARD:CARD interaction. A compound can modulate Caspase-1. For example, a compound can inhibit a process whereby Caspase-1 converts the inactive precursors of IL-1$\beta$ and IL-18 into mature cytokines.

A compound can be a component of a platform to generate a GMP compatible cellular therapy. A compound can used to improve cellular therapy. A compound can be used as a reagent. A compound can be combined as a combination therapy. A compound can be utilized ex vivo. A compound can be used for immunotherapy. A compound can be a part of a process that generates a T cell therapy for a patient in need, thereof.

In some cases, a compound is not used to reduce toxicity. In some cases, a polynucleic acid can be modified to also reduce toxicity. For example, a polynucleic acid can be modified to reduce detection of a polynucleic acid, e.g., an exogenous polynucleic acid. A polynucleic acid can also be modified to reduce cellular toxicity. For example, a polynucleic acid can be modified by one or more of the methods depicted in FIG. 21. A polynucleic acid can also be modified in vitro or in vivo.

A compound or modifier compound can reduce cellular toxicity of plasmid DNA by or by about 10%, 20%, 30%, 40%, 50%, 60%, 70%, 80%, 90%, or 100%. A modifier compound can improve cellular viability by or by about 10%, 20%, 30%, 40%, 50%, 60%, 70%, 80%, 90%, or 100%.

Unmethylated polynucleic acid can also reduce toxicity. For example, an unmethylated polynucleic acid comprising at least one engineered antigen receptor flanked by at least two recombination arms complementary to at least one genomic region can be used to reduce cellular toxicity. The polynucleic acid can also be naked polynucleic acids. The polynucleic acids can also have mammalian methylation, which in some cases will reduce toxicity as well. In some cases, a polynucleic acid can also be modified so that bacterial methylation is removed and mammalian methylation is introduced. Any of the modifications described herein can apply to any of the polynucleic acids as described herein.

Polynucleic acid modifications can comprise demethylation, addition of CpG methylation, removal of bacterial methylation, and/or addition of mammalian methylation. A modification can be converting a double strand polynucleic acid into a single strand polynucleic acid. A single strand polynucleic acid can also be converted into a double strand polynucleic acid.

A polynucleic acid can be methylated (e.g. Human methylation) to reduce cellular toxicity. The modified polynucleic acid can comprise a TCR sequence or chimeric antigen receptor (CAR). The polynucleic acid can also comprise an engineered extracellular receptor.

Mammalian methylated polynucleic acid comprising at least one engineered antigen receptor can be used to reduce cellular toxicity. A polynucleic acid can be modified to comprise mammalian methylation. A polynucleic acid can be methylated with mammalian methylation so that it is not recognized as foreign by a cell.

Polynucleic acid modifications can also be performed as part of a culturing process. Demethylated polynucleic acid can be produced with genomically modified bacterial cultures that do not introduce bacterial methylation. These polynucleic acids can later be modified to contain mammalian methylation, e.g., human methylation.

Toxicity can also be reduced by introducing viral proteins during a genomic engineering procedure. For example, viral proteins can be used to block DNA sensing and reduce toxicity of a donor nucleic acid encoding for an exogenous TCR or CRISPR system. An evasion strategy employed by a virus to block DNA sensing can be sequestration or modification of a viral nucleic acid; interference with specific post-translational modifications of PRRs or their adaptor proteins; degradation or cleavage of pattern recognition receptors (PRRs) or their adaptor proteins; sequestration or relocalization of PRRs, or any combination thereof. In some cases, a viral protein may be introduced that can block DNA sensing by any of the evasion strategies employed by a virus.

In some cases, a viral protein can be or can be derived from a virus such as Human cytomegalovirus (HCMV), Dengue virus (DENV), Human Papillomavirus Virus (HPV), Herpes Simplex Virus type 1 (HSV1), Vaccinia Virus (VACV), Human corona viruses (HCoVs), Severe acute respiratory syndrome (SARS) corona virus (SARS-Cov), Hepatitis B virus, Porcine epidemic diarrhea virus, or any combination thereof.

An introduced viral protein can prevent RIG-I-like receptors (RLRs) from accessing viral RNA by inducing formation of specific replication compartments that can be confined by cellular membranes, or in other cases to replicate on organelles, such as an endoplasmic reticulum, a Golgi apparatus, mitochondria, or any combination thereof. For example, a virus of the invention can have modifications that prevent detection or hinder the activation of RLRs. In other cases, an RLR signaling pathway can be inhibited. For example, a Lys63-linked ubiquitylation of RIG-I can be inhibited or blocked to prevent activation of RIG-I signaling. In other cases, a viral protein can target a cellular E3 ubiquitin ligase that can be responsible for ubiquitylation of RIG-I. A viral protein can also remove a ubiquitylation of RIG-I. Furthermore, viruses can inhibit a ubiquitylation (e.g., Lys63-linked) of RIG-I independent of protein-protein interactions, by modulating the abundance of cellular microRNAs or through RNA-protein interactions.

In some cases, to prevent activation of RIG-I, viral proteins can process a 5'-triphosphate moiety in the viral RNA, or viral nucleases can digest free double-stranded RNA (dsRNA). Furthermore, viral proteins, can bind to viral RNA to inhibit the recognition of pathogen-associated molecular patterns (PAMPs) by RIG-I. Some viral proteins can manipulate specific post-translational modifications of RIG-I and/or MDA5, thereby blocking their signaling abilities. For example, viruses can prevent the Lys63-linked ubiquitylation of RIG-I by encoding viral deubiquitylating enzymes (DUBs). In other cases, a viral protein can antagonize a cellular E3 ubiquitin ligase, tripartite motif protein 25 (TRIM25) and/or Riplet, thereby also inhibiting RIG-I ubiquitylation and thus its activation. Furthermore, in other cases a viral protein can bind to TRIM25 to block sustained RIG-I signaling. To suppress the activation of MDA5, a viral protein can prevent a PP1α-mediated or PP1γ-mediated dephosphorylation of MDA5, keeping it in its phosphorylated inactive state. For example, a Middle East respiratory syndrome coronavirus (MERS-CoV) can target protein kinase R activator (PACT) to antagonize RIG-I. An NS3 protein from DENV virus can target the trafficking factor 14-3-3ε to prevent translocation of RIG-I to MAVS at the mitochondria. In some cases, a viral protein can cleave RIG-I, MDA5 and/or MAVS. Other viral proteins can be introduced to subvert cellular degradation pathways to inhibit RLR-MAVS-dependent signaling. For example, an X protein from hepatitis B virus (HBV) and the 9b protein from severe acute respiratory syndrome (SARS)-associated coronavirus (SARS-CoV) can promote the ubiquitylation and degradation of MAVS.

In some cases, an introduced viral protein can allow for immune evasion of cGAS, IFI16, STING, or any combination thereof. For example, to prevent activation of cyclic GMP-AMP synthase (cGAS), a viral protein can use the cellular 3'-repair exonuclease 1 (TREX1) to degrade excess reverse transcribed viral DNA. In addition, the a viral capsid can recruit host-encoded factors, such as cyclophilin A (CYPA), which can prevent the sensing of reverse transcribed DNA by cGAS. Furthermore, an introduced viral protein can bind to both viral DNA and cGAS to inhibit the activity of cGAS. In other cases, to antagonize the activation of stimulator of interferon (IFN) genes (STING), the polymerase (Pol) of hepatitis B virus (HBV) and the papain-like proteases (PLPs) of human coronavirus NL63 (HCoV-NL63), severe acute respiratory syndrome (SARS)-associated coronavirus (SARS-CoV) for example, can prevent or remove the Lys63-linked ubiquitylation of STING. An introduced viral protein can also bind to STING and inhibit its activation or cleave STING to inactivate it. In some cases, IFI16 can be inactivated. For example, a viral protein can target IFI16 for proteasomal degradation or bind to IFI16 to prevent its oligomerization and thus its activation.

For example, a viral protein to be introduced can be or can be derived from: HCMV pUL83, DENV NS2B-NS3, HPV18 E7, hAd5 E1A, HSV1 ICP0, VACV B13, VACV C16, TREX1, HCoV-NL63, SARS-Cov, HBV Pol PEDV, or any combination thereof. A viral protein can be adenoviral. Adenoviral proteins can be adenovirus 4 E1B55K, E4orf6 protein. A viral protein can be a B13 vaccine virus protein. Viral proteins that are introduced can inhibit cytosolic DNA recognition, sensing, or a combination.

In some cases, a RIP pathway can be inhibited. In other cases, a cellular FLICE (FADD-like IL-1beta-converting enzyme)-inhibitory protein (c-FLIP) pathway can be introduced to a cell. c-FLIP can be expressed as long (c-FLIPL), short (c-FLIPS), and c-FLIPR splice variants in human cells. c-FLIP can be expressed as a splice variant. c-FLIP can also be known as Casper, iFLICE, FLAME-1, CASH, CLARP, MRIT, or usurpin. c-FLIP can bind to FADD and/or caspase-8 or -10 and TRAIL receptor 5 (DR5). This interaction in turn prevents Death-Inducing Signaling Complex (DISC) formation and subsequent activation of the caspase cascade. c-FLIPL and c-FLIPS are also known to have multifunctional roles in various signaling pathways, as well as activating and/or upregulating several cytoprotective and pro-survival signaling proteins including Akt, ERK, and NF-κB. In some cases, c-FLIP can be introduced to a cell to increase viability.

In other cases, STING can be inhibited. In some cases, a caspase pathway is inhibited. A DNA sensing pathway can be a cytokine-based inflammatory pathway and/or an interferon alpha expressing pathway. In some cases, a multimodal approach is taken where at least one DNA sensing pathway inhibitor is introduced to a cell. In some cases, an inhibitor of DNA sensing can reduce cell death and allow for improved integration of an exogenous TCR transgene. A multimodal approach can be a STING and Caspase inhibitor in combination with a TBK inhibitor.

To enhance HDR, enabling the insertion of precise genetic modifications, we suppressed the NHEJ key molecules KU70, KU80 or DNA ligase IV by gene silencing, the ligase IV inhibitor SCR7 or the coexpression of adenovirus 4 E1B55K and E4orf6 proteins.

An introduced viral protein can reduce cellular toxicity of plasmid DNA by or by about 10%, 20%, 30%, 40%, 50%, 60%, 70%, 80%, 90%, or 100%. A viral protein can improve cellular viability by or by about 10%, 20%, 30%, 40%, 50%, 60%, 70%, 80%, 90%, or 100%.

In some cases, gRNA can be used to reduce toxicity. For example, a gRNA can be engineered to bind within a filler region of a vector. A vector can be a minicircle DNA vector. In some cases, a minicircle vector can be used in conjunction with a viral protein. In other cases, a minicircle vector can be used in conjunction with a viral protein and at least one additional toxicity reducing agent. In some cases, by reducing toxicity associated with exogenous DNA, such as double strand DNA, genomic disruptions can be performed more efficiently.

In some cases, an enzyme can be used to reduce DNA toxicity. For example, an enzyme such as DpnI can be utilized to remove methylated targets on a DNA vector or transgene. A vector or transgene can be pre-treated with DpnI prior to electroporation. Type IIM restriction endonucleases, such as DpnI, are able to recognize and cut methylated DNA. In some cases, a minicircle DNA is treated with DpnI. Naturally occurring restriction endonucleases are categorized into four groups (Types I, II III, and IV). In some cases, a restriction endonuclease, such as DpnI or a CRISPR system endonuclease is utilized to prepare engineered cells.

Disclosed herein, is a method of making an engineered cell comprising: introducing at least one engineered adenoviral protein or functional portion thereof; introducing at least one polynucleic acid encoding at least one exogenous receptor sequence; and genomically disrupting at least one genome with at least one endonuclease or portion thereof. In some cases, an adenoviral protein or function portion thereof is E1B55K, E4orf6, Scr7, L755507, NS2B3, HPV18 E7, hAd5 E1A, or a combination thereof. An adenoviral protein can be selected from a serotype 1 to 57. In some cases, an adenoviral protein serotype is serotype 5.

In some cases, an engineered adenoviral protein or portion thereof has at least one modification. A modification can be a substitution, insertion, deletion, or modification of a sequence of said adenoviral protein. A modification can be an insertion. An insertion can be a AGIPA insertion. In some cases, a modification is a substitution. A substitution can be a H to A at amino acid position 373 of a protein sequence. A polynucleic acid can be DNA or RNA. A polynucleic acid can be DNA. DNA can be minicircle DNA. In some cases, an exogenous receptor sequence can be selected from the group consisting of a sequence of a T cell receptor (TCR), a 13 cell receptor (BCR), a chimeric antigen receptor (CAR), and any portion or derivative thereof. An exogenous receptor sequence can be a TCR sequence. An endonuclease can be selected from the group consisting of CRISPR, TALEN, transposon-based, ZEN, meganuclease, Mega-TAL, and any portion or derivative thereof. An endonuclease can be CRISPR. CRISPR can comprise at least one Cas protein. A Cas protein can be selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, homologues thereof or modified versions thereof. A Cas protein can be Cas9.

In some cases, CRISPR creates a double strand break in a genome. A genome can comprise at least one gene. In some cases, an exogenous receptor sequence is introduced into at least one gene. An introduction can disrupt at least one gene. A gene can be CISH, PD-1, TRA, TRB, or a combination thereof. A cell can be human. A human cell can be immune. An immune cell can be CD3+, CD4+, CD8+ or any combination thereof. A method can further comprise expanding a cell.

Disclosed herein, is a method of making an engineered cell comprising: virally introducing at least one polynucleic acid encoding at least one exogenous T cell receptor (TCR) sequence; and genomically disrupting at least one gene with at least one endonuclease or functional portion thereof. In some cases, a virus can be selected from retrovirus, lentivirus, adenovirus, adeno-associated virus, or any derivative thereof. A virus can be an adeno-associated virus (AAV). An AAV can be serotype 5. An AAV can comprise at least one modification. A modification can be a chemical modification. A polynucleic acid can be DNA, RNA, or any modification thereof. A polynucleic acid can be DNA. In some cases, DNA is minicircle DNA. In some cases, a polynucleic acid can further comprise at least one homology arm flanking a TCR sequence. A homology arm can comprise a complementary sequence at least one gene. A gene can be an endogenous gene. An endogenous gene can be a checkpoint gene.

In some cases, a method can further comprise at least one toxicity reducing agent. A toxicity reducing agent can be a viral protein or an inhibitor of the cytosolic DNA sensing pathway. A viral protein can be E1B55K, E4orf6, Scr7, L755507, NS2B3, HPV18 E7, hAd5 E1A, or a combination thereof. A method can further comprise expansion of cells. In some cases, an inhibitor of the cytosolic DNA sensing pathway can be used. An inhibitor of the cytosolic DNA sensing pathway can be cellular FLICE (FADD-like IL-1β-converting enzyme)-inhibitory protein (c-FLIP).

Cell viability and/or the efficiency of integration of a transgene into a genome of one or more cells may be measured using any method known in the art. In some cases, cell viability and/or efficiency of integration may be measured using trypan blue exclusion, terminal deoxynucleotidyl transferase dUTP nick end labeling (TUNEL), the presence or absence of given cell-surface markers (e.g., CD4 or CD8), telomere length, fluorescence-activated cell sorting (FACS), real-time PCR, or droplet digital PCR. For example, FACS may be used to detect the efficiency of integration of a transgene following electroporation. In another example, apoptosis of may be measured using TUNEL.

Delivery of Non-Viral Vector into Cell Membrane

The nucleases and transcription factors, polynucleotides encoding same, and/or any transgene polynucleotides and compositions comprising the proteins and/or polynucleotides described herein can be delivered to a target cell by any suitable means.

Suitable cells can include but are not limited to eukaryotic and prokaryotic cells and/or cell lines. Non-limiting examples of such cells or cell lines generated from such cells include COS, CHO (e.g., CHO-S, CHO-K1, CHO-DG44, CHO-DUXB11, CHO-DUKX, CHOK1SV), VERO, MDCK, WI38, V79, B14AF28-G3, BHK, HaK, NSO, SP2/0-Ag14, HeLa, HEK293 (e.g., HEK293-F, HEK293-H, HEK293-T), and perC6 cells as well as insect cells such as Spodopterafugiperda (Sf), or fungal cells such as *Saccharomyces, Pichia* and *Schizosaccharomyces*. In some cases, the cell line is a CHO-K1, MDCK or HEK293 cell line. In some cases, suitable primary cells include peripheral blood mononuclear cells (PBMC), peripheral blood lymphocytes (PBL), and other blood cell subsets such as, but not limited to, T cell, a natural killer cell, a monocyte, a natural killer T cell, a monocyte-precursor cell, a hematopoietic stem cell or a non-pluripotent stem cell. In some cases, the cell can be any immune cells including any T-cell such as tumor infiltrating cells (TILs), such as CD3+ T-cells, CD4+ T-cells, CD8+ T-cells, or any other type of T-cell. The T cell can also include memory T cells, memory stem T cells, or effector T cells. The T cells can also be selected from a bulk population, for example, selecting T cells from whole blood. The T cells can also be expanded from a bulk population. The T cells can also be skewed towards particular populations and phenotypes. For example, the T cells can be skewed to phenotypically comprise, CD45RO(−), CCR7(+), CD45RA (+), CD62L(+), CD27(+), CD28(+) and/or IL-7Rα(+). Suitable cells can be selected that comprise one of more markers selected from a list comprising: CD45RO(−), CCR7(+), CD45RA(+), CD62L(+), CD27(+), CD28(+) and/or IL-7Rα (+). Suitable cells also include stem cells such as, by way of example, embryonic stem cells, induced pluripotent stem cells, hematopoietic stem cells, neuronal stem cells and mesenchymal stem cells. Suitable cells can comprise any number of primary cells, such as human cells, non-human cells, and/or mouse cells. Suitable cells can be progenitor cells. Suitable cells can be derived from the subject to be treated (e.g., patient). Suitable cells can be derived from a human donor. Suitable cells can be stem memory $T_{SCM}$ cells comprised of CD45RO (−), CCR7(+), CD45RA (+), CD62L+(L-selectin), CD27+, CD28+ and IL-7Rα+, stem memory cells can also express CD95, IL-2Rβ, CXCR3, and LFA-1, and show numerous functional attributes distinctive of stem memory cells. Suitable cells can be central memory $T_{CM}$ cells comprising L-selectin and CCR7, central memory cells can secrete, for example, IL-2, but not IFNγ or IL-4. Suitable cells can also be effector memory $T_{EM}$ cells comprising L-selectin or CCR7 and produce, for example, effector cytokines such as IFNγ and IL-4.

A method of attaining suitable cells can comprise selecting cells. In some cases, a cell can comprise a marker that can be selected for the cell. For example, such marker can comprise GFP, a resistance gene, a cell surface marker, an endogenous tag. Cells can be selected using any endogenous marker. Suitable cells can be selected using any technology. Such technology can comprise flow cytometry and/or magnetic columns. The selected cells can then be infused into a subject. The selected cells can also be expanded to large numbers. The selected cells can be expanded prior to infusion.

The transcription factors and nucleases as described herein can be delivered using vectors, for example containing sequences encoding one or more of the proteins. Transgenes encoding polynucleotides can be similarly delivered. Any vector systems can be used including, but not limited to, plasmid vectors, retroviral vectors, lentiviral vectors, adenovirus vectors, poxvirus vectors; herpesvirus vectors and adeno-associated virus vectors, etc. Furthermore, any of these vectors can comprise one or more transcription factor, nuclease, and/or transgene. Thus, when one or more CRISPR, TALEN, transposon-based, ZEN, meganuclease, or Mega-TAL molecules and/or transgenes are introduced into the cell, CRISPR, TALEN, transposon-based, ZEN, meganuclease, or Mega-TAL molecules and/or transgenes can be carried on the same vector or on different vectors. When multiple vectors are used, each vector can comprise a sequence encoding one or multiple CRISPR, TALEN, transposon-based, ZEN, meganuclease, or Mega-TAL molecules and/or transgenes.

Conventional viral and non-viral based gene transfer methods can be used to introduce nucleic acids encoding engineered CRISPR, TALEN, transposon-based, ZEN, meganuclease, or Mega-TAL molecules and/or transgenes in cells (e.g., mammalian cells) and target tissues. Such methods can also be used to administer nucleic acids encoding CRISPR, TALEN, transposon-based, ZEN, meganuclease, or Mega-TAL molecules and/or transgenes to cells in vitro. In some examples, nucleic acids encoding CRISPR, TALEN, transposon-based, ZEN, meganuclease, or Mega-TAL molecules and/or transgenes can be administered for in vivo or ex vivo immunotherapy uses. Non-viral vector delivery systems can include DNA plasmids, naked nucleic acid, and nucleic acid complexed with a delivery vehicle such as a liposome or poloxamer. Viral vector delivery systems can include DNA and RNA viruses, which have either episomal or integrated genomes after delivery to the cell.

Methods of non-viral delivery of nucleic acids include electroporation, lipofection, nucleofection, gold nanoparticle delivery, microinjection, biolistics, virosomes, liposomes, immunoliposomes, polycation or lipid: nucleic acid conjugates, naked DNA, mRNA, artificial virions, and agent-enhanced uptake of DNA. Sonoporation using, e.g., the Sonitron 2000 system (Rich-Mar) can also be used for delivery of nucleic acids.

Additional exemplary nucleic acid delivery systems include those provided by AMAXA® Biosystems (Cologne, Germany), Life Technologies (Frederick, Md.), MAX-CYTE, Inc. (Rockville, Md.), BTX Molecular Delivery Systems (Holliston, Mass.) and Copernicus Therapeutics Inc. (see for example U.S. Pat. No. 6,008,336). Lipofection reagents are sold commercially (e.g., TRANSFECTAM® and LIPOFECTIN®). Delivery can be to cells (ex vivo administration) or target tissues (in vivo administration). Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis.

Vectors including viral and non-viral vectors containing nucleic acids encoding engineered CRISPR, TALEN, transposon-based, ZEN, meganuclease, or Mega-TAL molecules, transposon and/or transgenes can also be administered directly to an organism for transduction of cells in vivo. Alternatively, naked DNA or mRNA can be administered. Administration is by any of the routes normally used for introducing a molecule into ultimate contact with blood or tissue cells including, but not limited to, injection, infusion, topical application and electroporation. More than one route can be used to administer a particular composition. Pharmaceutically acceptable carriers are determined in part by the particular composition being administered, as well as by the particular method used to administer the composition.

In some cases, a vector encoding for an exogenous TCR can be shuttled to a cellular nuclease. For example, a vector can contain a nuclear localization sequence (NLS). A vector can also be shuttled by a protein or protein complex. In some cases, Cas9 can be used as a means to shuttle a minicircle vector. Cas can comprise a NLS. In some cases, a vector can be pre-complexed with a Cas protein prior to electroporation. A Cas protein that can be used for shuttling can be a nuclease-deficient Cas9 (dCas9) protein. A Cas protein that can be used for shuttling can be a nuclease-competent Cas9. In some cases, Cas protein can be pre-mixed with a guide RNA and a plasmid encoding an exogenous TCR.

Certain aspects disclosed herein can utilize vectors. For example, vectors that can be used include, but not limited to, Bacterial: pBs, pQE-9 (Qiagen), phagescript, PsiX174, pBluescript SK, pBsKS, pNH8a, pNH16a, pNH18a, pNH46a (Stratagene); pTrc99A, pKK223-3, pKK233-3, pDR540, pRIT5 (Pharmacia). Eukaryotic: pWL-neo, pSv2cat, pOG44, pXT1, pSG (Stratagene) pSVK3, pBPv, pMSG, pSVL (Pharmiacia). Also, any other plasmids and vectors can be used as long as they are replicable and viable in a selected host. Any vector and those commercially available (and variants or derivatives thereof) can be engineered to include one or more recombination sites for use in the methods. Such vectors can be obtained from, for example, Vector Laboratories Inc., Invitrogen, Promega, Novagen, NEB, Clontech, Boehringer Mannheim, Pharmacia, EpiCenter, OriGenes Technologies Inc., Stratagene, PerkinElmer, Pharmingen, and Research Genetics. Other vectors of interest include eukaryotic expression vectors such as pFastBac, pFastBacHT, pFastBacDUAL, pSFV, and pTet-Splice (Invitrogen), pEUK-C1, pPUR, pMAM, pMAMneo, pBI101, pBI121, pDR2, pCMVEBNA, and pYACneo (Clontech), pSVK3, pSVL, pMSG, pCH110, and pKK232-8 (Pharmacia, Inc.), p3'SS, pXT1, pSG5, pPbac, pMbac, pMClneo, and pOG44 (Stratagene, Inc.), pYES2, pAC360, pBlueBa-cHis A, B, and C, pVL1392, pBlueBacI11, pCDM8, pcDNA1, pZeoSV, pcDNA3 pREP4, pCEP4, and pEBVHis (Invitrogen, Corp.), and variants or derivatives thereof. Other vectors include pUC18, pUC19, pBlueScript, pSPORT, cosmids, phagemids, YAC's (yeast artificial chromosomes), BAC's (bacterial artificial chromosomes), P1 (*Escherichia coli* phage), pQE70, pQE60, pQE9 (quagan), pBS vectors, PhageScript vectors, BlueScript vectors, pNH8A, pNH16A, pNH18A, pNH46A (Stratagene), pcDNA3 (Invitrogen), pGEX, pTrsfus, pTrc99A, pET-5, pET-9, pKK223-3, pKK233-3, pDR540, pRIT5 (Pharmacia), pSPORT1, pSPORT2, pCMVSPORT2.0 and pSYSPORT1 (Invitrogen) and variants or derivatives thereof. Additional vectors of interest can also include pTrxFus, pThioHis, pLEX, pTrcHis, pTrcHis2, pRSET, pBlueBa-cHis2, pcDNA3.1/His, pcDNA3.1(−)/Myc-His, pSecTag, pEBVHis, pPIC9K, pPIC3.5K, pA081S, pPICZ, pPICZA, pPICZB, pPICZC, pGAPZA, pGAPZB, pGAPZC, pBlue-Bac4.5, pBlueBa-cHis2, pMelBac, pSinRep5, pSinHis, pIND, pIND(SP1), pVgRXR, pcDNA2.1, pYES2, pZErO1.1, pZErO-2.1, pCR-Blunt, pSE280, pSE380, pSE420, pVL1392, pVL1393, pCDM8, pcDNA1.1, pcDNA1.1/Amp, pcDNA3.1, pcDNA3.1/Zeo, pSe, SV2, pRc/CMV2, pRc/RSV, pREP4, pREP7, pREP8, pREP9, pREP 10, pCEP4, pEBVHis, pCR3.1, pCR2.1, pCR3.1-Uni, and pCRBac from Invitrogen; X ExCell, X gt11, pTrc99A, pKK223-3, pGEX-1X T, pGEX-2T, pGEX-2TK, pGEX-4T-1, pGEX-4T-2, pGEX-4T-3, pGEX-3X, pGEX-5X-1, pGEX-5X-2, pGEX-5X-3, pEZZ18, pRIT2T, pMC1871, pSVK3, pSVL, pMSG, pCH110, pKK232-8, pSL1180, pNEO, and pUC4K from Pharmacia; pSCREEN-1b(+), pT7B1ue(R), pT7Blue-2, pCITE-4-abc(+), pOCUS-2, pTAg, pET-32L1C, pET-30LIC, pBAC-2 cp LIC, pBACgus-2 cp LIC, pT7Blue-2 LIC, pT7Blue-2, X SCREEN-1, X BlueSTAR, pET-3abcd, pET-7abc, pET9abcd, pET11 abed, pET12abc, pET-14b, pET-15b, pET-16b, pET-17b-pET-17xb, pET-19b, pET-20b (+), pET-21abcd(+), pET-22b(+), pET-23abcd(+), pET-24abcd (+), pET-25b(+), pET-26b(+), pET-27b(+), pET-28abc(+), pET-29abc(+), pET-30abc(+), pET-31b(+), pET-32abc(+), pET-33b(+), pBAC-1, pBACgus-1, pBAC4x-1, pBACgus4x-1, pBAC-3 cp, pBACgus-2 cp, pBACsurf-1, plg, Signal plg, pYX, Selecta Vecta-Neo, Selecta Vecta-Hyg, and Selecta Vecta-Gpt from Novagen; pLexA, pB42AD, pGBT9, pAS2-1, pGAD424, pACT2, pGAD GL, pGAD GH, pGAD 10, pGilda, pEZM3, pEGFP, pEGFP-1, pEG-FPN, pEGFP-C, pEBFP, pGFPuv, pGFP, p6xHis-GFP ("6xHis" disclosed as SEQ ID NO: 161), pSEAP2-Basic, pSEAP2-Contral, pSEAP2-Promoter, pSEAP2-Enhancer, p I3gal-Basic, pl3gal-Control, p I3 gal-Promoter, p I3 gal-Enhancer, pCMV, pTet-Off, pTet-On, pTK-Hyg, pRetro-Off, pRetro-On, pIRES1neo, pIRES1hyg, pLXSN, pLNCX, pLAPSN, pMAMneo, pMAMneo-CAT, pMAMneo-LUC, pPUR, pSV2neo, pYEX4T-1/2/3, pYEX-S1, pBacPAK-His, pBac-PAK8/9, pAcUW31, BacPAK6, pTriplEx, 2Xgt10, Xgt11, pWE15, and X TriplEx from Clontech; Lambda ZAP II, pBK-CMV, pBK-RSV, pBluescript II KS+/−, pBluescript II SK+/−, pAD-GAL4, pBD-GAL4 Cam, pSurfscript, Lambda FIX II, Lambda DASH, Lambda EMBL3, Lambda EMBL4, SuperCos, pCR-Scrigt Amp, pCR-Script Cam, pCR-Script Direct, pBS+/−, pBC KS+/−, pBC SK+/−, Phagescript, pCAL-n-EK, pCAL-n, pCAL-c, pCAL-kc, pET-3abcd, pET-llabcd, pSPUTK, pESP-1, pCMVLacI, pOPRSVI/MCS, pOPI3 CAT, pXT1, pSG5, pPbac, pMbac, pMClneo, pMCineo Poly A, pOG44, p0G45, pFRTI3GAL, pNE0I3GAL, pRS403, pRS404, pRS405, pRS406, pRS413, pRS414, pRS415, and pRS416 from Stratagene, pPC86, pDBLeu, pDBTrp, pPC97, p2.5, pGAD1-3, pGAD10, pACt, pACT2, pGADGL, pGADGH, pAS2-1, pGAD424, pGBT8, pGBT9, pGAD-GAL4, pLexA, pBD-GAL4, pHISi, pHISi-1, placZi, pB42AD, pDG202, pJK202, pJG4-5, pNLexA, pYESTrp, and variants or derivatives thereof.

These vectors can be used to express a gene, e.g., a transgene, or portion of a gene of interest. A gene of portion or a gene can be inserted by using any method For example; a method can be a restriction enzyme-based technique.

Figure 43:
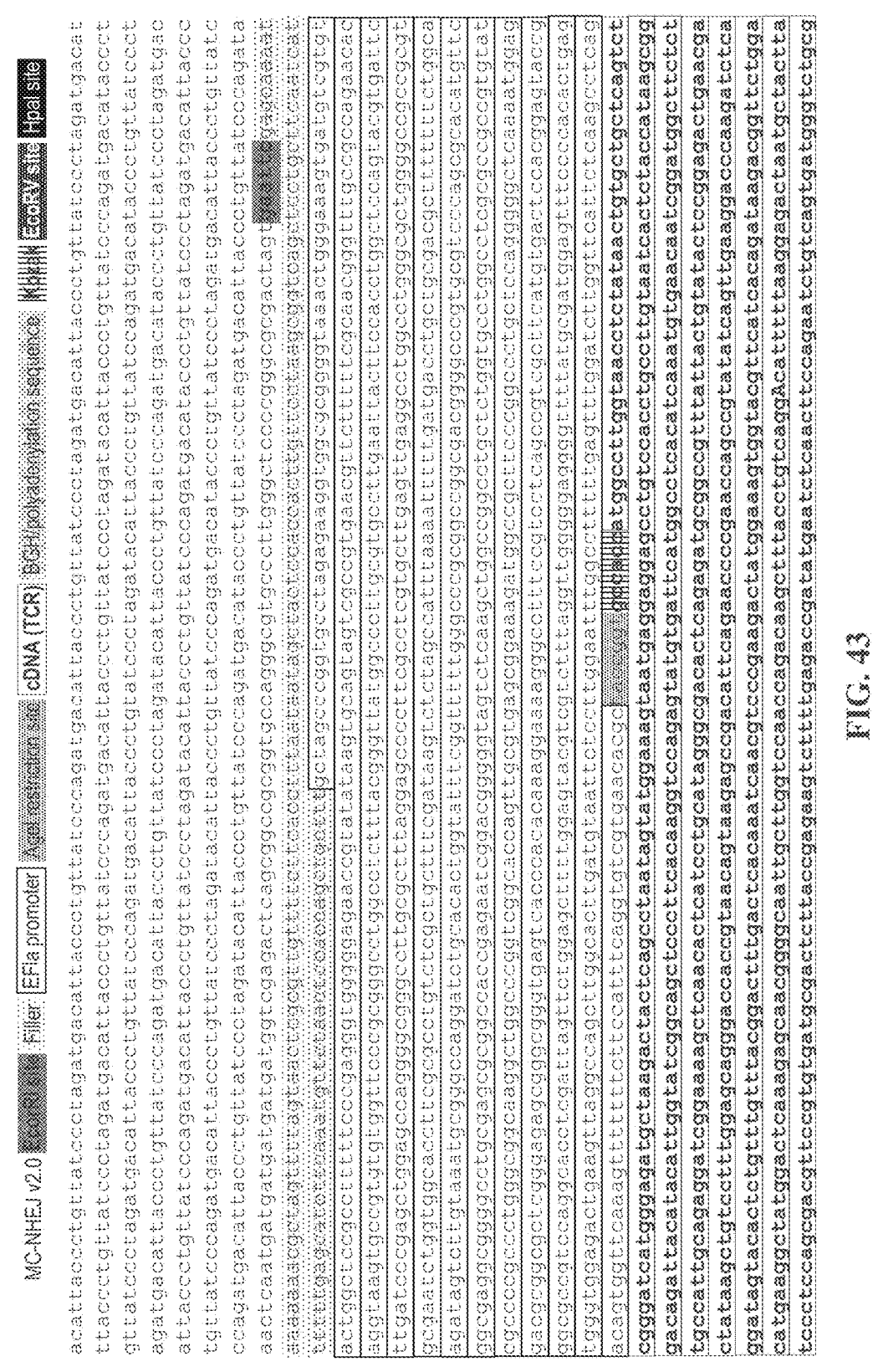
Figure 43:
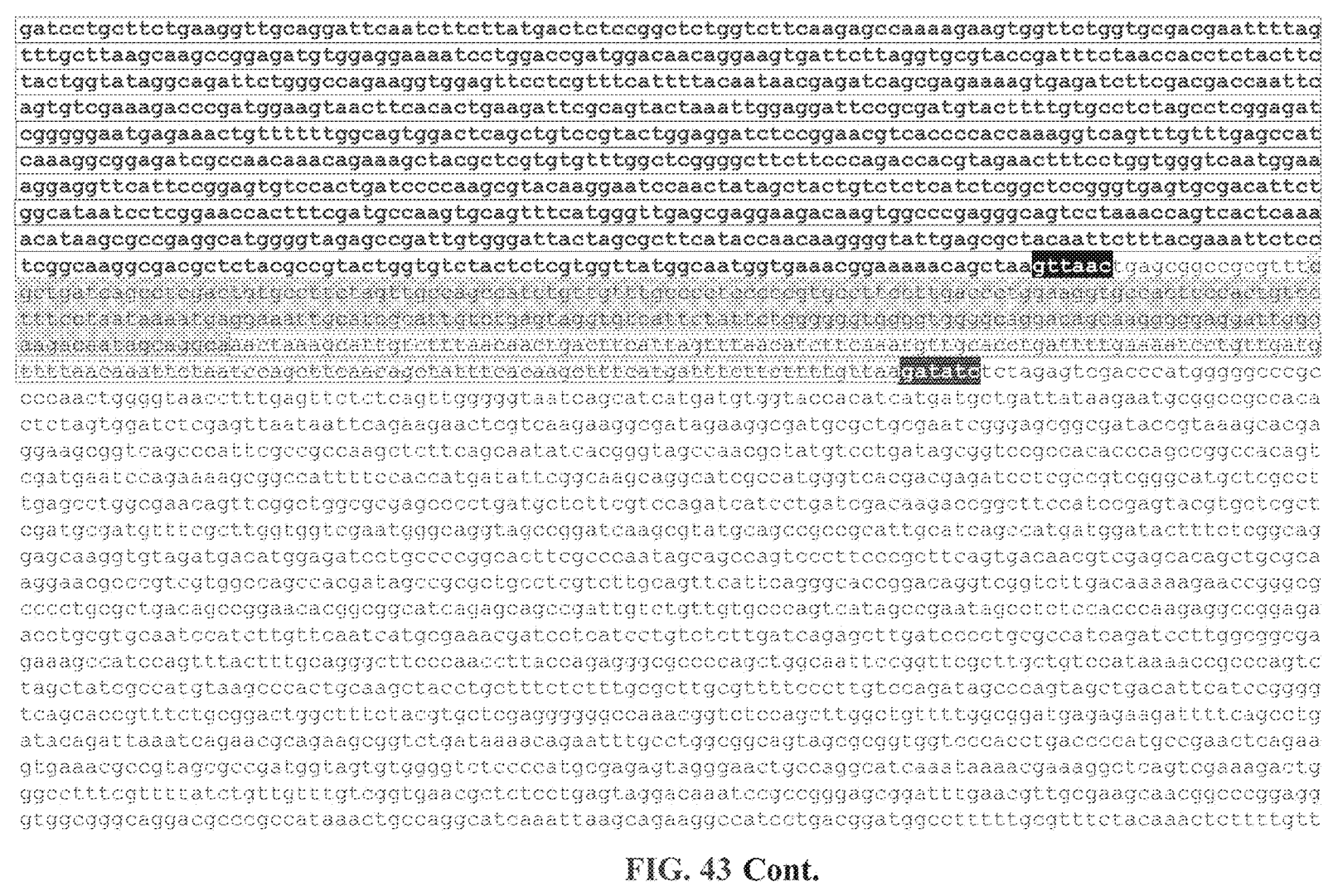

Vectors can be delivered in vivo by administration to an individual patient, typically by systemic administration (e.g., intravenous, intraperitoneal, intramuscular, subdermal, or intracranial infusion) or topical application, as described below. Alternatively, vectors can be delivered to cells ex vivo, such as cells explanted from an individual patient (e.g., lymphocytes, T cells, bone marrow aspirates, tissue biopsy), followed by reimplantation of the cells into a patient, usually after selection for cells which have incorporated the vector. Prior to or after selection, the cells can be expanded. A vector can be a minicircle vector, FIG. 43.

Figure 73:
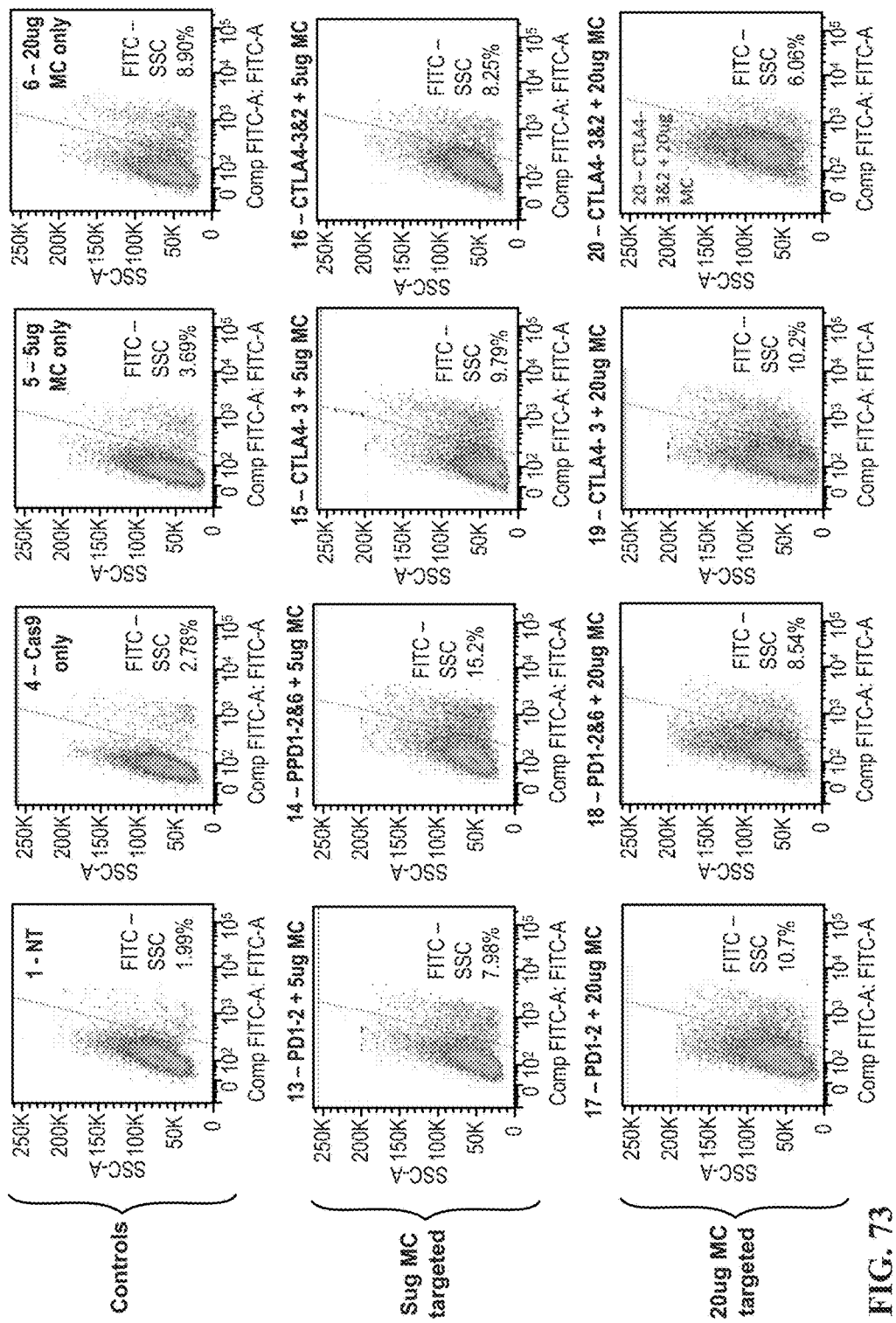
FIG. 73 shows FACs analysis of day 7 TCR beta detection in control cells, cells electroporated with 5 micrograms of donor DNA (minicircle), or cells electroporated with 20 micrograms of donor DNA (minicircle).
Figure 74:
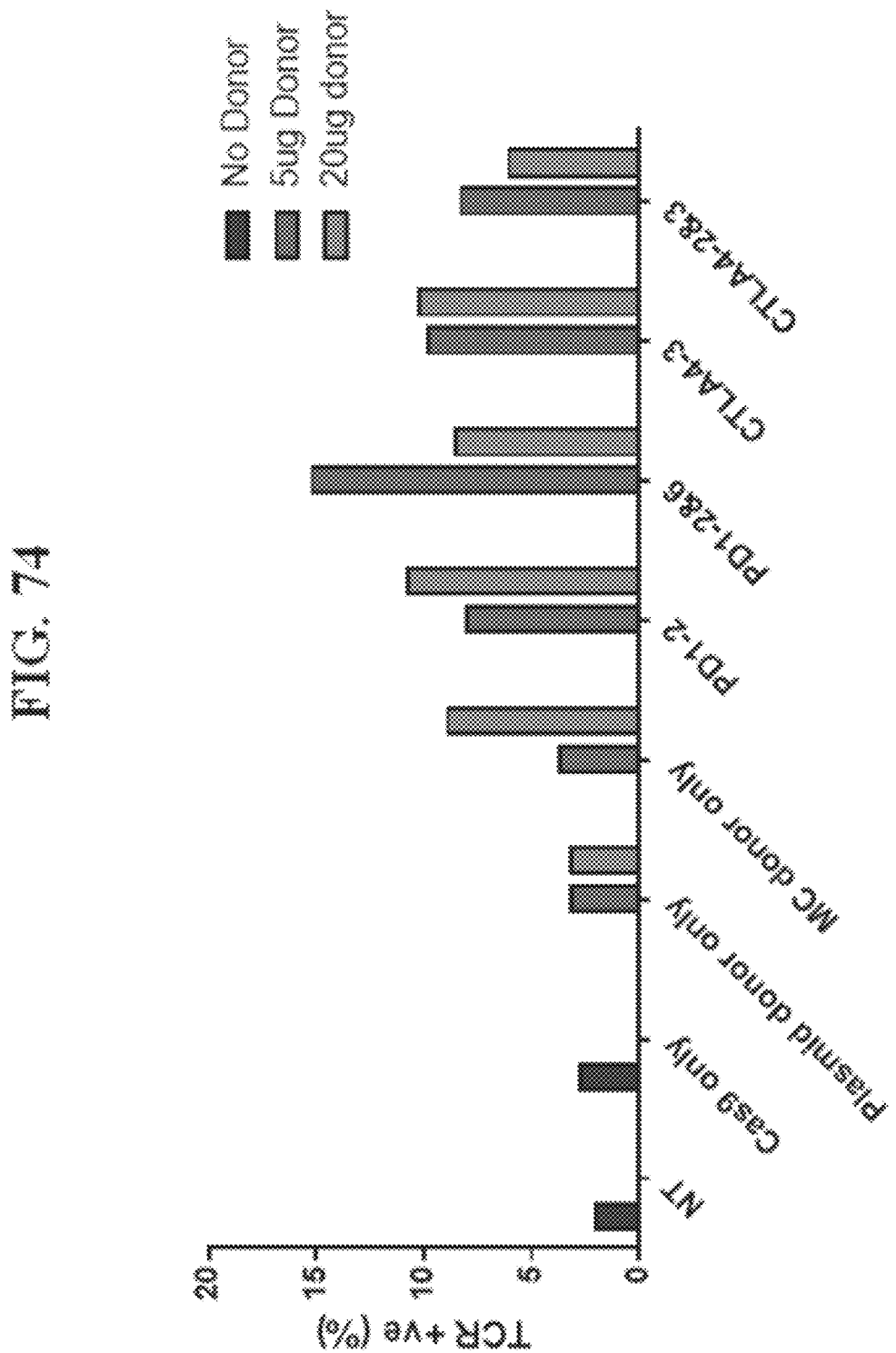
FIG. 74 shows a summary of day 7 T cells electroporated with the CRISPR system and either no polynucleic acid donor (control), 5 micrograms of polynucleic acid donor (minicircle), or 20 micrograms of polynucleic acid donor (minicircle). A summary of FACs analysis of TCR positive cells is shown.
Figure 75:
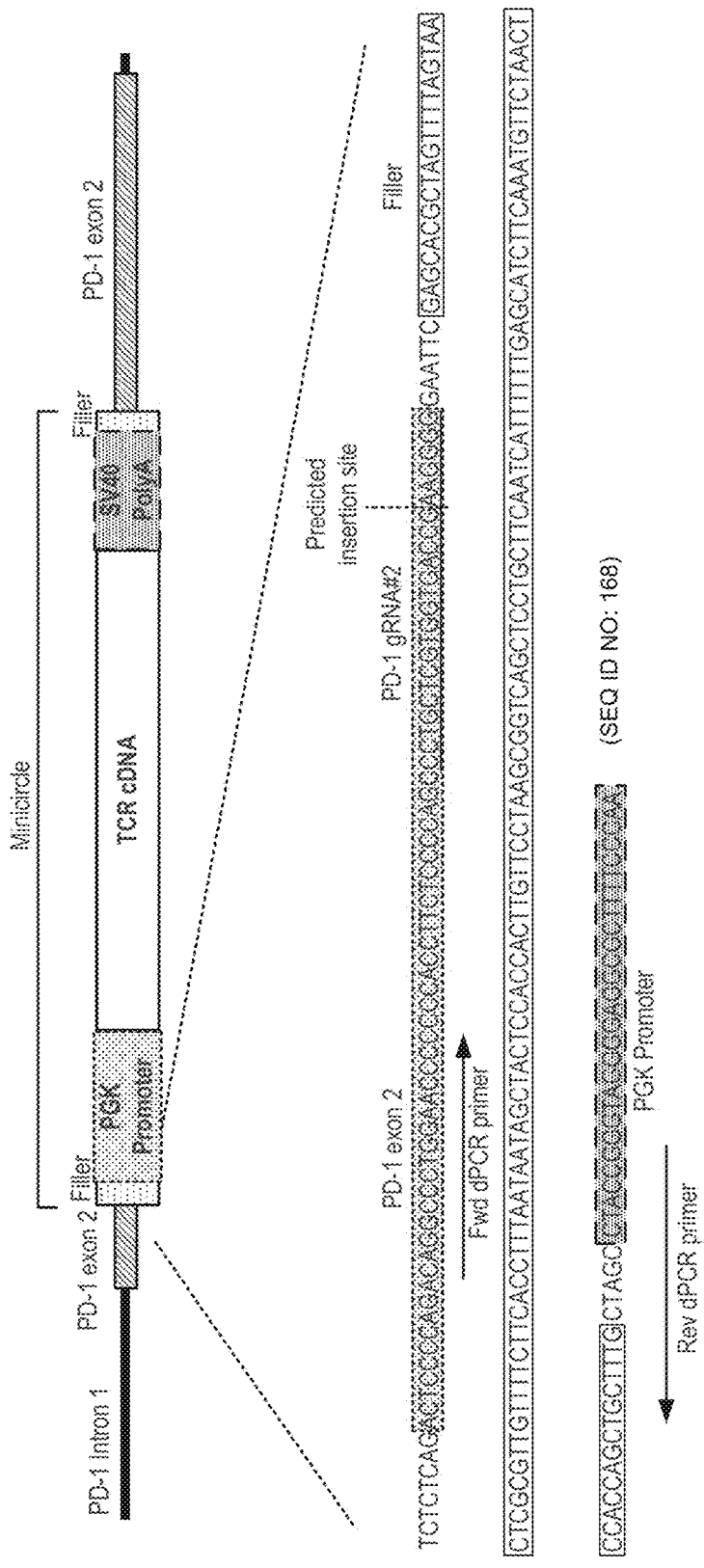
FIG. 75 shows integration of the TCR minicircle in the forward direction into the PD1 gRNA#2 cut site (SEQ ID NO: 168).
Figure 78:
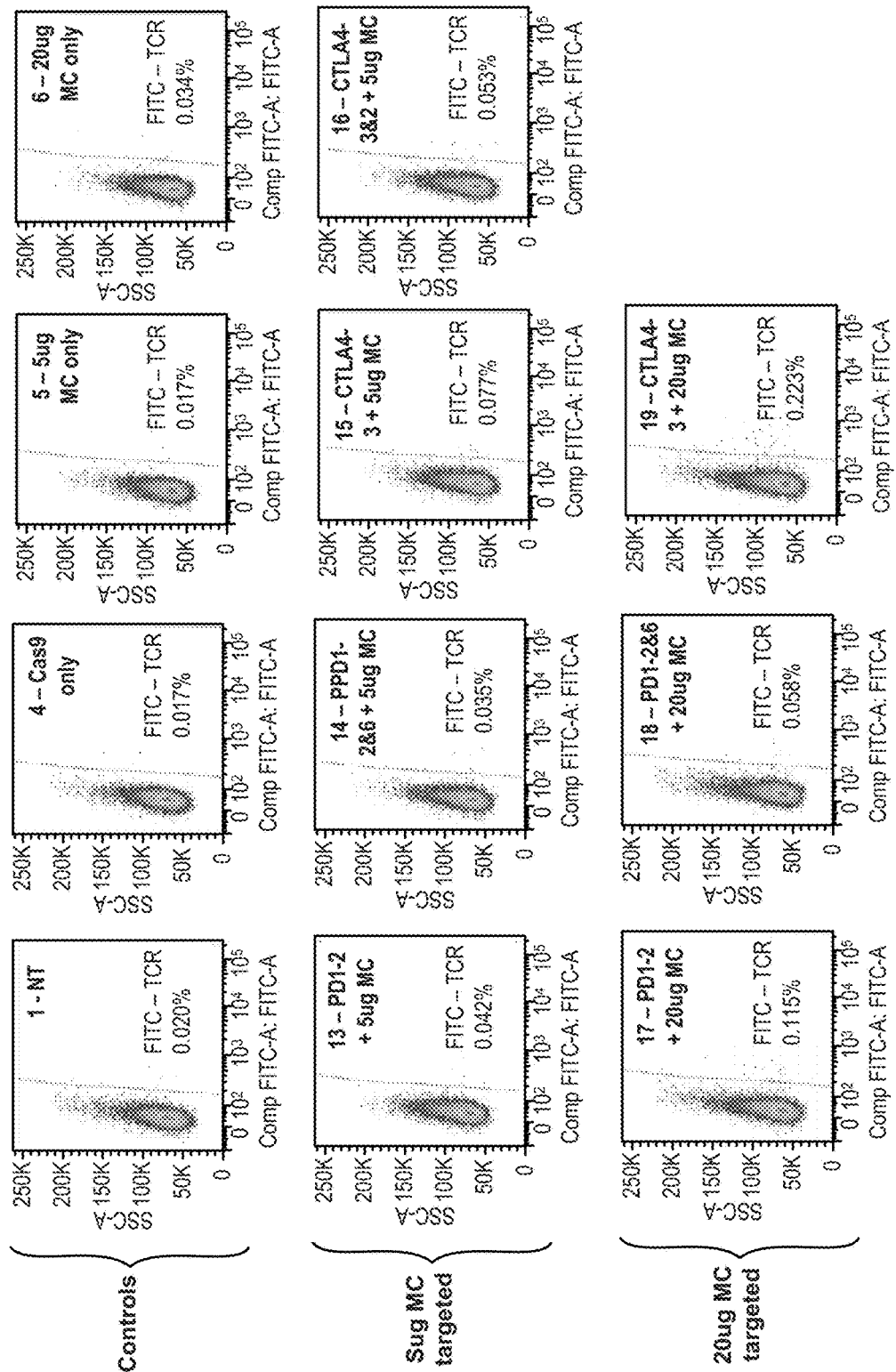
FIG. 78 shows day 15 FACs analysis of human T cells transfected with CRISPR and 5 micrograms or 20 micrograms of minicircle DNA encoding for an exogenous TCR.
Figure 79:
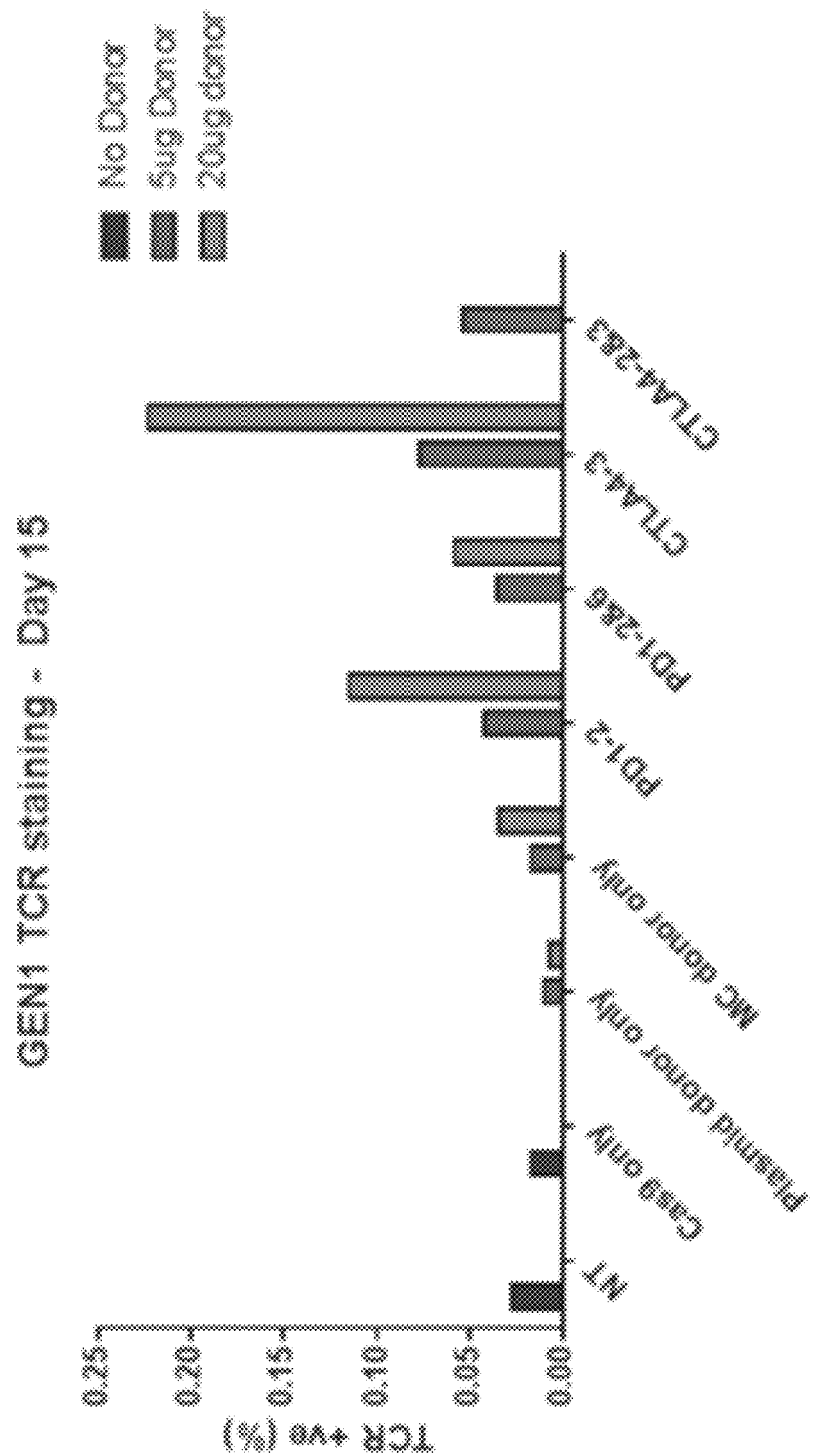
FIG. 79 shows a summary of day 15 T cells electroporated with the CRISPR system and either no polynucleic acid donor (control), 5 micrograms of polynucleic acid donor (minicircle), or 20 micrograms of polynucleic acid donor (minicircle). A summary of FACs analysis of TCR positive cells is shown.

A cell can be transfected with a minicircle vector and a CRISPR system. A minicircle vector concentration can be from 0.5 nanograms to 50 micrograms. In some cases, the amount of nucleic acid (e.g., ssDNA, dsDNA, RNA) that may be introduced into the cell by electroporation may be varied to optimize transfection efficiency and/or cell viability. In some cases, less than about 100 picograms of nucleic acid may be added to each cell sample (e.g., one or more cells being electroporated). In some cases, at least about 100 picograms, at least about 200 picograms, at least about 300 picograms, at least about 400 picograms, at least about 500 picograms, at least about 600 picograms, at least about 700 picograms, at least about 800 picograms, at least about 900 picograms, at least about 1 microgram, at least about 1.5 micrograms, at least about 2 micrograms, at least about 2.5 micrograms, at least about 3 micrograms, at least about 3.5 micrograms, at least about 4 micrograms, at least about 4.5 micrograms, at least about 5 micrograms, at least about 5.5 micrograms, at least about 6 micrograms, at least about 6.5 micrograms, at least about 7 micrograms, at least about 7.5 micrograms, at least about 8 micrograms, at least about 8.5 micrograms, at least about 9 micrograms, at least about 9.5 micrograms, at least about 10 micrograms, at least about 11 micrograms, at least about 12 micrograms, at least about 13 micrograms, at least about 14 micrograms, at least about 15 micrograms, at least about 20 micrograms, at least about 25 micrograms, at least about 30 micrograms, at least about 35 micrograms, at least about 40 micrograms, at least about 45 micrograms, or at least about 50 micrograms, of nucleic acid may be added to each cell sample (e.g., one or more cells being electroporated). For example, 1 microgram of dsDNA may be added to each cell sample for electroporation. In some cases, the amount of nucleic acid (e.g., dsDNA) required for optimal transfection efficiency and/or cell viability may be specific to the cell type. In some cases, the amount of nucleic acid (e.g., dsDNA) used for each sample may directly correspond to the transfection efficiency and/or cell viability. For example, a range of concentrations of minicircle transfections are shown in FIG. 70 A, FIG. 70 B, and FIG. 73. A representative flow cytometry experiment depicting a summary of efficiency of integration of a minicircle vector transfected at a 5 and 20 microgram concentration is shown in FIG. 74, FIG. 78, and FIG. 79. A transgene encoded by a minicircle vector can integrate into a cellular genome. In some cases, integration of a transgene encoded by a minicircle vector is in the forward direction, FIG. 75. In other cases, integration of a transgene encoded by a minicircle vector is in the reverse direction.

The transfection efficiency of cells with any of the nucleic acid delivery platforms described herein, for example, nucleofection or electroporation, can be or can be about 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 99.5%, 99.9%, or more than 99.9%.

Electroporation using, for example, the Neon® Transfection System (ThermoFisher Scientific) or the AMAXA® Nucleofector (AMAXA® Biosystems) can also be used for delivery of nucleic acids into a cell. Electroporation parameters may be adjusted to optimize transfection efficiency and/or cell viability. Electroporation devices can have multiple electrical wave form pulse settings such as exponential decay, time constant and square wave. Every cell type has a unique optimal Field Strength (E) that is dependent on the pulse parameters applied (e.g., voltage, capacitance and resistance). Application of optimal field strength causes electropermeabilization through induction of transmembrane voltage, which allows nucleic acids to pass through the cell membrane. In some cases, the electroporation pulse voltage, the electroporation pulse width, number of pulses, cell density, and tip type may be adjusted to optimize transfection efficiency and/or cell viability.

In some cases, electroporation pulse voltage may be varied to optimize transfection efficiency and/or cell viability. In some cases, the electroporation voltage may be less than about 500 volts. In some cases, the electroporation voltage may be at least about 500 volts, at least about 600 volts, at least about 700 volts, at least about 800 volts, at least about 900 volts, at least about 1000 volts, at least about 1100 volts, at least about 1200 volts, at least about 1300 volts, at least about 1400 volts, at least about 1500 volts, at least about 1600 volts, at least about 1700 volts, at least about 1800 volts, at least about 1900 volts, at least about 2000 volts, at least about 2100 volts, at least about 2200 volts, at least about 2300 volts, at least about 2400 volts, at least about 2500 volts, at least about 2600 volts, at least about 2700 volts, at least about 2800 volts, at least about 2900 volts, or at least about 3000 volts. In some cases, the electroporation pulse voltage required for optimal transfection efficiency and/or cell viability may be specific to the cell type. For example, an electroporation voltage of 1900 volts may optimal (e.g., provide the highest viability and/or transfection efficiency) for macrophage cells. In another example, an electroporation voltage of about 1350 volts may optimal (e.g., provide the highest viability and/or transfection efficiency) for Jurkat cells or primary human cells such as T cells. In some cases, a range of electroporation voltages may be optimal for a given cell type. For example, an electroporation voltage between about 1000 volts and about 1300 volts may optimal (e.g., provide the highest viability and/or transfection efficiency) for human 578T cells.

In some cases, electroporation pulse width may be varied to optimize transfection efficiency and/or cell viability. In some cases, the electroporation pulse width may be less than about 5 milliseconds. In some cases, the electroporation width may be at least about 5 milliseconds, at least about 6 milliseconds, at least about 7 milliseconds, at least about 8 milliseconds, at least about 9 milliseconds, at least about 10 milliseconds, at least about 11 milliseconds, at least about 12 milliseconds, at least about 13 milliseconds, at least about 14 milliseconds, at least about 15 milliseconds, at least about 16 milliseconds, at least about 17 milliseconds, at least about 18 milliseconds, at least about 19 milliseconds, at least about 20 milliseconds, at least about 21 milliseconds, at least about 22 milliseconds, at least about 23 milliseconds, at least about 24 milliseconds, at least about 25 milliseconds, at least about 26 milliseconds, at least about 27 milliseconds, at least about 28 milliseconds, at least about 29 milliseconds, at least about 30 milliseconds, at least about 31 milliseconds, at least about 32 milliseconds, at least about 33 milliseconds, at least about 34 milliseconds, at least about 35 milliseconds, at least about 36 milliseconds, at least about 37 milliseconds, at least about 38 milliseconds, at least about 39 milliseconds, at least about 40 milliseconds, at least about 41 milliseconds, at least about 42 milliseconds, at least about 43 milliseconds, at least about 44 milliseconds, at least about 45 milliseconds, at least about 46 milliseconds, at least about 47 milliseconds, at least about 48 milliseconds, at least about 49 milliseconds, or at least about 50 milliseconds. In some cases, the electroporation pulse width required for optimal transfection efficiency and/or cell viability may be specific to the cell type. For example, an electroporation pulse width of 30 milliseconds may optimal (e.g., provide the highest viability and/or transfection efficiency) for macrophage cells. In another example, an electroporation width of about 10 milliseconds may optimal (e.g., provide the highest viability and/or transfection efficiency) for Jurkat cells. In some cases, a range of electroporation widths may be optimal for a given cell type. For example, an electroporation width between about 20 milliseconds and about 30 milliseconds may optimal (e.g., provide the highest viability and/or transfection efficiency) for human 578T cells.

In some cases, the number of electroporation pulses may be varied to optimize transfection efficiency and/or cell viability. In some cases, electroporation may comprise a single pulse. In some cases, electroporation may comprise more than one pulse. In some cases, electroporation may comprise 2 pulses, 3 pulses, 4 pulses, 5 pulses 6 pulses, 7 pulses, 8 pulses, 9 pulses, or 10 or more pulses. In some cases, the number of electroporation pulses required for optimal transfection efficiency and/or cell viability may be specific to the cell type. For example, electroporation with a single pulse may be optimal (e.g., provide the highest viability and/or transfection efficiency) for macrophage cells. In another example, electroporation with a 3 pulses may be optimal (e.g., provide the highest viability and/or transfection efficiency) for primary cells. In some cases, a range of electroporation widths may be optimal for a given cell type. For example, electroporation with between about 1 to about 3 pulses may be optimal (e.g., provide the highest viability and/or transfection efficiency) for human cells.

In some cases, the starting cell density for electroporation may be varied to optimize transfection efficiency and/or cell viability. In some cases, the starting cell density for electroporation may be less than about $1\times10^5$ cells. In some cases, the starting cell density for electroporation may be at least about $1\times10^5$ cells, at least about $2\times10^5$ cells, at least about $3\times10^5$ cells, at least about $4\times10^5$ cells, at least about $5\times10^5$ cells, at least about $6\times10^5$ cells, at least about $7\times10^5$ cells, at least about $8\times10^5$ cells, at least about $9\times10^5$ cells, at least about $1\times10^6$ cells, at least about $1.5\times10^6$ cells, at least about $2\times10^6$ cells, at least about $2.5\times10^6$ cells, at least about $3\times10^6$ cells, at least about $3.5\times10^6$ cells, at least about $4\times10^6$ cells, at least about $4.5\times10^6$ cells, at least about $5\times10^6$ cells, at least about $5.5\times10^6$ cells, at least about $6\times10^6$ cells, at least about $6.5\times10^6$ cells, at least about $7\times10^6$ cells, at least about $7.5\times10^6$ cells, at least about $8\times10^6$ cells, at least about $8.5\times10^6$ cells, at least about $9\times10^6$ cells, at least about $9.5\times10^6$ cells, at least about $1\times10^7$ cells, at least about $1.2\times10^7$ cells, at least about $1.4\times10^7$ cells, at least about $1.6\times10^7$ cells, at least about $1.8\times10^7$ cells, at least about $2\times10^7$ cells, at least about $2.2\times10^7$ cells, at least about $2.4\times10^7$ cells, at least about $2.6\times10^7$ cells, at least about $2.8\times10^7$ cells, at least about $3\times10^7$ cells, at least about $3.2\times10^7$ cells, at least about $3.4\times10^7$ cells, at least about $3.6\times10^7$ cells, at least about $3.8\times10^7$ cells, at least about $4\times10^7$ cells, at least about $4.2\times10^7$ cells, at least about $4.4\times10^7$ cells, at least about $4.6\times10^7$ cells, at least about $4.8\times10^7$ cells, or at least about $5\times10^7$ cells. In some cases, the starting cell density for electroporation required for optimal transfection efficiency and/or cell viability may be specific to the cell type. For example, a starting cell density for electroporation of $1.5\times10^6$ cells may optimal (e.g., provide the highest viability and/or transfection efficiency) for macrophage cells. In another example, a starting cell density for electroporation of $5\times10^6$ cells may optimal (e.g., provide the highest viability and/or transfection efficiency) for human cells. In some cases, a range of starting cell densities for electroporation may be optimal for a given cell type. For example, a starting cell density for electroporation between of $5.6\times10^6$ and $5\times10^7$ cells may optimal (e.g., provide the highest viability and/or transfection efficiency) for human cells such as T cells.

The efficiency of integration of a nucleic acid sequence encoding an exogenous TCR into a genome of a cell with, for example, a CRISPR system, can be or can be about 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 99.5%, 99.9%, or more than 99.9%.

Figure 35:
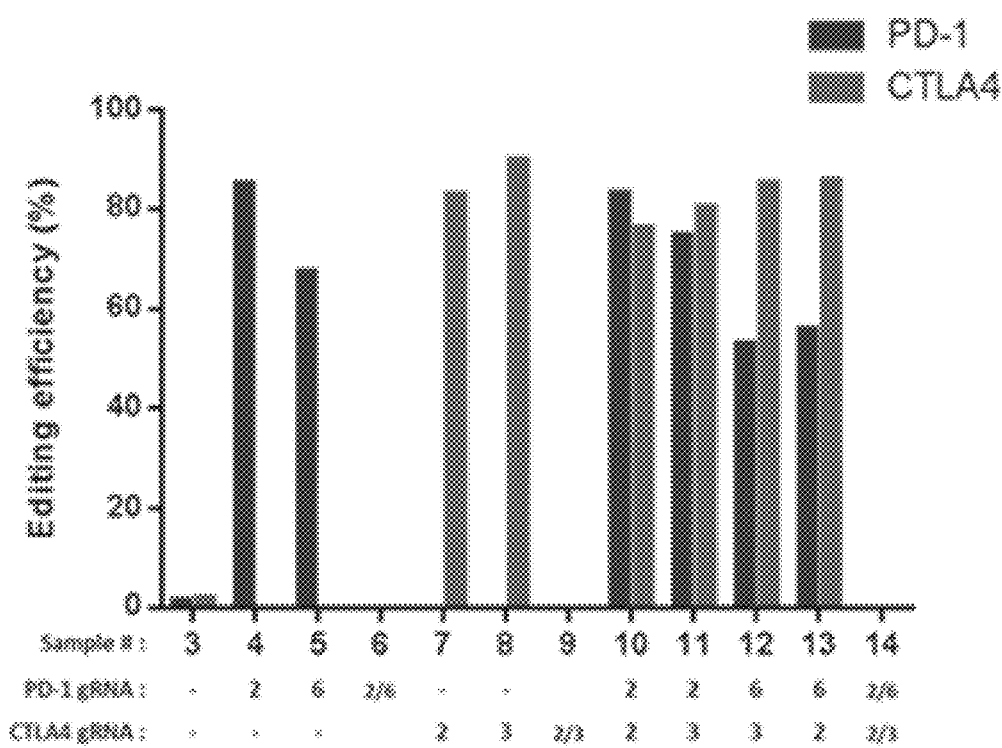
FIG. 35 shows results of a tracking of indels by decomposition (TIDE) analysis. Percent gene editing efficiency as shows to PD-1 and CTLA-4 guide RNAs.
Figure 36:
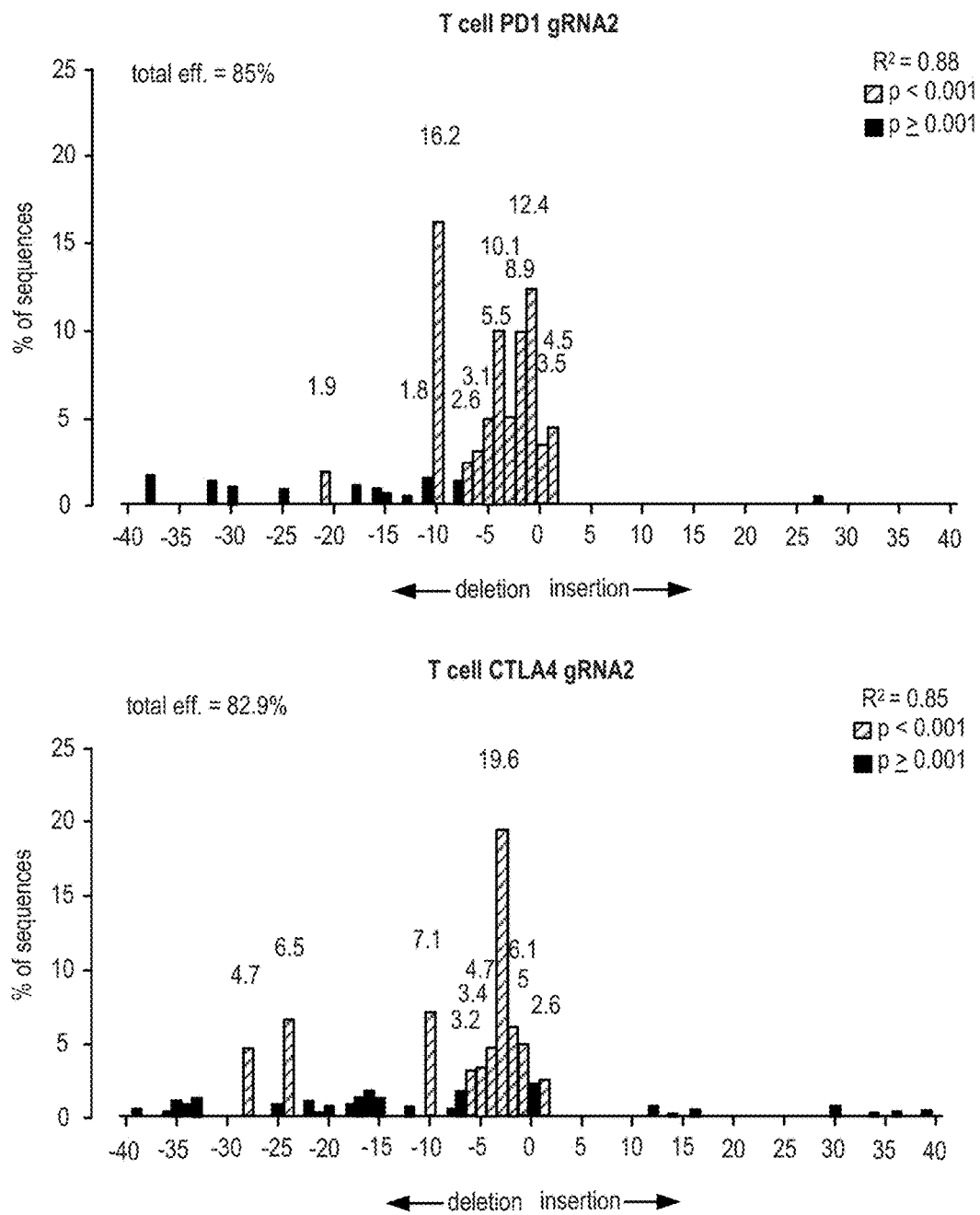
FIG. 36 shows results of a tracking of indels by decomposition (TIDE) analysis for single guide transfections. Percent of sequences with either deletions or insertions are shown for primary human T cells transfected with PD-1 or CTLA-1 guide RNAs and CRISPR.
Figure 36:
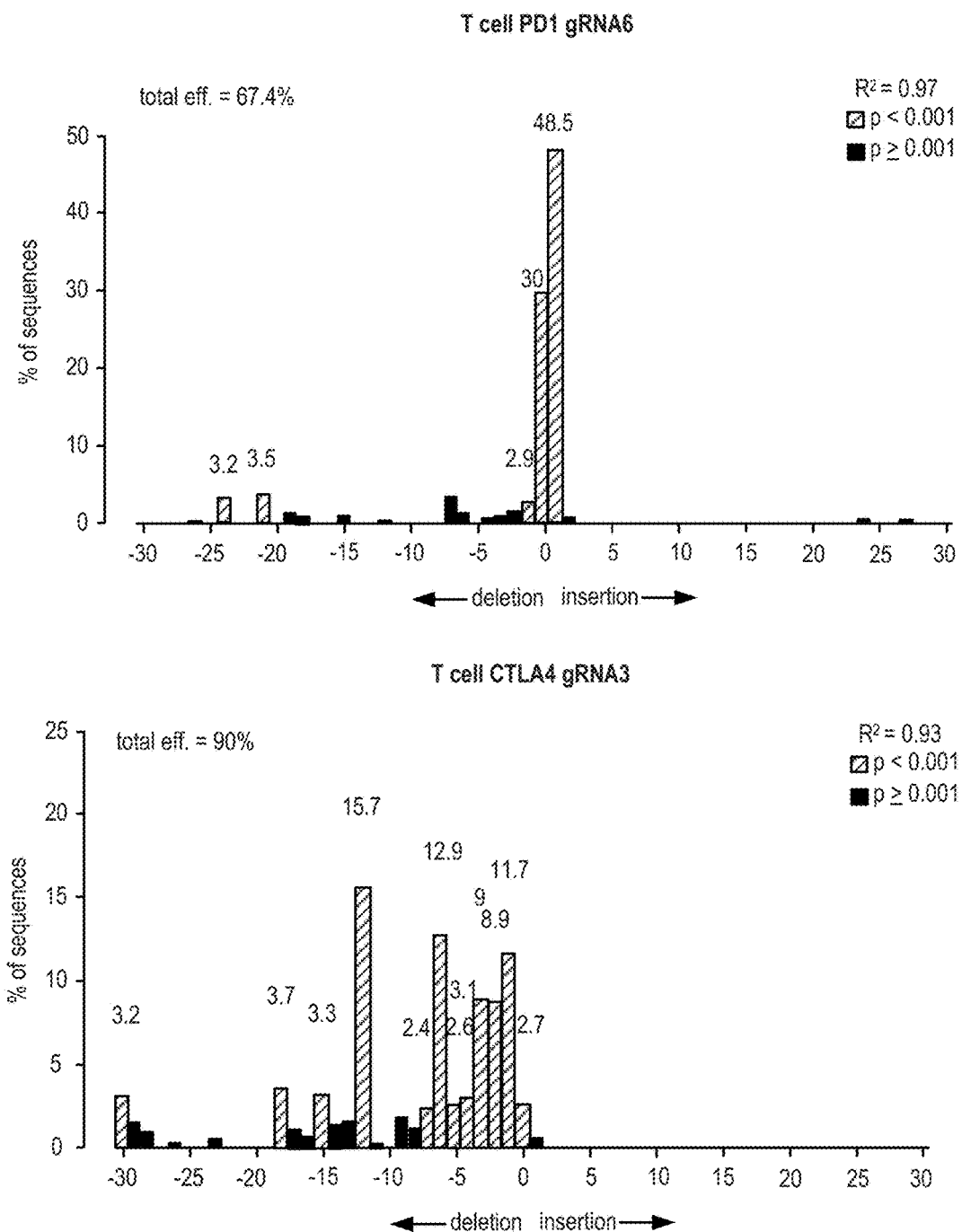
Figure 56:
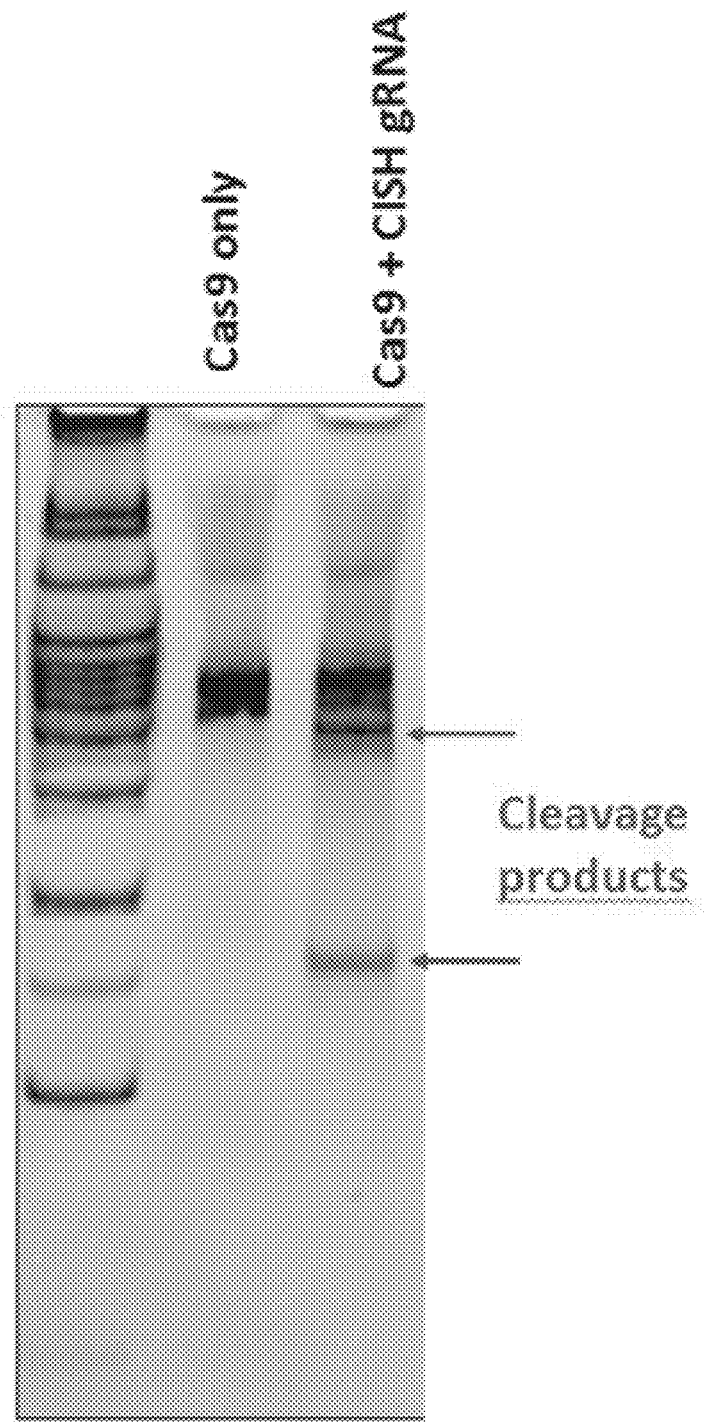
FIG. 56 depicts results of a surveyor assay for CRISPR mediated gene-modification of the CISH locus in primary human T cells.
Figure 71A:
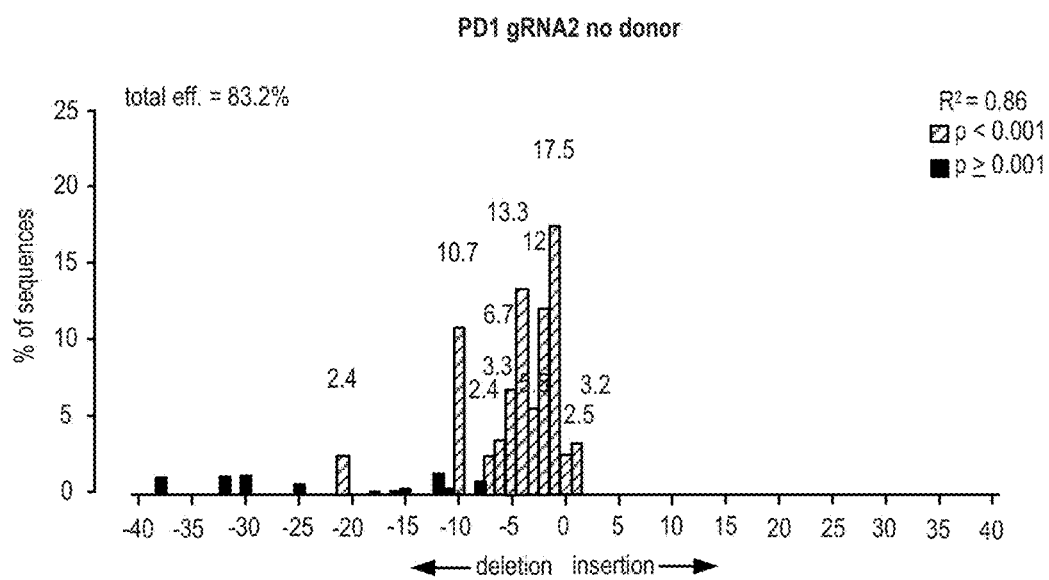
FIG. 71 A and FIG. 71 B show Day 4 TIDE analysis of PD1 FIG. 71 A gRNA 2 and FIG. 71 B gRNA6 with no donor nucleic acid.
Figure 71B:
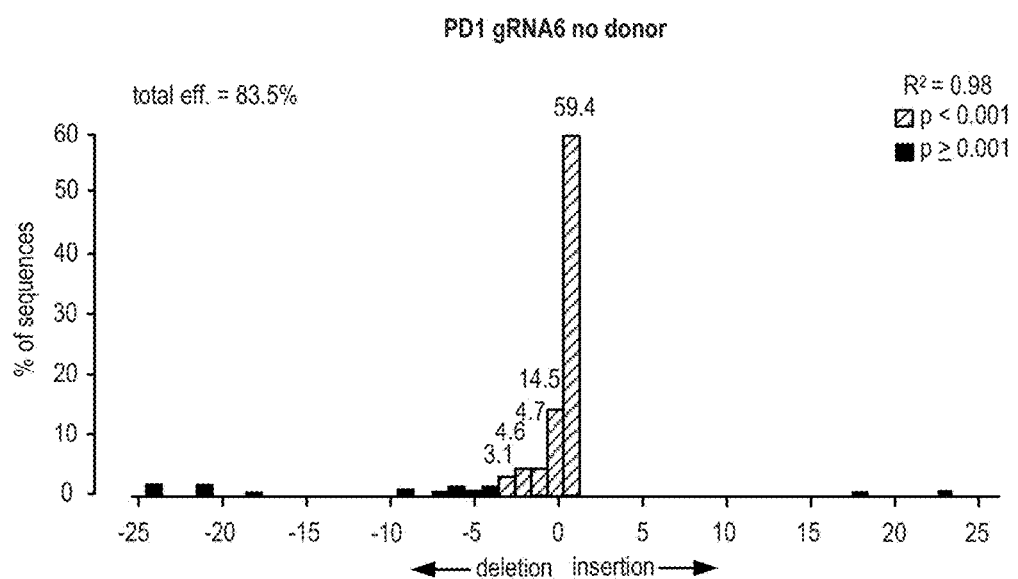
Figure 72A:
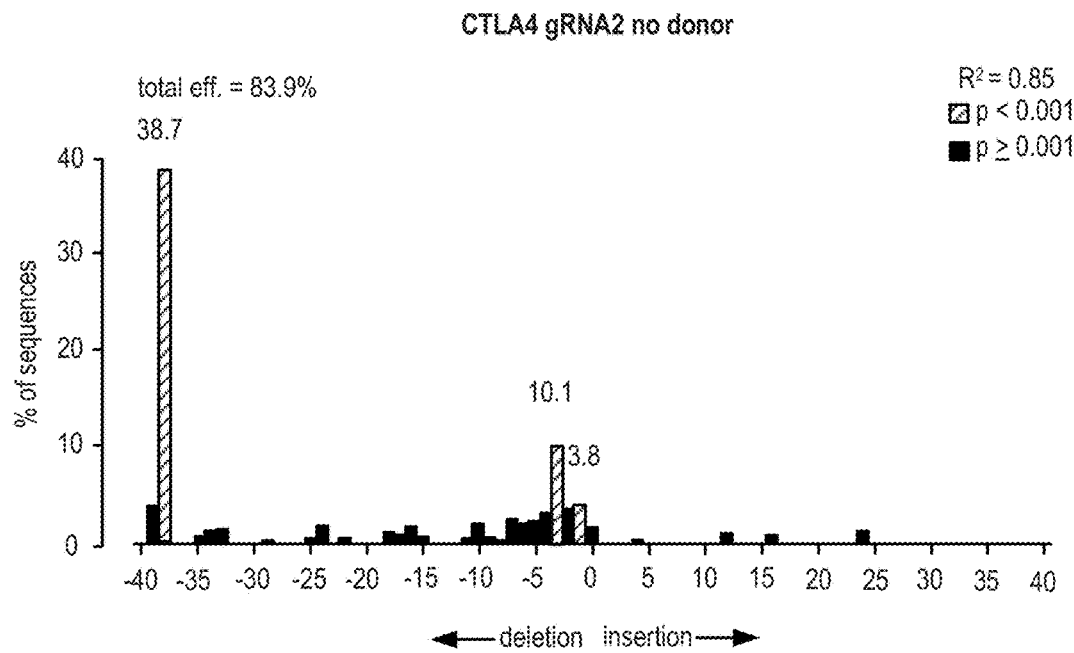
FIG. 72 A and FIG. 72 B show Day 4 TIDE analysis of CTLA4 FIG. 72 A gRNA 2 and FIG. 72 B gRNA3 with no donor nucleic acid.
Figure 72B:
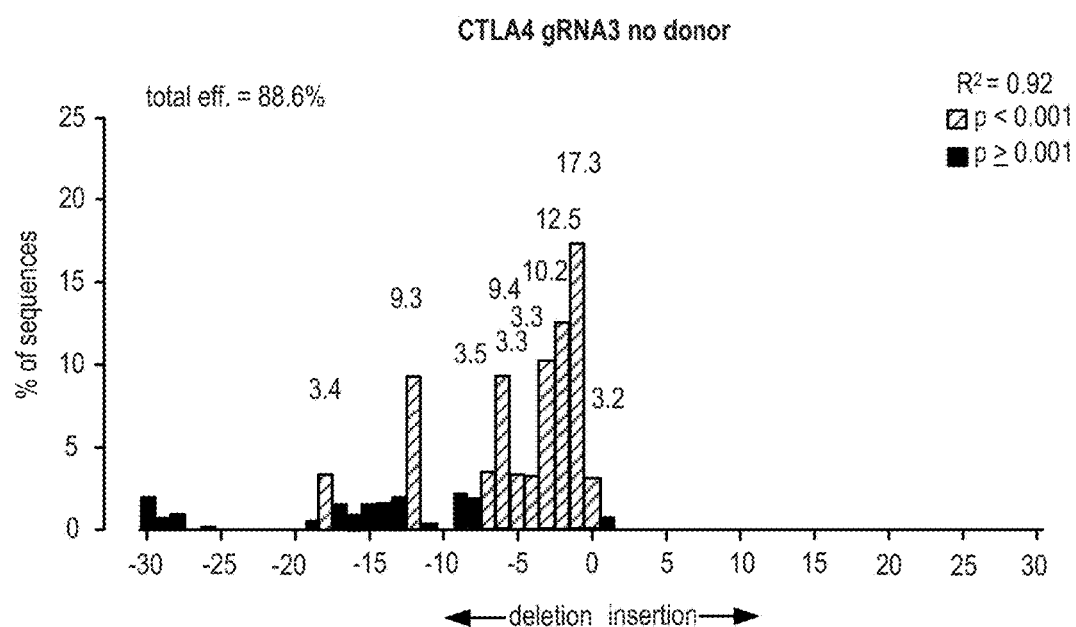
Figure 77:
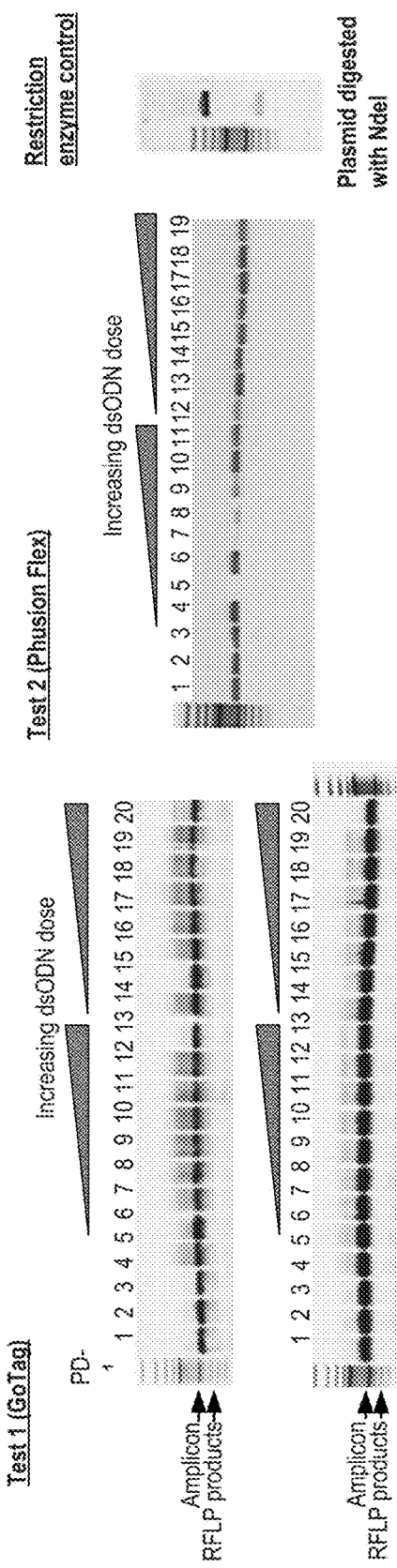
FIG. 77 shows GoTaq and PhusionFlex analysis of dsDNA integration at the PD-1 or CISH gene sites.
Figure 80:
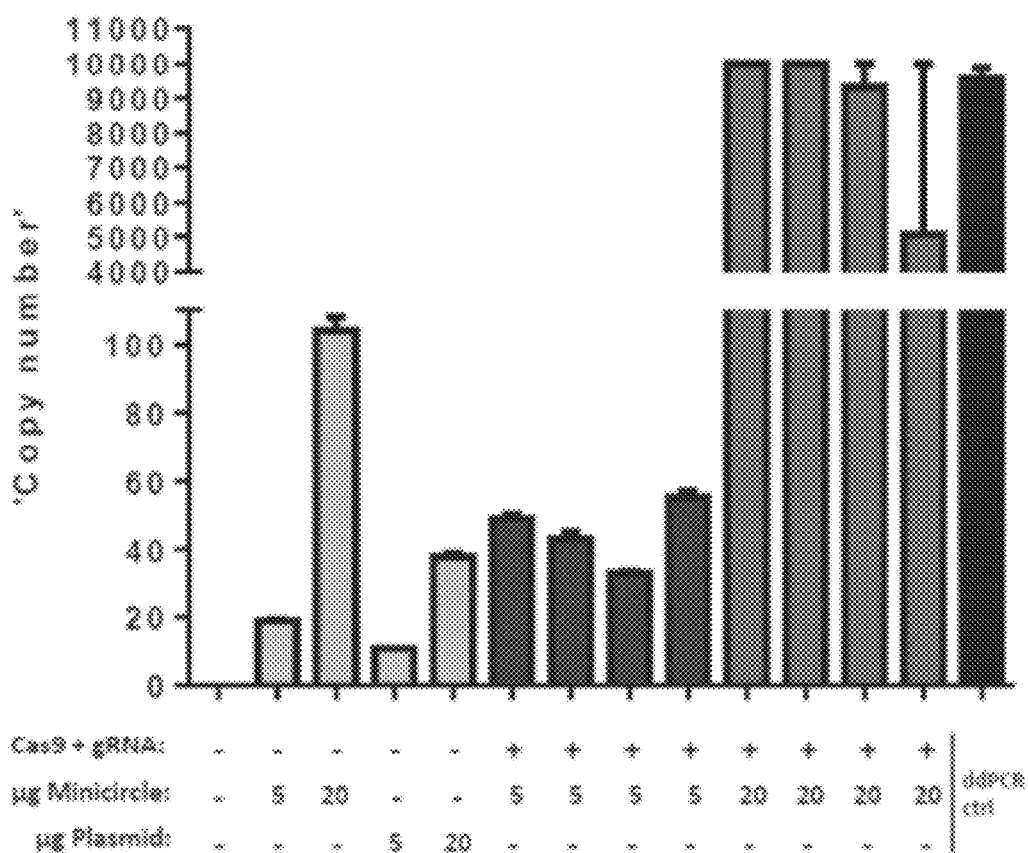
FIG. 80 depicts digital PCR copy number data copy number relative to RNaseP on Day 4 post transfection of CRISPR, and a minicircle encoding an mTCRb chain. A plasmid donor encoding the mTCRb chain was used as a control.
Figure 95:
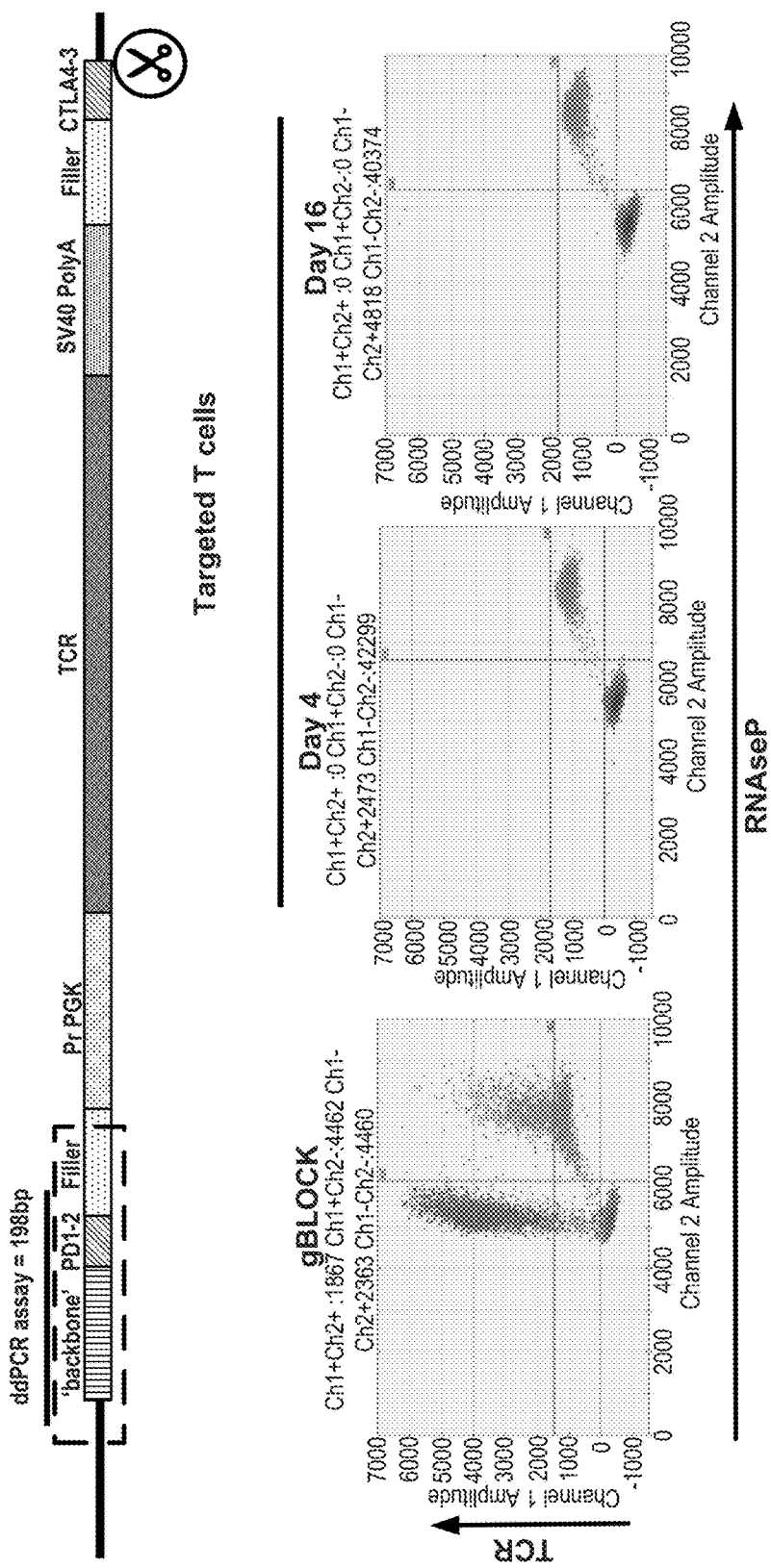
FIG. 95 shows a locus-specific digital PCR assay to rapidly detect integration of an exogenous transgene (e.g., TCR).

Integration of an exogenous polynucleic acid, such as a TCR, can be measured using any technique. For example, integration can be measured by flow cytometry, surveyor nuclease assay (FIG. 56), tracking of indels by decomposition (TIDE), FIG. 71 and FIG. 72, junction PCR, or any combination thereof. A representative TIDE analysis is shown for percent gene editing efficiency as show for PD-1 and CTLA-4 guide RNAs, FIG. 35 and FIG. 36. A representative TIDE analysis for CISH guide RNAs is shown from FIG. 62 to FIGS. 67 A and B. In other cases, transgene integration can be measured by PCR, FIG. 77, FIG. 80, and FIG. 95.

Ex vivo cell transfection can also be used for diagnostics, research, or for gene therapy (e.g., via re-infusion of the transfected cells into the host organism). In some cases, cells are isolated from the subject organism, transfected with a nucleic acid (e.g., gene or cDNA), and re-infused back into the subject organism (e.g., patient).

The amount of cells that are necessary to be therapeutically effective in a patient may vary depending on the viability of the cells, and the efficiency with which the cells have been genetically modified (e.g., the efficiency with which a transgene has been integrated into one or more cells). In some cases, the product (e.g., multiplication) of the viability of cells post genetic modification and the efficiency of integration of a transgene may correspond to the therapeutic aliquot of cells available for administration to a subject. In some cases, an increase in the viability of cells post genetic modification may correspond to a decrease in the amount of cells that are necessary for administration to be therapeutically effective in a patient. In some cases, an increase in the efficiency with which a transgene has been integrated into one or more cells may correspond to a decrease in the amount of cells that are necessary for administration to be therapeutically effective in a patient. In some cases, determining an amount of cells that are necessary to be therapeutically effective may comprise determining a function corresponding to a change in the viability of cells over time. In some cases, determining an amount of cells that are necessary to be therapeutically effective may comprise determining a function corresponding to a change in the efficiency with which a transgene may be integrated into one or more cells with respect to time dependent variables (e.g., cell culture time, electroporation time, cell stimulation time).

a. Functional Transplant

Cells (e.g., engineered cells or engineered primary T cells) before, after, and/or during transplantation can be functional. For example, transplanted cells can be functional for at least or at least about 1, 2, 3, 4, 5, 6, 7, 8, 9, 10, 11, 12, 13, 14, 15, 16, 17, 18, 19, 20, 21, 22, 23, 24, 25, 6, 27, 28, 29, 30, 40, 50, 60, 70, 80, 90, or 100 days after transplantation. Transplanted cells can be functional for at least or at least about 1, 2, 3, 4, 5, 6, 7, 8, 9, 10, 11, or 12 months after transplantation. Transplanted cells can be functional for at least or at least about 1, 2, 3, 4, 5, 6, 7, 8, 9, 10, 15, 20, 25, or 30 years after transplantation. In some cases, transplanted cells can be functional for up to the lifetime of a recipient.

Further, transplanted cells can function at 100% of its normal intended operation. Transplanted cells can also function 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% of its normal intended operation.

Transplanted cells can also function over 100% of its normal intended operation. For example, transplanted cells can function 110, 120, 130, 140, 150, 160, 170, 180, 190, 200, 250, 300, 400, 500, 600, 700, 800, 900, 1000 or more % of its normal intended operation.

Pharmaceutical Compositions and Formulations

The compositions described throughout can be formulation into a pharmaceutical medicament and be used to treat a human or mammal, in need thereof, diagnosed with a disease, e.g., cancer. These medicaments can be co-administered with one or more T cells (e.g., engineered T cells) to a human or mammal, together with one or more chemotherapeutic agent or chemotherapeutic compound.

A "chemotherapeutic agent" or "chemotherapeutic compound" and their grammatical equivalents as used herein, can be a chemical compound useful in the treatment of cancer. The chemotherapeutic cancer agents that can be used in combination with the disclosed T cell include, but are not limited to, mitotic inhibitors (vinca alkaloids). These include vincristine, vinblastine, vindesine and Navelbine™ (vinorelbine, 5'-noranhydroblastine). In yet other cases, chemotherapeutic cancer agents include topoisomerase I inhibitors, such as camptothecin compounds. As used herein, "camptothecin compounds" include Camptosar™ (irinotecan HCL), Hycamtin™ (topotecan HCL) and other compounds derived from camptothecin and its analogues. Another category of chemotherapeutic cancer agents that can be used in the methods and compositions disclosed herein are podophyllotoxin derivatives, such as etoposide, teniposide and mitopodozide. The present disclosure further encompasses other chemotherapeutic cancer agents known as alkylating agents, which alkylate the genetic material in tumor cells. These include without limitation cisplatin, cyclophosphamide, nitrogen mustard, trimethylene thiophosphoramide, carmustine, busulfan, chlorambucil, belustine, uracil mustard, chlomaphazin, and dacarbazine. The disclosure encompasses antimetabolites as chemotherapeutic agents. Examples of these types of agents include cytosine arabinoside, fluorouracil, methotrexate, mercaptopurine, azathioprime, and procarbazine. An additional category of chemotherapeutic cancer agents that may be used in the methods and compositions disclosed herein include antibiotics. Examples include without limitation doxorubicin, bleomycin, dactinomycin, daunorubicin, mithramycin, mitomycin, mytomycin C, and daunomycin. There are numerous liposomal formulations commercially available for these compounds. The present disclosure further encompasses other chemotherapeutic cancer agents including without limitation anti-tumor antibodies, dacarbazine, azacytidine, amsacrine, melphalan, ifosfamide and mitoxantrone.

The disclosed T cell herein can be administered in combination with other anti-tumor agents, including cytotoxic/antineoplastic agents and anti-angiogenic agents. Cytotoxic/anti-neoplastic agents can be defined as agents who attack and kill cancer cells. Some cytotoxic/anti-neoplastic agents can be alkylating agents, which alkylate the genetic material in tumor cells, e.g., cis-platin, cyclophosphamide, nitrogen mustard, trimethylene thiophosphoramide, carmustine, busulfan, chlorambucil, belustine, uracil mustard, chlomaphazin, and dacabazine. Other cytotoxic/anti-neoplastic agents can be antimetabolites for tumor cells, e.g., cytosine arabinoside, fluorouracil, methotrexate, mercaptopurine, azathioprime, and procarbazine. Other cytotoxic/anti-neoplastic agents can be antibiotics, e.g., doxorubicin, bleomycin, dactinomycin, daunorubicin, mithramycin, mitomycin, mytomycin C, and daunomycin. There are numerous liposomal formulations commercially available for these compounds. Still other cytotoxic/anti-neoplastic agents can be mitotic inhibitors (vinca alkaloids). These include vincristine, vinblastine and etoposide. Miscellaneous cytotoxic/anti-neoplastic agents include taxol and its derivatives, L-asparaginase, anti-tumor antibodies, dacarbazine, azacytidine, amsacrine, melphalan, VM-26, ifosfamide, mitoxantrone, and vindesine.

Anti-angiogenic agents can also be used. Suitable anti-angiogenic agents for use in the disclosed methods and compositions include anti-VEGF antibodies, including humanized and chimeric antibodies, anti-VEGF aptamers and antisense oligonucleotides. Other inhibitors of angiogenesis include angiostatin, endostatin, interferons, interleukin 1 (including α and β) interleukin 12, retinoic acid, and tissue inhibitors of metalloproteinase-1 and -2. (TIMP-1 and -2). Small molecules, including topoisomerases such as razoxane, a topoisomerase II inhibitor with anti-angiogenic activity, can also be used.

Other anti-cancer agents that can be used in combination with the disclosed T cell include, but are not limited to: acivicin; aclarubicin; acodazole hydrochloride; acronine; adozelesin; aldesleukin; altretamine; ambomycin; ametantrone acetate; aminoglutethimide; amsacrine; anastrozole; anthramycin; asparaginase; asperlin; avastin; azacitidine; azetepa; azotomycin; batimastat; benzodepa; bicalutamide; bisantrene hydrochloride; bisnafide dimesylate; bizelesin; bleomycin sulfate; brequinar sodium; bropirimine; busulfan; cactinomycin; calusterone; caracemide; carbetimer; carboplatin; carmustine; carubicin hydrochloride; carzelesin; cedefingol; chlorambucil; cirolemycin; cisplatin; cladribine; crisnatol mesylate; cyclophosphamide; cytarabine; dacarbazine; dactinomycin; daunorubicin hydrochloride; decitabine; dexormaplatin; dezaguanine; dezaguanine mesylate; diaziquone; docetaxel; doxorubicin; doxorubicin hydrochloride; droloxifene; droloxifene citrate; dromostanolone propionate; duazomycin; edatrexate; eflornithine hydrochloride; elsamitrucin; enloplatin; enpromate; epipropidine; epirubicin hydrochloride; erbulozole; esorubicin hydrochloride; estramustine; estramustine phosphate sodium; etanidazole; etoposide; etoposide phosphate; etoprine; fadrozole hydrochloride; fazarabine; fenretinide; floxuridine; fludarabine phosphate; fluorouracil; flurocitabine; fosquidone; fostriecin sodium; gemcitabine; gemcitabine hydrochloride; hydroxyurea; idarubicin hydrochloride; ifosfamide; ilmofosine; interleukin II (including recombinant interleukin II, or rIL2), interferon alfa-2a; interferon alfa-2b; interferon alfa-n1; interferon alfa-n3; interferon beta-I a; interferon gamma-I b; iproplatin; irinotecan hydrochloride; lanreotide acetate; letrozole; leuprolide acetate; liarozole hydrochloride; lometrexol sodium; lomustine; losoxantrone hydrochloride; masoprocol; maytansine; mechlorethamine hydrochloride; megestrol acetate; melengestrol acetate; melphalan; menogaril; mercaptopurine; methotrexate; methotrexate sodium; metoprine; meturedepa; mitindomide; mitocarcin; mitocromin; mitogillin; mitomalcin; mitomycin; mitosper; mitotane; mitoxantrone hydrochloride; mycophenolic acid; nocodazole; nogalamycin; ormaplatin; oxisuran; paclitaxel; pegaspargase; peliomycin; pentamustine; peplomycin sulfate; perfosfamide; pipobroman; piposulfan; piroxantrone hydrochloride; plicamycin; plomestane; porfimer sodium; porfiromycin; prednimustine; procarbazine hydrochloride; puromycin; puromycin hydrochloride; pyrazofurin; riboprine; rogletimide; safingol; safingol hydrochloride; semustine; simtrazene; sparfosate sodium; sparsomycin; spirogermanium hydrochloride; spiromustine; spiroplatin; streptonigrin; streptozocin; sulofenur; talisomycin; tecogalan sodium; tegafur; teloxantrone hydrochloride; temoporfin; teniposide; teroxirone; testolactone; thiamiprine; thioguanine; thiotepa; tiazofurin; tirapazamine; toremifene citrate; trestolone acetate; triciribine phosphate; trimetrexate; trimetrexate glucuronate; triptorelin; tubulozole hydrochloride; uracil mustard; uredepa; vapreotide; verteporfin; vinblastine sulfate; vincristine sulfate; vindesine; vindesine sulfate; vinepidine sulfate; vinglycinate sulfate; vinleurosine sulfate; vinorelbine tartrate; vinrosidine sulfate; vinzolidine sulfate; vorozole; zeniplatin; zinostatin; zorubicin hydrochloride. Other anti-cancer drugs include, but are not limited to: 20-epi-1, 25 dihydroxyvitamin D3; 5-ethynyluracil; abiraterone; aclarubicin; acylfulvene; adecypenol; adozelesin; aldesleukin; ALL-TK antagonists; altretamine; ambamustine; amidox; amifostine; aminolevulinic acid; amrubicin; amsacrine; anagrelide; anastrozole; andrographolide; angiogenesis inhibitors; antagonist D; antagonist G; antarelix; anti-dorsalizing morphogenetic protein-1; antiandrogen, prostatic carcinoma; antiestrogen; antineoplaston; antisense oligonucleotides; aphidicolin glycinate; apoptosis gene modulators; apoptosis regulators; apurinic acid; ara-CDP-DL-PTBA; arginine deaminase; asulacrine; atamestane; atrimustine; axinastatin 1; axinastatin 2; axinastatin 3; azasetron; azatoxin; azatyrosine; baccatin III derivatives; balanol; batimastat; BCR/ABL antagonists; benzochlorins; benzoylstaurosporine; beta lactam derivatives; beta-alethine; betaclamycin B; betulinic acid; bFGF inhibitor; bicalutamide; bisantrene; bisaziridinylspermine; bisnafide; bistratene A; bizelesin; breflate; bropirimine; budotitane; buthionine sulfoximine; calcipotriol; calphostin C; camptothecin derivatives; canarypox IL-2; capecitabine; carboxamide-amino-triazole; carboxyamidotriazole; CaRest M3; CARN 700; cartilage derived inhibitor; carzelesin; casein kinase inhibitors (ICOS); castanospermine; cecropin B; cetrorelix; chlorins; chloroquinoxaline sulfonamide; cicaprost; cis-porphyrin; cladribine; clomifene analogues; clotrimazole; collismycin A; collismycin B; combretastatin A4; combretastatin analogue; conagenin; crambescidin 816; crisnatol; cryptophycin 8; cryptophycin A derivatives; curacin A; cyclopentanthraquinones; cycloplatam; cypemycin; cytarabine ocfosfate; cytolytic factor; cytostatin; daclixlimab; decitabine; dehydrodidemnin B; deslorelin; dexamethasone; dexifosfamide; dexrazoxane; dexverapamil; diaziquone; didemnin B; didox; diethylnorspermine; dihydro-5-azacytidine; dihydrotaxol, 9-; dioxamycin; diphenyl spiromustine; docetaxel; docosanol; dolasetron; doxifluridine; droloxifene; dronabinol; duocarmycin SA; ebselen; ecomustine; edelfosine; edrecolomab; eflornithine; elemene; emitefur; epirubicin; epristeride; estramustine analogue; estrogen agonists; estrogen antagonists; etanidazole; etoposide phosphate; exemestane; fadrozole; fazarabine; fenretinide; filgrastim; finasteride; flavopiridol; flezelastine; fluasterone; fludarabine; fluorodaunorunicin hydrochloride; forfenimex; formestane; fostriecin; fotemustine; gadolinium texaphyrin; gallium nitrate; galocitabine; ganirelix; gelatinase inhibitors; gemcitabine; glutathione inhibitors; hepsulfam; heregulin; hexamethylene bisacetamide; hypericin; ibandronic acid; idarubicin; idoxifene; idramantone; ilmofosine; ilomastat; imidazoacridones; imiquimod; immunostimulant peptides; insulin-like growth factor-1 receptor inhibitor; interferon agonists; interferons; interleukins; iobenguane; iododoxorubicin; ipomeanol, 4-; iroplact; irsogladine; isobengazole; isohomohalicondrin B; itasetron; jasplakinolide; kahalalide F; lamellarin-N triacetate; lanreotide; leinamycin; lenograstim; lentinan sulfate; leptolstatin; letrozole; leukemia inhibiting factor; leukocyte alpha interferon; leuprolide+estrogen+progesterone; leuprorelin; levamisole; liarozole; linear polyamine analogue; lipophilic disaccharide peptide; lipophilic platinum compounds; lissoclinamide 7; lobaplatin; lombricine; lometrexol; lonidamine; losoxantrone; lovastatin; loxoribine; lurtotecan; lutetium texaphyrin; lysofylline; lytic peptides; maitansine; mannostatin A; marimastat; masoprocol; maspin; matrilysin inhibitors; matrix metalloproteinase inhibitors; menogaril; merbarone; meterelin; methioninase; metoclopramide; MIF inhibitor; mifepristone; miltefosine; mirimostim; mismatched double stranded RNA; mitoguazone; mitolactol; mitomycin analogues; mitonafide; mitotoxin fibroblast growth factor-saporin; mitoxantrone; mofarotene; molgramostim; monoclonal antibody, human chorionic gonadotrophin; monophosphoryl lipid A+myobacterium cell wall sk; mopidamol; multiple drug resistance gene inhibitor; multiple tumor suppressor 1-based therapy; mustard anticancer agent; mycaperoxide B; mycobacterial cell wall extract; myriaporone; N-acetyldinaline; N-substituted benzamides; nafarelin; nagrestip; naloxone+pentazocine; napavin; naphterpin; nartograstim; nedaplatin; nemorubicin; neridronic acid; neutral endopeptidase; nilutamide; nisamycin; nitric oxide modulators; nitroxide antioxidant; nitrullyn; O6-benzylguanine; octreotide; okicenone; oligonucleotides; onapristone; ondansetron; ondansetron; oracin; oral cytokine inducer; ormaplatin; osaterone; oxaliplatin; oxaunomycin; paclitaxel; paclitaxel analogues; paclitaxel derivatives; palauamine; palmitoylrhizoxin; pamidronic acid; panaxytriol; panomifene; parabactin; pazelliptine; pegaspargase; peldesine; pentosan polysulfate sodium; pentostatin; pentrozole; perflubron; perfosfamide; perillyl alcohol; phenazinomycin; phenylacetate; phosphatase inhibitors; picibanil; pilocarpine hydrochloride; pirarubicin; piritrexim; placetin A; placetin B; plasminogen activator inhibitor; platinum complex; platinum compounds; platinum-triamine complex; porfimer sodium; porfiromycin; prednisone; propyl bis-acridone; prostaglandin J2; proteasome inhibitors; protein A-based immune modulator; protein kinase C inhibitor; protein kinase C inhibitors, microalgal; protein tyrosine phosphatase inhibitors; purine nucleoside phosphorylase inhibitors; purpurins; pyrazoloacridine; pyridoxylated hemoglobin polyoxyethylene conjugate; raf antagonists; raltitrexed; ramosetron; ras farnesyl protein transferase inhibitors; ras inhibitors; ras-GAP inhibitor; retelliptine demethylated; rhenium Re 186 etidronate; rhizoxin; ribozymes; RII retinamide; rogletimide; rohitukine; romurtide; roquinimex; rubiginone B1; ruboxyl; safingol; saintopin; SarCNU; sarcophytol A; sargramostim; Sdi 1 mimetics; semustine; senescence derived inhibitor 1; sense oligonucleotides; signal transduction inhibitors; signal transduction modulators; single chain antigen binding protein; sizofiran; sobuzoxane; sodium borocaptate; sodium phenylacetate; solverol; somatomedin binding protein; sonermin; sparfosic acid; spicamycin D; spiromustine; splenopentin; spongistatin 1; squalamine; stem cell inhibitor; stem-cell division inhibitors; stipiamide; stromelysin inhibitors; sulfinosine; superactive vasoactive intestinal peptide antagonist; suradista; suramin; swainsonine; synthetic glycosaminoglycans; tallimustine; tamoxifen methiodide; tauromustine; tazarotene; tecogalan sodium; tegafur; tellurapyrylium; telomerase inhibitors; temoporfin; temozolomide; teniposide; tetrachlorodecaoxide; tetrazomine; thaliblastine; thiocoraline; thrombopoietin; thrombopoietin mimetic; thymalfasin; thymopoietin receptor agonist; thymotrinan; thyroid stimulating hormone; tin ethyl etiopurpurin; tirapazamine; titanocene bichloride; topsentin; toremifene; totipotent stem cell factor; translation inhibitors; tretinoin; triacetyluridine; triciribine; trimetrexate; triptorelin; tropisetron; turosteride; tyrosine kinase inhibitors; tyrphostins; UBC inhibitors; ubenimex; urogenital sinus-derived growth inhibitory factor; urokinase receptor antagonists; vapreotide; variolin B; vector system, erythrocyte gene therapy; velaresol; veramine; verdins; verteporfin; vinorelbine; vinxaltine; vitaxin; vorozole; zanoterone; zeniplatin; zilascorb; and zinostatin stimalamer. In one embodiment, the anti-cancer drug is 5-fluorouracil, taxol, or leucovorin.

In some cases, for example, in the compositions, formulations and methods of treating cancer, the unit dosage of the composition or formulation administered can be 5, 10, 15, 20, 25, 30, 35, 40, 45, 50, 55, 60, 65, 70, 75, 80, 85, 90, 95 or 100 mg. In some cases, the total amount of the composition or formulation administered can be 0.1, 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5, 10, 11, 12, 13, 14, 15, 16, 17, 18, 19, 20, 25, 30, 40, 50, 60, 70, 80, 90, or 100 g.

In some cases, the present invention provides a pharmaceutical composition comprising a T cell can be administered either alone or together with a pharmaceutically acceptable carrier or excipient, by any routes, and such administration can be carried out in both single and multiple dosages. More particularly, the pharmaceutical composition can be combined with various pharmaceutically acceptable inert carriers in the form of tablets, capsules, lozenges, troches, hand candies, powders, sprays, aqueous suspensions, injectable solutions, elixirs, syrups, and the like. Such carriers include solid diluents or fillers, sterile aqueous media and various non-toxic organic solvents, etc. Moreover, such oral pharmaceutical formulations can be suitably sweetened and/or flavored by means of various agents of the type commonly employed for such purposes.

For example, cells can be administered to a patient in conjunction with (e.g., before, simultaneously, or following) any number of relevant treatment modalities, including but not limited to treatment with agents such as antiviral therapy, cidofovir and interleukin-2, or Cytarabine (also known as ARA-C). In some cases, the engineered cells can be used in combination with chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludaribine, cyclosporin, FK506, rapamycin, mycoplienolic acid, steroids, FR901228, cytokines, and irradiation. The engineered cell composition can also be administered to a patient in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAMPATH. In some cases, the engineered cell compositions of the present invention can be administered following B-cell ablative therapy such as agents that react with CD20, e.g., Rituxan. For example, subjects can undergo standard treatment with high dose chemotherapy followed by peripheral blood stem cell transplantation. In certain cases, following the transplant, subjects can receive an infusion of the engineered cells, e.g., expanded engineered cells, of the present invention. Additionally, expanded engineered cells can be administered before or following surgery. The engineered cells obtained by any one of the methods described herein can be used in a particular aspect of the invention for treating patients in need thereof against Host versus Graft (HvG) rejection and Graft versus Host Disease (GvHD). Therefore, a method of treating patients in need thereof against Host versus Graft (HvG) rejection and Graft versus Host Disease (GvHD) comprising treating a patient by administering to a patient an effective amount of engineered cells comprising inactivated TCR alpha and/or TCR beta genes is contemplated.

Method of Use

Cells can be extracted from a human as described herein. Cells can be genetically altered ex vivo and used accordingly. These cells can be used for cell-based therapies. These cells can be used to treat disease in a recipient (e.g., a human). For example, these cells can be used to treat cancer.

Described herein is a method of treating a disease (e.g., cancer) in a recipient comprising transplanting to the recipient one or more cells (including organs and/or tissues) comprising engineered cells. Cells prepared by intracellular genomic transplant can be used to treat cancer.

Described herein is a method of treating a disease (e.g., cancer) in a recipient comprising transplanting to the recipient one or more cells (including organs and/or tissues) comprising engineered cells. In some cases $5 \times 10^{10}$ cells will be administered to a patient. In other cases, $5 \times 10^{11}$ cells will be administered to a patient.

In some embodiments, about $5 \times 10^{10}$ cells are administered to a subject. In some embodiments, about $5 \times 10^{10}$ cells represents the median amount of cells administered to a subject. In some embodiments, about $5 \times 10^{10}$ cells are necessary to effect a therapeutic response in a subject. In some embodiments, at least about at least about $1 \times 10^7$ cells, at least about $2 \times 10^7$ cells, at least about $3 \times 10^7$ cells, at least about $4 \times 10^7$ cells, at least about $5 \times 10^7$ cells, at least about $6 \times 10^7$ cells, at least about $6 \times 10^7$ cells, at least about $8 \times 10^7$ cells, at least about $9 \times 10^7$ cells, at least about $1 \times 10^8$ cells, at least about $2 \times 10^8$ cells, at least about $3 \times 10^8$ cells, at least about $4 \times 10^8$ cells, at least about $5 \times 10^8$ cells, at least about $6 \times 10^8$ cells, at least about $6 \times 10^8$ cells, at least about $8 \times 10^8$ cells, at least about $9 \times 10^8$ cells, at least about $1 \times 10^9$ cells, at least about $2 \times 10^9$ cells, at least about $3 \times 10^9$ cells, at least about $4 \times 10^9$ cells, at least about $5 \times 10^9$ cells, at least about $6 \times 10^9$ cells, at least about $6 \times 10^9$ cells, at least about $8 \times 10^9$ cells, at least about $9 \times 10^9$ cells, at least about $1 \times 10^{10}$ cells, at least about $2 \times 10^{10}$ cells, at least about $3 \times 10^{10}$ cells, at least about $4 \times 10^{10}$ cells, at least about $5 \times 10^{10}$ cells, at least about $6 \times 10^{10}$ cells, at least about $6 \times 10^{10}$ cells, at least about $8 \times 10^{10}$ cells, at least about $9 \times 10^{10}$ cells, at least about $1 \times 10^{11}$ cells, at least about $2 \times 10^{11}$ cells, at least about $3 \times 10^{11}$ cells, at least about $4 \times 10^{11}$ cells, at least about $5 \times 10^{11}$ cells, at least about $6 \times 10^{11}$ cells, at least about $6 \times 10^{11}$ cells, at least about $8 \times 10^{11}$ cells, at least about $9 \times 10^{11}$ cells, or at least about $1 \times 10^{12}$ cells. For example, about $5 \times 10^{10}$ cells may be administered to a subject. In another example, starting with $3 \times 10^{6}$ cells, the cells may be expanded to about $5 \times 10^{10}$ cells and administered to a subject. In some cases, cells are expanded to sufficient numbers for therapy. For example, $5 \times 10^{7}$ cells can undergo rapid expansion to generate sufficient numbers for therapeutic use. In some cases, sufficient numbers for therapeutic use can be $5 \times 10^{10}$. Any number of cells can be infused for therapeutic use. For example, a patient may be infused with a number of cells between $1 \times 10^{6}$ to $5 \times 10^{12}$ inclusive. A patient may be infused with as many cells that can be generated for them. In some cases, cells that are infused into a patient are not all engineered. For example, at least 90% of cells that are infused into a patient can be engineered. In other instances, at least 40% of cells that are infused into a patient can be engineered.

In some embodiments, a method of the present disclosure comprises calculating and/or administering to a subject an amount of engineered cells necessary to effect a therapeutic response in the subject. In some embodiments, calculating the amount of engineered cells necessary to effect a therapeutic response comprises the viability of the cells and/or the efficiency with which a transgene has been integrated into the genome of a cell. In some embodiments, in order to effect a therapeutic response in a subject, the cells administered to the subject may be viable cells. In some embodiments, in order to effect a therapeutic response in a subject, at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10% of the cells are viable cells. In some embodiments, in order to effect a therapeutic response in a subject, the cells administered to a subject may be cells that have had one or more transgenes successfully integrated into the genome of the cell. In some embodiments, in order to effect a therapeutic response in a subject, at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10% of the cells have had one or more transgenes successfully integrated into the genome of the cell.

The method disclosed herein can be used for treating or preventing disease including, but not limited to, cancer, cardiovascular diseases, lung diseases, liver diseases, skin diseases, or neurological diseases.

Transplanting can be by any type of transplanting. Sites can include, but not limited to, liver subcapsular space, splenic subcapsular space, renal subcapsular space, omentum, gastric or intestinal submucosa, vascular segment of small intestine, venous sac, testis, brain, spleen, or cornea. For example, transplanting can be subcapsular transplanting. Transplanting can also be intramuscular transplanting. Transplanting can be intraportal transplanting.

Transplanting can be of one or more cells from a human. For example, the one or more cells can be from an organ, which can be a brain, heart, lungs, eye, stomach, pancreas, kidneys, liver, intestines, uterus, bladder, skin, hair, nails, ears, glands, nose, mouth, lips, spleen, gums, teeth, tongue, salivary glands, tonsils, pharynx, esophagus, large intestine, small intestine, rectum, anus, thyroid gland, thymus gland, bones, cartilage, tendons, ligaments, suprarenal capsule, skeletal muscles, smooth muscles, blood vessels, blood, spinal cord, trachea, ureters, urethra, hypothalamus, pituitary, pylorus, adrenal glands, ovaries, oviducts, uterus, vagina, mammary glands, testes, seminal vesicles, penis, lymph, lymph nodes or lymph vessels. The one or more cells can also be from a brain, heart, liver, skin, intestine, lung, kidney, eye, small bowel, or pancreas. The one or more cells can be from a pancreas, kidney, eye, liver, small bowel, lung, or heart. The one or more cells can be from a pancreas. The one or more cells can be pancreatic islet cells, for example, pancreatic β cells. The one or more cells can be any blood cells, such as peripheral blood mononuclear cell (PBMC), lymphocytes, monocytes or macrophages. The one or more cells can be any immune cells such as lymphocytes, B cells, or T cells.

The method disclosed herein can also comprise transplanting one or more cells, where the one or more cells can be can be any types of cells. For example, the one or more cells can be epithelial cells, fibroblast cells, neural cells, keratinocytes, hematopoietic cells, melanocytes, chondrocytes, lymphocytes (B and T), macrophages, monocytes, mononuclear cells, cardiac muscle cells, other muscle cells, granulosa cells, cumulus cells, epidermal cells, endothelial cells, pancreatic islet cells, blood cells, blood precursor cells, bone cells, bone precursor cells, neuronal stem cells, primordial stem cells, hepatocytes, keratinocytes, umbilical vein endothelial cells, aortic endothelial cells, microvascular endothelial cells, fibroblasts, liver stellate cells, aortic smooth muscle cells, cardiac myocytes, neurons, Kupffer cells, smooth muscle cells, Schwann cells, and epithelial cells, erythrocytes, platelets, neutrophils, lymphocytes, monocytes, eosinophils, basophils, adipocytes, chondrocytes, pancreatic islet cells, thyroid cells, parathyroid cells, parotid cells, tumor cells, glial cells, astrocytes, red blood cells, white blood cells, macrophages, epithelial cells, somatic cells, pituitary cells, adrenal cells, hair cells, bladder cells, kidney cells, retinal cells, rod cells, cone cells, heart cells, pacemaker cells, spleen cells, antigen presenting cells, memory cells, T cells, B cells, plasma cells, muscle cells, ovarian cells, uterine cells, prostate cells, vaginal epithelial cells, sperm cells, testicular cells, germ cells, egg cells, leydig cells, peritubular cells, sertoli cells, lutein cells, cervical cells, endometrial cells, mammary cells, follicle cells, mucous cells, ciliated cells, nonkeratinized epithelial cells, keratinized epithelial cells, lung cells, goblet cells, columnar epithelial cells, dopamiergic cells, squamous epithelial cells, osteocytes, osteoblasts, osteoclasts, dopaminergic cells, embryonic stem cells, fibroblasts and fetal fibroblasts. Further, the one or more cells can be pancreatic islet cells and/or cell clusters or the like, including, but not limited to pancreatic α cells, pancreatic β cells, pancreatic δ cells, pancreatic F cells (e.g., PP cells), or pancreatic ε cells. In one instance, the one or more cells can be pancreatic α cells. In another instance, the one or more cells can be pancreatic β cells.

Donor can be at any stage of development including, but not limited to, fetal, neonatal, young and adult. For example, donor T cells can be isolated from adult human. Donor human T cells can be under the age of 10, 9, 8, 7, 6, 5, 4, 3, 2, or 1 year(s). For example, T cells can be isolated from a human under the age of 6 years. T cells can also be isolated from a human under the age of 3 years. A donor can be older than 10 years.

a. Transplantation

The method disclosed herein can comprise transplanting. Transplanting can be auto transplanting, allotransplanting, xenotransplanting, or any other transplanting. For example, transplanting can be xenotransplanting. Transplanting can also be allotransplanting.

"Xenotransplantation" and its grammatical equivalents as used herein can encompass any procedure that involves transplantation, implantation, or infusion of cells, tissues, or organs into a recipient, where the recipient and donor are different species. Transplantation of the cells, organs, and/or tissues described herein can be used for xenotransplantation in into humans. Xenotransplantation includes but is not limited to vascularized xenotransplant, partially vascularized xenotransplant, unvascularized xenotransplant, xenodressings, xenobandages, and xenostructures.

"Allotransplantation" and its grammatical equivalents (e.g., allogenic transplantation) as used herein can encompass any procedure that involves transplantation, implantation, or infusion of cells, tissues, or organs into a recipient, where the recipient and donor are the same species but different individuals. Transplantation of the cells, organs, and/or tissues described herein can be used for allotransplantation into humans. Allotransplantation includes but is not limited to vascularized allotransplant, partially vascularized allotransplant, unvascularized allotransplant, allodressings, allobandages, and allostructures.

"Autotransplantation" and its grammatical equivalents (e.g., autologous transplantation) as used herein can encompass any procedure that involves transplantation, implantation, or infusion of cells, tissues, or organs into a recipient, where the recipient and donor is the same individual. Transplantation of the cells, organs, and/or tissues described herein can be used for autotransplantation into humans. Autotransplantation includes but is not limited to vascularized autotransplantation, partially vascularized autotransplantation, unvascularized autotransplantation, autodressings, autobandages, and autostructures.

After treatment (e.g., any of the treatment as disclosed herein), transplant rejection can be improved as compared to when one or more wild-type cells is transplanted into a recipient. For example, transplant rejection can be hyperacute rejection. Transplant rejection can also be acute rejection. Other types of rejection can include chronic rejection. Transplant rejection can also be cell-mediated rejection or T cell-mediated rejection. Transplant rejection can also be natural killer cell-mediated rejection.

"Improving" and its grammatical equivalents as used herein can mean any improvement recognized by one of skill in the art. For example, improving transplantation can mean lessening hyperacute rejection, which can encompass a decrease, lessening, or diminishing of an undesirable effect or symptom.

After transplanting, the transplanted cells can be functional in the recipient. Functionality can in some cases determine whether transplantation was successful. For example, the transplanted cells can be functional for at least or at least about 1, 2, 3, 4, 5, 6, 7, 8, 9, 10 or more days. This can indicate that transplantation was successful. This can also indicate that there is no rejection of the transplanted cells, tissues, and/or organs.

In certain instances, transplanted cells can be functional for at least 1 day. Transplanted cells can also functional for at least 7 day. Transplanted cells can be functional for at least 14 day. Transplanted cells can be functional for at least 21 day. Transplanted cells can be functional for at least 28 day. Transplanted cells can be functional for at least 60 days.

Another indication of successful transplantation can be the days a recipient does not require immunosuppressive therapy. For example, after treatment (e.g., transplantation) provided herein, a recipient can require no immunosuppressive therapy for at least or at least about 1, 2, 3, 4, 5, 6, 7, 8, 9, 10 or more days. This can indicate that transplantation was successful. This can also indicate that there is no rejection of the transplanted cells, tissues, and/or organs.

In some cases, a recipient can require no immunosuppressive therapy for at least 1 day. A recipient can also require no immunosuppressive therapy for at least 7 days. A recipient can require no immunosuppressive therapy for at least 14 days. A recipient can require no immunosuppressive therapy for at least 21 days. A recipient can require no immunosuppressive therapy for at least 28 days. A recipient can require no immunosuppressive therapy for at least 60 days. Furthermore, a recipient can require no immunosuppressive therapy for at least 1, 2, 3, 4, 5, 6, 7, 8, 9, 10, or more years.

Another indication of successful transplantation can be the days a recipient requires reduced immunosuppressive therapy. For example, after the treatment provided herein, a recipient can require reduced immunosuppressive therapy for at least 1, 2, 3, 4, 5, 6, 7, 8, 9, 10 or more days. This can indicate that transplantation was successful. This can also indicate that there is no or minimal rejection of the transplanted cells, tissues, and/or organs.

In some cases, a recipient can require no immunosuppressive therapy for at least 1 day. A recipient can also require no immunosuppressive therapy for at least or at least about 7 days. A recipient can require no immunosuppressive therapy for at least or at least about 14 days. A recipient can require no immunosuppressive therapy for at least or at least about 21 days. A recipient can require no immunosuppressive therapy for at least or at least about 28 days. A recipient can require no immunosuppressive therapy for at least or at least about 60 days. Furthermore, a recipient can require no immunosuppressive therapy for at least or at least about 1, 2, 3, 4, 5, 6, 7, 8, 9, 10, or more years.

Another indication of successful transplantation can be the days a recipient requires reduced immunosuppressive therapy. For example, after the treatment provided herein, a recipient can require reduced immunosuppressive therapy for at least or at least about 1, 2, 3, 4, 5, 6, 7, 8, 9, 10 or more days. This can indicate that transplantation was successful. This can also indicate that there is no or minimal rejection of the transplanted cells, tissues, and/or organs.

"Reduced" and its grammatical equivalents as used herein can refer to less immunosuppressive therapy compared to a required immunosuppressive therapy when one or more wild-type cells is transplanted into a recipient.

Immunosuppressive therapy can comprise any treatment that suppresses the immune system. Immunosuppressive therapy can help to alleviate, minimize, or eliminate transplant rejection in a recipient. For example, immunosuppressive therapy can comprise immuno-suppressive drugs. Immunosuppressive drugs that can be used before, during and/or after transplant, but are not limited to, MMF (mycophenolate mofetil (Cellcept)), ATG (anti-thymocyte globulin), anti-CD154 (CD40L), anti-CD40 (2C10, ASKP1240, CCFZ533X2201), alemtuzumab (Campath), anti-CD20 (rituximab), anti-IL-6R antibody (tocilizumab, Actemra), anti-IL-6 antibody (sarilumab, olokizumab), CTLA4-Ig (Abatacept/Orencia), belatacept (LEA29Y), sirolimus (Rapimune), everolimus, tacrolimus (Prograf), daclizumab (Ze-napax), basiliximab (Simulect), infliximab (Remicade), cyclosporin, deoxyspergualin, soluble complement receptor 1, cobra venom factor, compstatin, anti C5 antibody (eculizumab/Soliris), methylprednisolone, FTY720, everolimus, leflunomide, anti-IL-2R-Ab, rapamycin, anti-CXCR3 antibody, anti-ICOS antibody, anti-OX40 antibody, and anti-CD122 antibody. Furthermore, one or more than one immunosuppressive agents/drugs can be used together or sequentially. One or more than one immunosuppressive agents/drugs can be used for induction therapy or for maintenance therapy. The same or different drugs can be used during induction and maintenance stages. In some cases, daclizumab (Zenapax) can be used for induction therapy and tacrolimus (Prograf) and sirolimus (Rapimune) can be used for maintenance therapy. Daclizumab (Zenapax) can also be used for induction therapy and low dose tacrolimus (Prograf) and low dose sirolimus (Rapimune) can be used for maintenance therapy. Immunosuppression can also be achieved using non-drug regimens including, but not limited to, whole body irradiation, thymic irradiation, and full and/or partial splenectomy. These techniques can also be used in combination with one or more immuno-suppressive drugs.

EXAMPLES

Example 1: Determine the Transfection Efficiency of Various Nucleic Acid Delivery Platforms Isolation of Peripheral Blood Mononuclear Cells (PBMCs) from a LeukoPak Leukopaks collected from normal peripheral blood were used herein. Blood cells were diluted 3 to 1 with chilled 1X PBS. The diluted blood was added dropwise (e.g., very slowly) over 15 mLs of LYMPHOPREP (Stem Cell Technologies) in a 50 ml conical. Cells were spun at 400×G for 25 minutes with no brake. The buffy coat was slowly removed and placed into a sterile conical. The cells were washed with chilled 1X PBS and spun for 400×G for 10 minutes. The supernatant was removed, cells resuspended in media, counted and viably frozen in freezing media (45 mLs heat inactivated FBS and 5 mLs DMSO).

Isolation of CD3+ T Cells

PBMCs were thawed and plated for 1-2 hours in culturing media (RPMI-1640 (with no Phenol red), 20% FBS (heat inactivated), and 1X Gluta-MAX). Cells were collected and counted; the cell density was adjusted to $5 \times 10^7$ cells/mL and transferred to sterile 14 mL polystyrene round-bottom tube. Using the EasySep Human CD3 cell Isolation Kit (Stem Cell Technologies), 50 uL/mL of the Isolation Cocktail was added to the cells. The mixture was mixed by pipetting and incubated for 5 minutes at room temperature. After incubation, the RapidSpheres were vortexed for 30 seconds and added at 50 uL/mL to the sample; mixed by pipetting. Mixture was topped off to 5 mLs for samples less than 4 mLs or topped off to 10 mLs for samples more than 4 mLs. The sterile polystyrene tube was added to the "Big Easy" magnet; incubated at room temperature for 3 minutes. The magnet and tube, in one continuous motion, were inverted, pouring off the enriched cell suspension into a new sterile tube.

Activation and Stimulation of CD3+ T Cells

Isolated CD3+ T cells were counted and plated out at a density of $2 \times 10^6$ cells/mL in a 24 well plate. Dynabeads Human T-Activator CD3/CD28 beads (Gibco, Life Technologies) were added 3:1 (beads:cells) to the cells after being washed with 1×PBS with 0.2% BSA using a dynamagnet. IL-2 (Peprotech) was added at a concentration of 300 IU/mL. Cells were incubated for 48 hours and then the beads were removed using a dynamagnet. Cells were cultured for an additional 6-12 hours before electroporation or nucleofection.

Amaxa Transfection of CD3+ T Cells

Figure 82:
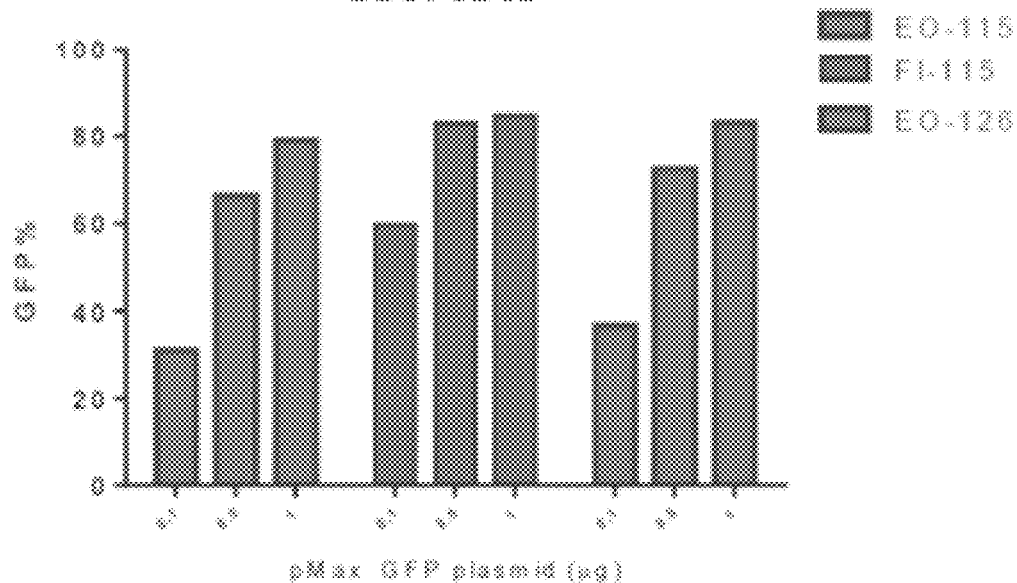
FIG. 82 A shows optimization conditions for Lonza nucleofection of T cell double strand DNA transfection. Cell number vs concentration of a plasmid encoding GFP.
Figure 82:
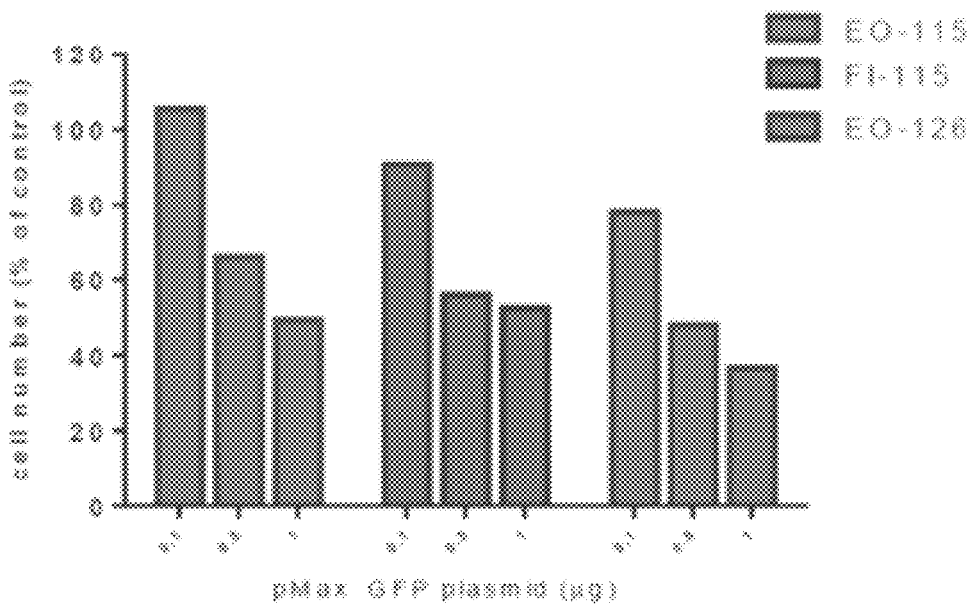

Unstimulated or stimulated T cells were nucleofected using the Amaxa Human T Cell Nucleofector Kit (Lonza, Switzerland), FIG. 82 A and FIG. 82 B. Cells were counted and resuspended at of density of $1-8 \times 10^6$ cells in 100 uL of room temperature Amaxa buffer. 1-15 ug of mRNA or plasmids were added to the cell mixture. Cells were nucleofected using the U-014 program. After nucleofection, cells were plated in 2 mLs culturing media in a 6 well plate.

Neon Transfection of CD3+ T Cells

Unstimulated or stimulated T cells were electroporated using the Neon Transfection System (10 uL Kit, Invitrogen, Life Technologies). Cells were counted and resuspended at a density of $2 \times 10^5$ cells in 10 uL of T buffer. 1 ug of GFP plasmid or mRNA or 1 ug Cas9 and 1 ug of gRNA plasmid were added to the cell mixture. Cells were electroporated at 1400 V, 10 ms, 3 pulses. After transfection, cells were plated in a 200 uL culturing media in a 48 well plate.

Lipofection of RNA and Plasmid DNA Transfections of CD3+ T Cells

Unstimulated T cells were plated at a density of $5 \times 10^5$ cells per mL in a 24 well plate. For RNA transfection, T cells were transfected with 500 ng of mRNA using the TransIT-mRNA Transfection Kit (Mirus Bio), according to the manufacturer's protocol. For Plasmid DNA transfection, the T cells were transfected with 500 ng of plasmid DNA using the TransIT-X2 Dynamic Delivery System (Mirus Bio), according to the manufacturer's protocol. Cells were incubated at 37° C. for 48 hours before being analyzed by flow cytometry.

CD3+ T Cell Uptake of Gold Nanoparticle SmartFlares

Unstimulated or stimulated T cells were plated at a density of $1-2 \times 10^5$ cells per well in a 48 well plate in 200 uL of culturing media. Gold nanoparticle SmartFlared complexed to Cy5 or Cy3 (Millipore, Germany) were vortexed for 30 seconds prior to being added to the cells. 1 uL of the gold nanoparticle SmartFlares was added to each well of cells. The plate was rocked for 1 minute incubated for 24 hours at 37° C. before being analyzed for Cy5 or Cy3 expression by flow cytometry.

Flow Cytometry

Electroporated and nucleofected T cells were analyzed by flow cytometry 24-48 hours post transfection for expression of GFP. Cells were prepped by washing with chilled 1X PBS with 0.5% FBS and stained with APC anti-human CD3ε (eBiosciences, San Diego) and Fixable Viability Dye eFlour 780 (eBiosciences, San Diego). Cells were analyzed using a LSR II (BD Biosciences, San Jose) and FlowJo v.9.

Results

As shown in Table 2, a total of six cell and DNA/RNA combinations were tested using four exemplary transfection platforms. The six cell and DNA/RNA combinations were: adding EGFP plasmid DNA to unstimulated PBMCs; adding EGFP plasmid DNA to unstimulated T cells; adding EGFP plasmid DNA to stimulated T cells; adding EGFP mRNA to unstimulated PBMCs; adding EGFP mRNA to unstimulated T cells; and adding EGFP mRNA to stimulated T cells. The four exemplary transfection platforms were: AMAXA Nucleofection, NEON Eletrophoration, Lipid-based Transfection, and Gold Nanoparticle delivery. The transfection efficiency (% of transfected cells) results under various conditions were listed in Table 1 and adding mRNA to stimulated T cells using AMAXA platform provides the highest efficiency.

TABLE 2

The transfection efficiency of various nucleic acid delivery platforms.

| Cell type | DNA or RNA | Nucleic Acid Delivery Platforms | | | |
|---|---|---|---|---|---|
| | | Amaxa | NEON | Lipid Based | Gold Nanoparticle |
| PBMCs loading (unstimulated) | EGFP Plasmid | 8.1% (CD3 T-Cells) | | | |
| T-Cell loading (unstimulated) | EGFP Plasmid | 28.70% | >0.1% (DNA) | >0.1% (RNA) | 54.8% Cy5 Pos. |
| T-Cell loading (Stimulated, CD3/CD28) | EGFP Plasmid | | 32.10% >0.1% (DNA) | >0.1% (RNA) | |
| PBMCs loading (unstimulated) | EGFP mRNA | 28.1% (CD3 T-Cells) | | | |
| T-Cell loading (unstimulated) | EGFP mRNA | 29.80% | | | |
| T-Cell loading (Stimulated, CD3/CD28) | EGFP mRNA | 90.30% | 81.40% | | 29.1% Cy5 Pos. |

Other transfection conditions including exosome-mediated transfection will be tested using similar methods in the future. In addition, other delivery combinations including DNA Cas9/DNA gRNA, mRNA Cas9/DNA gRNA, protein Cas9/DNA gRNA, DNA Cas9/PCR product of gRNA, DNA Cas9/PCR product of gRNA, mRNA Cas9/PCR product of gRNA, protein Cas9/PCR product of gRNA, DNA Cas9/modified gRNA, mRNA Cas9/modified gRNA, and protein Cas9/modified gRNA, will also be tested using similar methods. The combinations with high delivery efficiency can be used in the methods disclosed herein.

Example 2: Determine the Transfection Efficiency of a GFP Plasmid in T Cells

The transfection efficiency of primary T cells with Amaxa Nucleofection using a GFP plasmid. FIG. 4 showed the structures of four plasmids prepared for this experiment: Cas9 nuclease plasmid, HPRT gRNA plasmid (CRISPR gRNA targeting human HPRT gene), Amaxa EGFPmax plasmid and HPRT target vector. The HPRT target vector had targeting arms of 0.5 kb (FIG. 5). The sample preparation, flow cytometry and other methods were similar to experiment 1. The plasmids were prepared using the endotoxin free kit (Qiagen). Different conditions (shown in Table 3) including cell number and plasmid combination were tested.

TABLE 3

The different conditions used in the experiment.

| Sample ID | #PBMCs | Plasmids | GFP' (ug) | Cas9' (ug) | gRNA' (ug) | target' (ug) |
|---|---|---|---|---|---|---|
| 1 | 5 × 10^6 | GFP | 5 | 0 | 0 | 0 |
| 2 | 2 × 10^7 | Cas9 | 0.1 | 20 | 0 | 0 |
| 3 | 2 × 10^7 | Cas9 + gRNA | 0.1 | 10 | 10 | 0 |
| 4 | 2 × 10^7 | Cas9 + gRNA + Target | 0.1 | 5 | 5 | 10 |
| 5 | 2 × 10^7 | Cas9 + gRNA + Target | 0.1 | 2.5 | 2.5 | 15 |
| 6 | 2 × 10^7 | GFP | 5 | 0 | 0 | 0 |

Results

Figure 7:
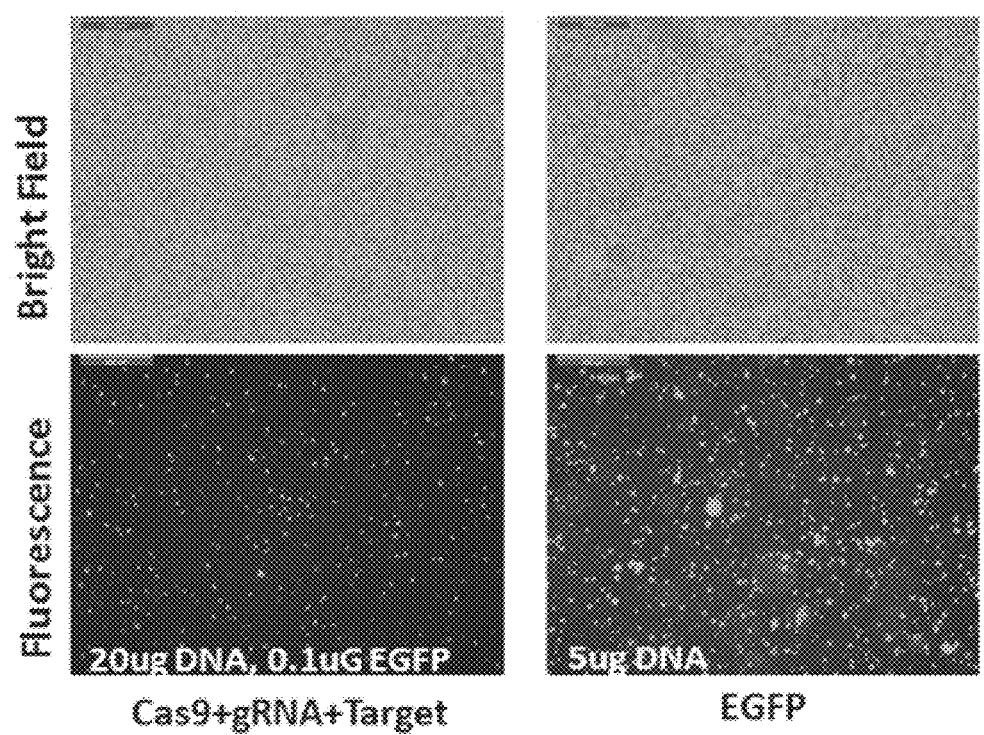
FIG. 7 demonstrates that Cas9+gRNA+Target plasmids co-transfection had good transfection efficiency in bulk population.
Figure 8:
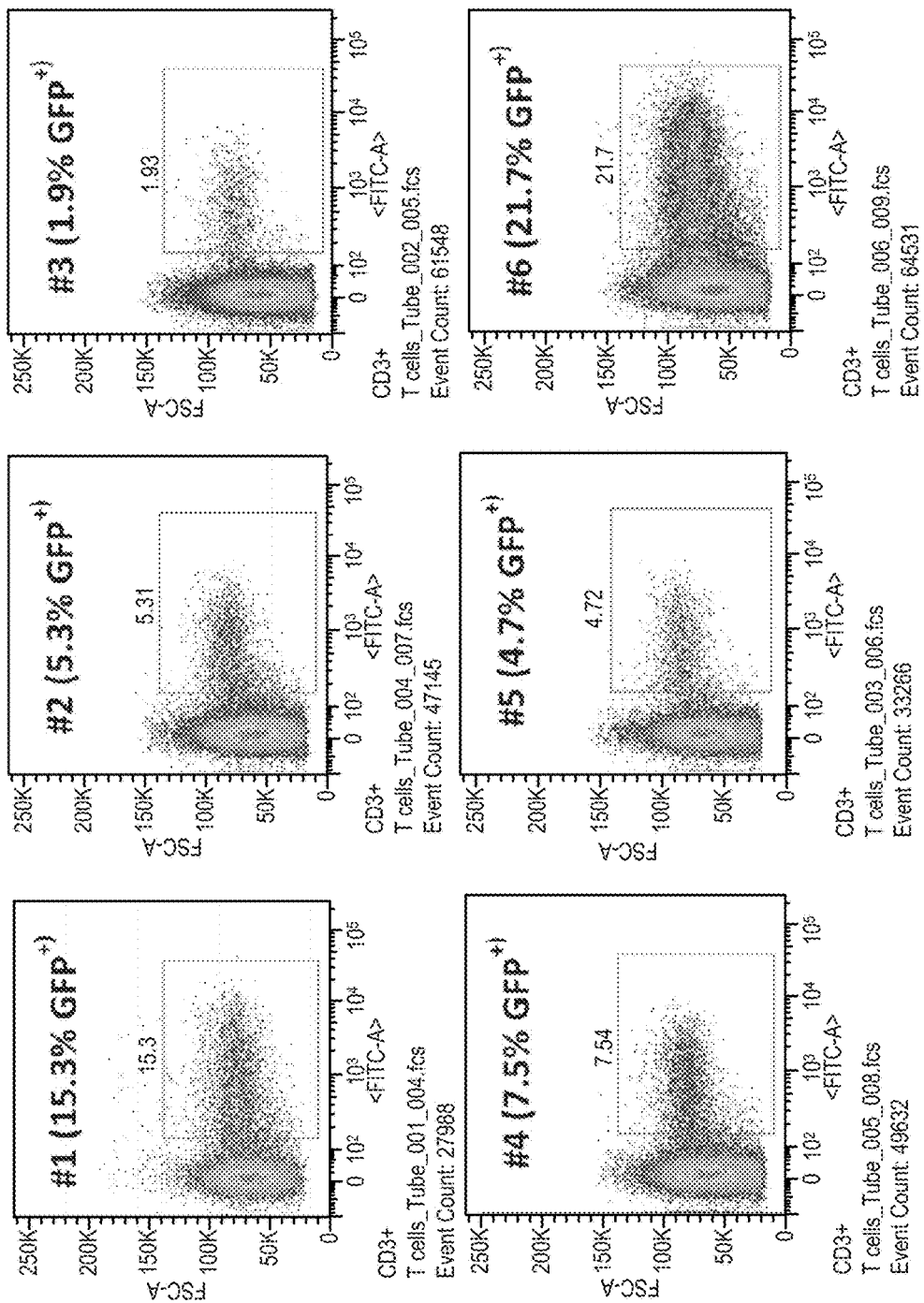
FIG. 8 demonstrates the results of the EGFP FACS analysis of CD3+ T cells.
Figure 9:
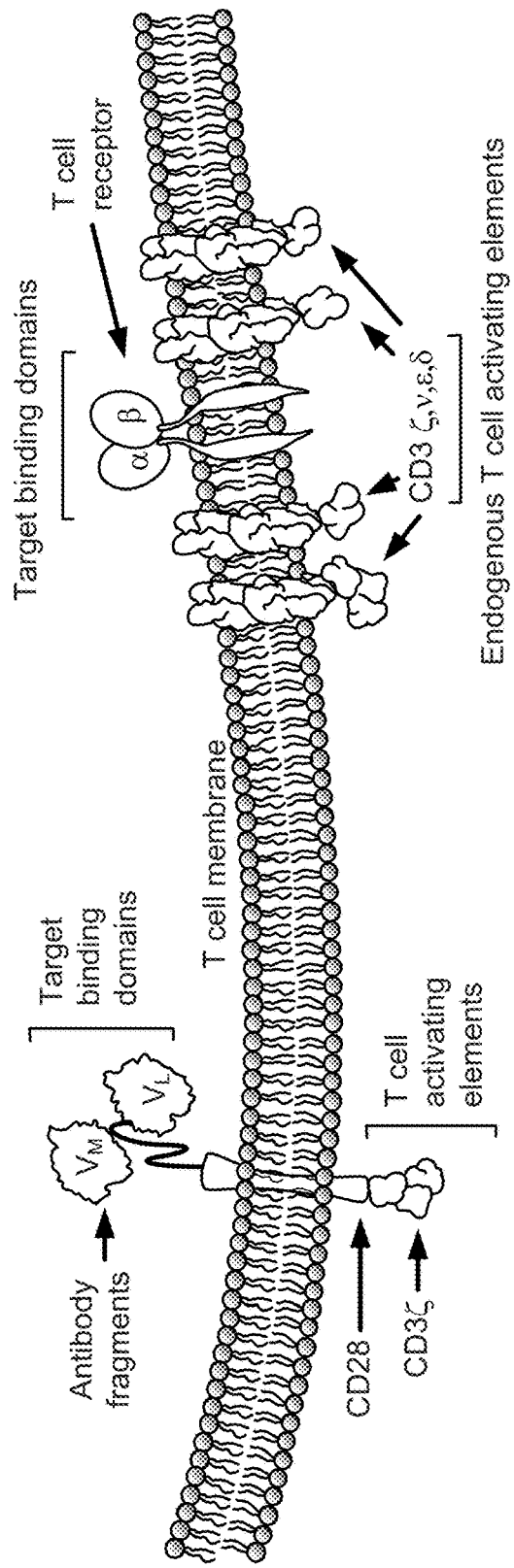
FIG. 9 shows two types of T cell receptors.
Figure 40:
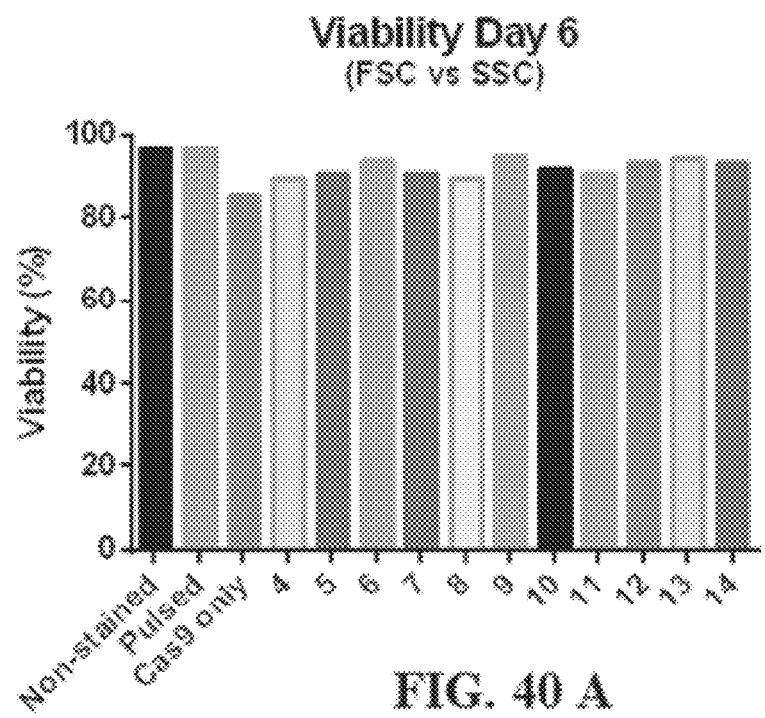
FIG. 40 A shows viability of human T cells on day 6 post CRISPR transfection.
Figure 40:
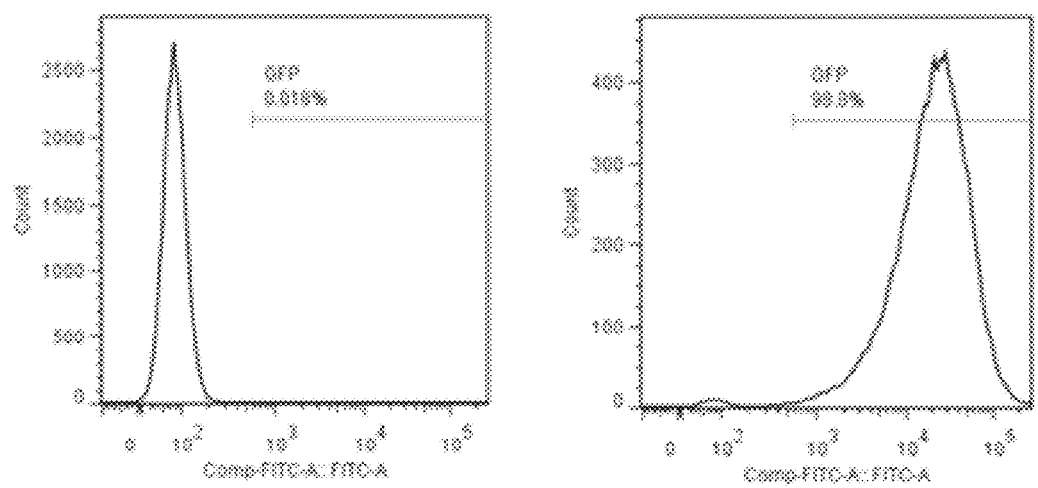
Figure 41:
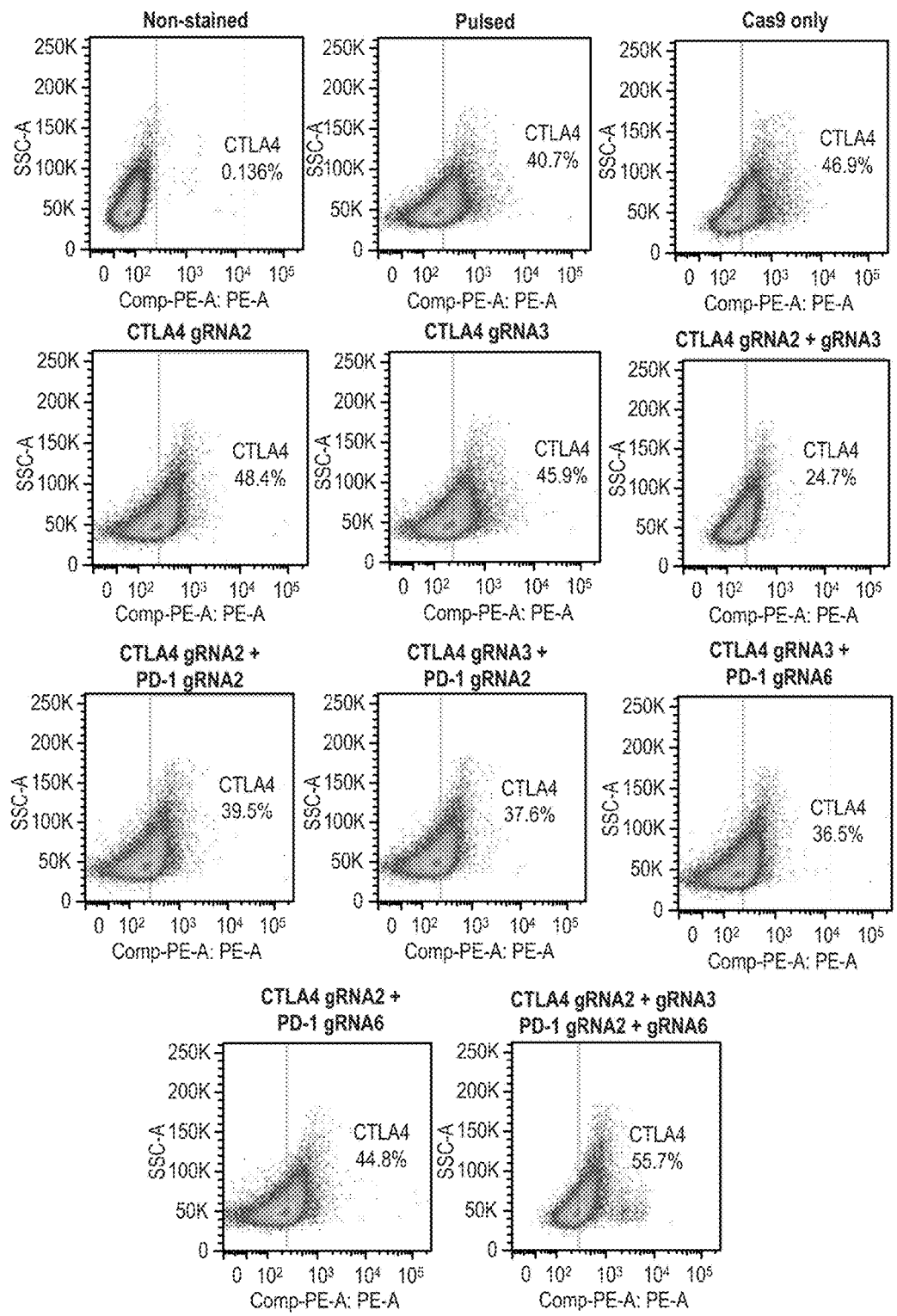
FIG. 41 shows FACs analysis of CTLA-4 expression in stained human T cells transfected with anti-CTLA-4 CRISPR guide RNAs. PE is anti-human CD152 (CTLA-4).
Figure 42:
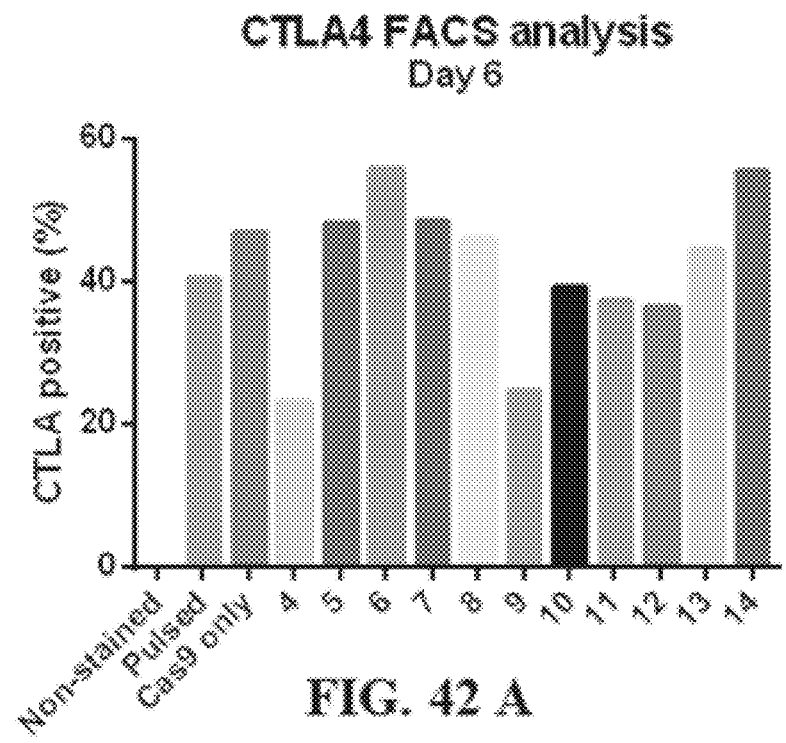
FIG. 42 A and FIG. 42 B show CTLA-4 FACs analysis of CTLA-4 positive human T cells post transfection with anti-CTLA-4 guide RNAs and CRISPR.
Figure 42:
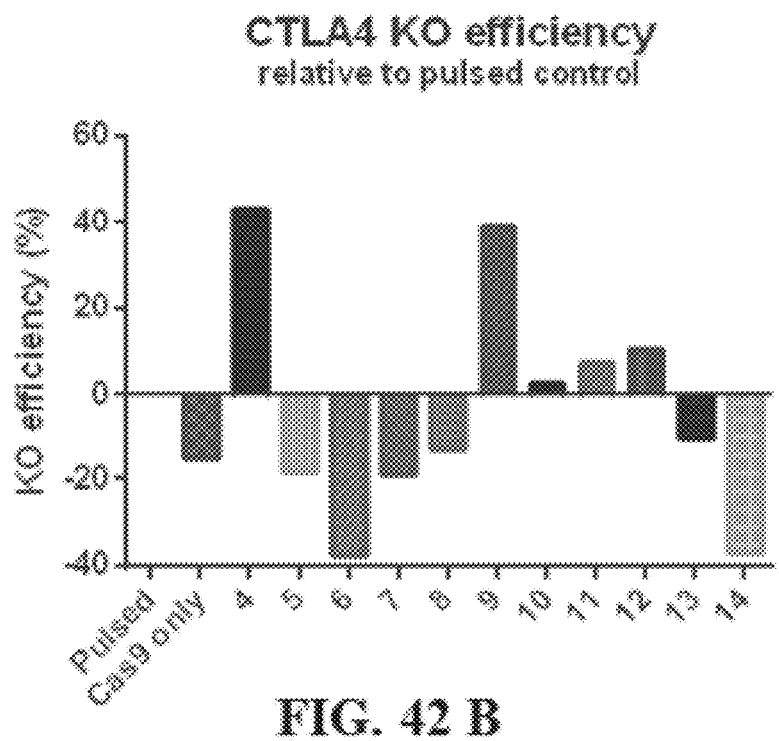

FIG. 7 demonstrated that the Cas9+gRNA+Target plasmids co-transfection had good transfection efficiency in bulk population. FIG. 8 showed the results of the EGFP FACS analysis of CD3+ T cells. Different transfection efficiencies were demonstrated using the above conditions. FIG. 40 A and FIG. 40 B show viability and transfection efficiency on day 6 post CRISPR transfection with a donor transgene (% GFP+).

Example 3: Identify gRNA with Highest Double Strand Break (DSB) Induction at Each Gene Site Design and Construction of Guide RNAs:

Guide RNAs (gRNAs) were designed to the desired region of a gene using the CRISPR Design Program (Zhang Lab, M I T 2015). Multiple primers to generate gRNAs (shown in Table 4) were chosen based on the highest ranked values determined by off-target locations. The gRNAs were ordered in oligonucleotide pairs: 5'-CACCG-gRNA sequence-3' and 5'-AAAC-reverse complement gRNA sequence-C-3' (sequences of the oligonucleotide pairs are listed in Table 4).

TABLE 4

Primers used to generate the gRNAs (the sequence CACCG is added to the sense and AAAC to the antisense for cloning purposes).

| SEQ ID | Primer Name | Sequence 5'-3' |
|---|---|---|
| 5 | HPRT gRNA 1 Sense | CACCGCACGTGTGAACCAACCCGCC |
| 6 | HPRT gRNA 1 Anti | AAACGGCGGGTTGGTTCACACGTGC |
| 7 | HPRT gRNA 2 Sense | CACCGAAACAACAGGCCGGGCGGGT |
| 8 | HPRT gRNA 2 Anti | AAACACCCGCCCGGCCTGTTGTTTC |
| 9 | HPRT gRNA 3 Sense | CACCGACAAAAAATTAGCCGGGTG |
| 10 | HPRT gRNA 3 Anti | AAACCACCCGGCTAATTTTTTTGT |
| 11 | HPRT gRNA 4 Sense | CACCGTAAATTTCTCTGATAGACTA |
| 12 | HPRT gRNA 4 Anti | AAACTAGTCTATCAGAGAAATTTAC |
| 13 | HPRT gRNA 5 Sense | CACCGTGTTTCAATGAGAGCATTAC |

TABLE 4-continued

Primers used to generate the gRNAs (the sequence CACCG is added to the sense and AAAC to the antisense for cloning purposes).

| SEQ ID | Primer Name | Sequence 5'-3' |
|---|---|---|
| 14 | HPRT gRNA 5 Anti | AAACGTAATGCTCTCATTGAAACAC |
| 15 | HPRT gRNA 6 Sense | CACCGGTCTCGAACTCCTGAGCTC |
| 16 | HPRT gRNA 6 Anti | AAACGAGCTCAGGAGTTCGAGACC |
| 17 | HPRT Cell For | AGTGAAGTGGCGCATTCTTG |
| 18 | HPRT Cell Rev | CACCCTTTCCAAATCCTCAGC |
| 19 | AAVS1 gRNA 1 Sense | CACCGTGGGGGTTAGACCCAATATC |
| 20 | AAVS1 gRNA 1 Anti | AAACGATATTGGGTCTAACCCCCAC |
| 21 | AAVS1 gRNA 2 Sense | CACCGACCCCACAGTGGGGCCACTA |
| 22 | AAVS1 gRNA 2 Anti | AAACTAGTGGCCCCACTGTGGGGTC |
| 23 | AAVS1 gRNA 3 Sense | CACCGAGGGCCGGTTAATGTGGCTC |
| 24 | AAVS1 gRNA 3 Anti | AAACGAGCCACATTAACCGGCCCTC |
| 25 | AAVS1 gRNA 4 Sense | CACCGTCACCAATCCTGTCCCTAG |
| 26 | AAVS1 gRNA 4 Anti | AAACCTAGGGACAGGATTGGTGAC |
| 27 | AAVS1 gRNA 5 Sense | CACCGCCGGCCCTGGGAATATAAGG |
| 28 | AAVS1 gRNA 5 Anti | AAACCCTTATATTCCCAGGGCCGGC |
| 29 | AAVS1 gRNA 6 Sense | CACCGCGGGCCCCTATGTCCACTTC |
| 30 | AAVS1 gRNA 6 Anti | AAACGAAGTGGACATAGGGGCCCGC |
| 31 | AAVS1 Cell For | ACTCCTTTCATTTGGGCAGC |
| 32 | AAVS1 Cell Rev | GGTTCTGGCAAGGAGAGAGA |
| 33 | PD-1 gRNA 1 Sense | CACCGCGGAGAGCTTCGTGCTAAAC |
| 34 | PD-1 gRNA 1 Anti | AAACGTTTAGCACGAAGCTCTCCGC |
| 35 | PD-1 gRNA 2 Sense | CACCGCCTGCTCGTGGTGACCGAAG |
| 36 | PD-1 gRNA 2 Anti | AAACCTTCGGTCACCACGAGCAGGC |
| 37 | PD-1 gRNA 3 Sense | CACCGCAGCAACCAGACGGACAAGC |
| 38 | PD-1 gRNA 3 Anti | AAACGCTTGTCCGTCTGGTTGCTGC |
| 39 | PD-1 gRNA 4 Sense | CACCGAGGCGGCCAGCTTGTCCGTC |
| 40 | PD-1 gRNA 4 Anti | AAACGACGGACAAGCTGGCCGCCTC |
| 41 | PD-1 gRNA 5 Sense | CACCGCGTTGGGCAGTTGTGTGACA |
| 42 | PD-1 gRNA 5 Anti | AAACTGTCACACAACTGCCCAACGC |
| 43 | PD-1 gRNA 6 Sense | CACCGACGGAAGCGGCAGTCCTGGC |
| 44 | PD-1 gRNA 6 Anti | AAACGCCAGGACTGCCGCTTCCGTC |
| 45 | PD-1 Cell For | AGAAGGAAGAGGCTCTGCAG |
| 46 | PD-1 Cell Rev | CTCTTTGATCTGCGCCTTGG |
| 47 | CTLA4 gRNA 1 Sense | CACCGCCGGGTGACAGTGCTTCGGC |
| 48 | CTLA4 gRNA 1 Anti | AAACGCCGAAGCACTGTCACCCGGC |
| 49 | CTLA4 gRNA 2 Sense | CACCGTGCGGCAACCTACATGATG |
| 50 | CTLA4 gRNA 2 Anti | AAACCATCATGTAGGTTGCCGCAC |
| 51 | CTLA4 gRNA 3 Sense | CACCGCTAGATGATTCCATCTGCAC |
| 52 | CTLA4 gRNA 3 Anti | AAACGTGCAGATGGAATCATCTAGC |
| 53 | CTLA4 gRNA 4 Sense | CACCGAGGTTCACTTGATTTCCAC |
| 54 | CTLA4 gRNA 4 Anti | AAACGTGGAAATCAAGTGAACCTC |
| 55 | CTLA4 gRNA 5 Sense | CACCGCCGCACAGACTTCAGTCACC |
| 56 | CTLA4 gRNA 5 Anti | AAACGGTGACTGAAGTCTGTGCGGC |
| 57 | CTLA4 gRNA 6 Sense | CACCGCTGGCGATGCCTCGGCTGC |
| 58 | CTLA4 gRNA 6 Anti | AAACGCAGCCGAGGCATCGCCAGC |
| 59 | CTLA4 Cell For | TGGGGATGAAGCTAGAAGGC |
| 60 | CTLA4 Cell Rev | AATCTGGGTTCCGTTGCCTA |
| 61 | CCR5 gRNA 1 Sense | CACCGACAATGTGTCAACTCTTGAC |
| 62 | CCR5 gRNA 1 Anti | AAACGTCAAGAGTTGACACATTGTC |
| 63 | CCR5 gRNA 2 Sense | CACCGTCATCCTCCTGACAATCGAT |
| 64 | CCR5 gRNA 2 Anti | AAACATCGATTGTCAGGAGGATGAC |
| 65 | CCR5 gRNA 3 Sense | CACCGGTGACAAGTGTGATCACTT |
| 66 | CCR5 gRNA 3 Anti | AAACAAGTGATCACACTTGTCACC |
| 67 | CCR5 gRNA 4 Sense | CACCGACACAGCATGGACGACAGCC |
| 68 | CCR5 gRNA 4 Anti | AAACGGCTGTCGTCCATGCTGTGTC |
| 69 | CCR5 gRNA 5 Sense | CACCGATCTGGTAAAGATGATTCC |
| 70 | CCR5 gRNA 5 Anti | AAACGGAATCATCTTTACCAGATC |
| 71 | CCR5 gRNA 6 Sense | CACCGTTGTATTTCCAAAGTCCCAC |
| 72 | CCR5 gRNA 6 Anti | AAACGTGGGACTTTGGAAATACAAC |
| 73 | CCR5 Cell For | CTCAACCTGGCCATCTCTGA |
| 74 | CCR5 Cell Rev | CCCGAGTAGCAGATGACCAT |

The gRNAs were cloned together using the target sequence cloning protocol (Zhang Lab, MIT). Briefly, the oligonucleotide pairs were phosphorylated and annealed together using T4 PNK (NEB) and 10X T4 Ligation Buffer (NEB) in a thermocycler with the following protocol: 37° C. 30 minutes, 95° C. 5 minutes and then ramped down to 25° C. at 5° C./minute. pENTR1-U6-Stuffer-gRNA vector (made in house) was digested with FastDigest BbsI (Fermentas), FastAP (Fermentas) and 10X Fast Digest Buffer were used for the ligation reaction. The digested pENTR1 vector was ligated together with the phosphorylated and annealed oligo duplex (dilution 1:200) from the previous step using T4 DNA Ligase and Buffer (NEB). The ligation was incubated at room temperature for 1 hour and then transformed and subsequently mini-prepped using GeneJET Plasmid Miniprep Kit (Thermo Scientific). The plasmids were sequenced to confirm the proper insertion.

TABLE 5

Engineered CISH guide RNA (gRNA) target sequences

| SEQ ID | gRNA No. | Exon | Target 5'-3' |
|---|---|---|---|
| 75 | 1 | 2 | TTGCTGGCTGTGGAGCGGAC |
| 76 | 2 | 2 | GACTGGCTTGGGCAGTTCCA |
| 77 | 3 | 2 | TGCTGGGGCCTTCCTCGAGG |
| 78 | 4 | 2 | CCGAAGGTAGGAGAAGGTCT |
| 79 | 5 | 2 | ATGCACAGCAGATCCTCCTC |
| 80 | 6 | 2 | AGAGAGTGAGCCAAAGGTGC |
| 81 | 1 | 3 | GGCATACTCAATGCGTACAT |
| 82 | 2 | 3 | GGGTTCCATTACGGCCAGCG |
| 83 | 3 | 3 | AAGGCTGACCACATCCGGAA |
| 84 | 4 | 3 | TGCCGACTCCAGCTTCCGTC |
| 85 | 5 | 3 | CTGTCAGTGAAAACCACTCG |
| 86 | 6 | 3 | CGTACTAAGAACGTGCCTTC |

Genomic sequences that are targeted by engineered gRNAs are shown in Table 5 and Table 6. FIG. 44 A and FIG. 44 B show modified gRNA targeting the CISH gene.

TABLE 6

AAVS1 gRNA target sequence

| SEQ ID | Gene | gRNA Sequence (5' to 3') |
|---|---|---|
| 87 | AAVS1 | GTCACCAATCCTGTCCCTAG- |

Validation of gRNAs

Figure 60:
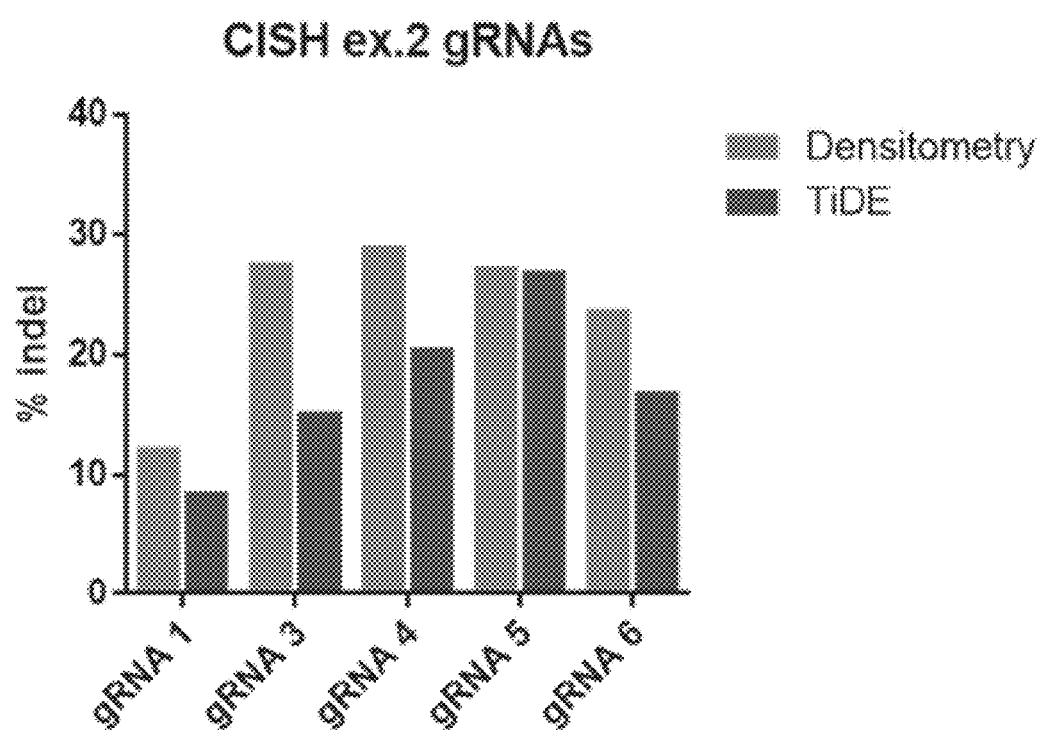
FIG. 60 shows TIDE and densitometry data comparison for 293T cells transfected with CRISPR and CISH gRNAs 1, 3, 4, 5 or 6.
Figure 61:
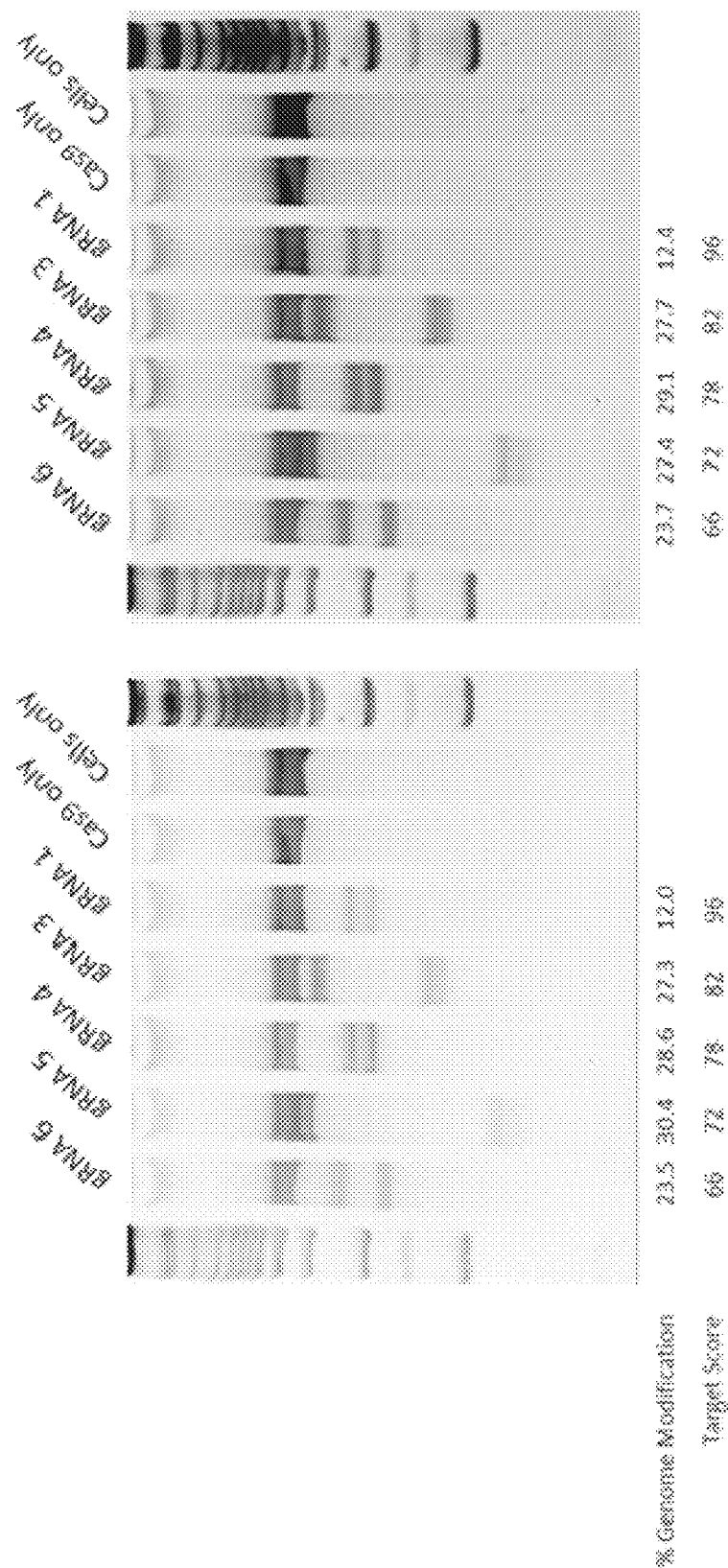
FIG. 61 depicts duplicate experiments of densitometry analysis for 293T cells transfected with CRISPR and CISH gRNAs 1, 3, 4, 5 or 6.
Figure 62A:
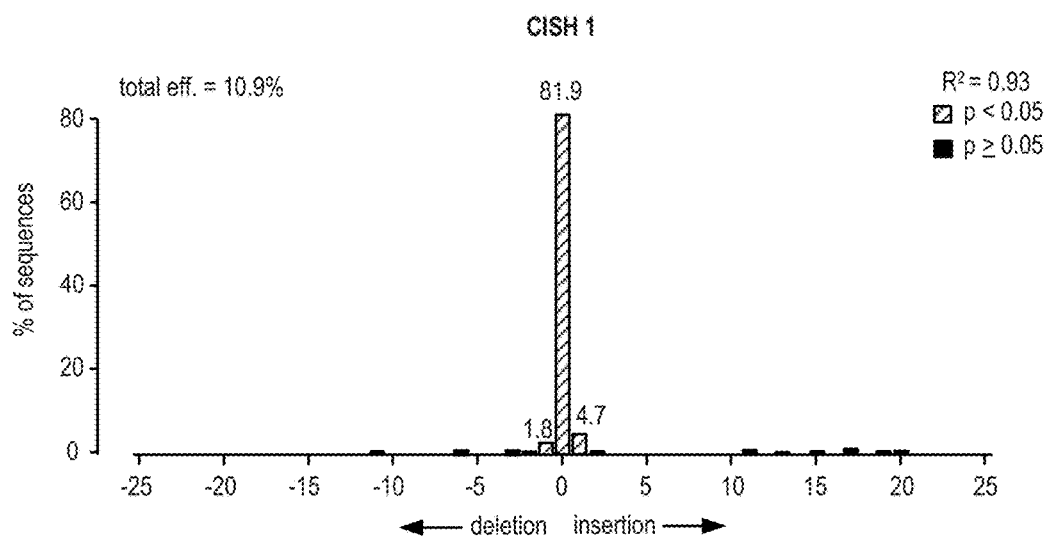
FIG. 62 A and FIG. 62 B show duplicate TIDE analyses of CISH gRNA 1.
Figure 62B:
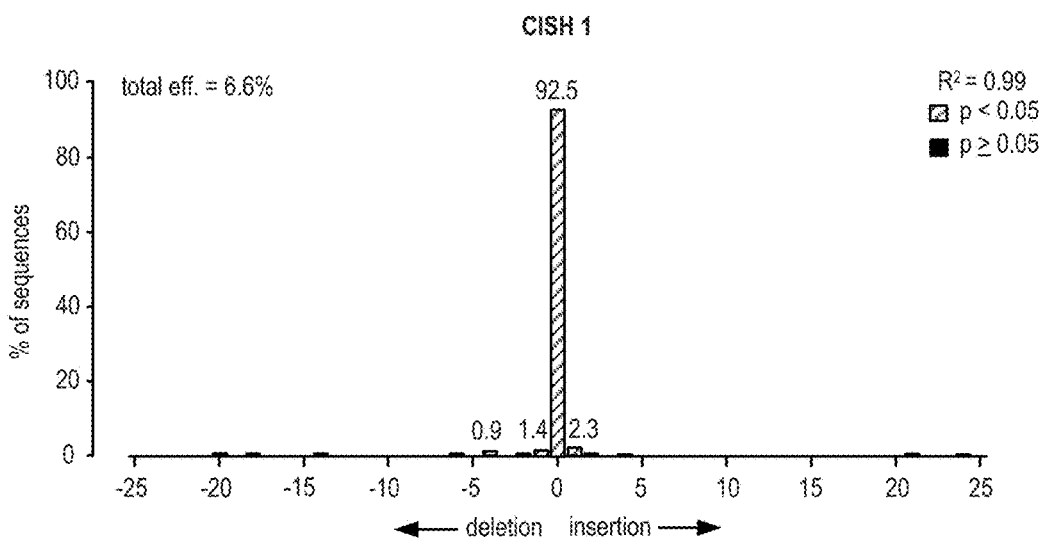
Figure 63A:
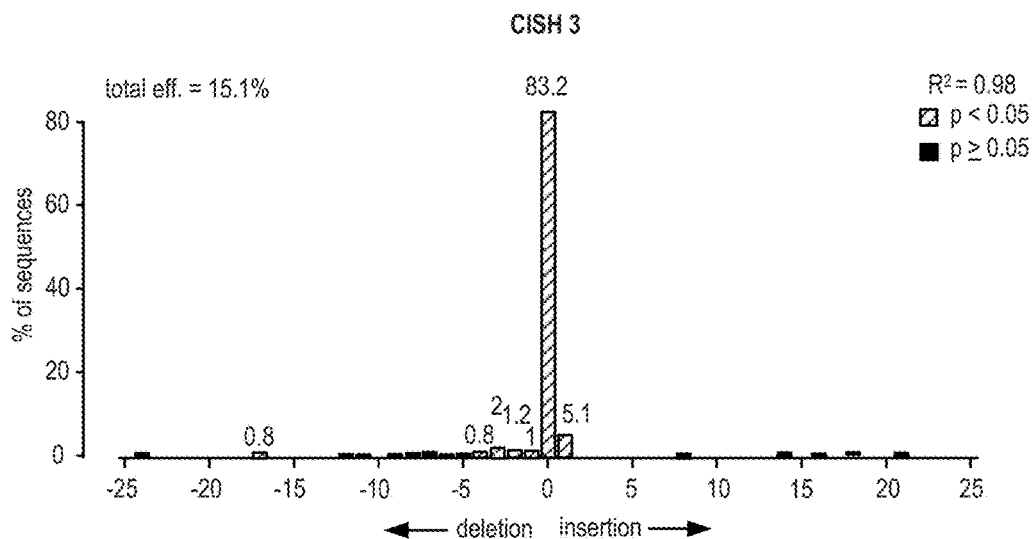
FIG. 63 A and FIG. 63 B show duplicate TIDE analyses of CISH gRNA 3.
Figure 63B:
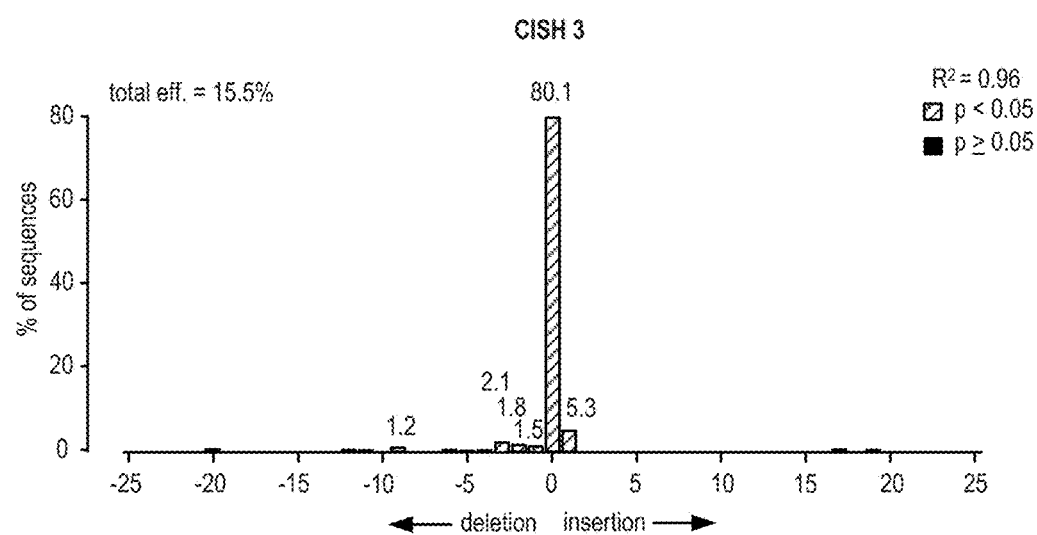
Figure 64A:
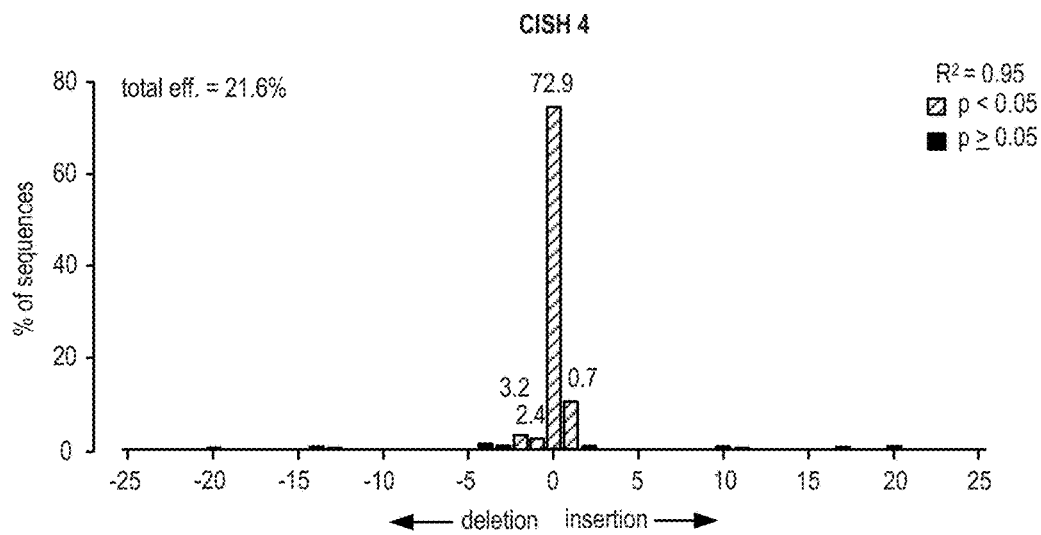
FIG. 64 A and FIG. 64 B show duplicate TIDE analyses of CISH gRNA 4.
Figure 64B:
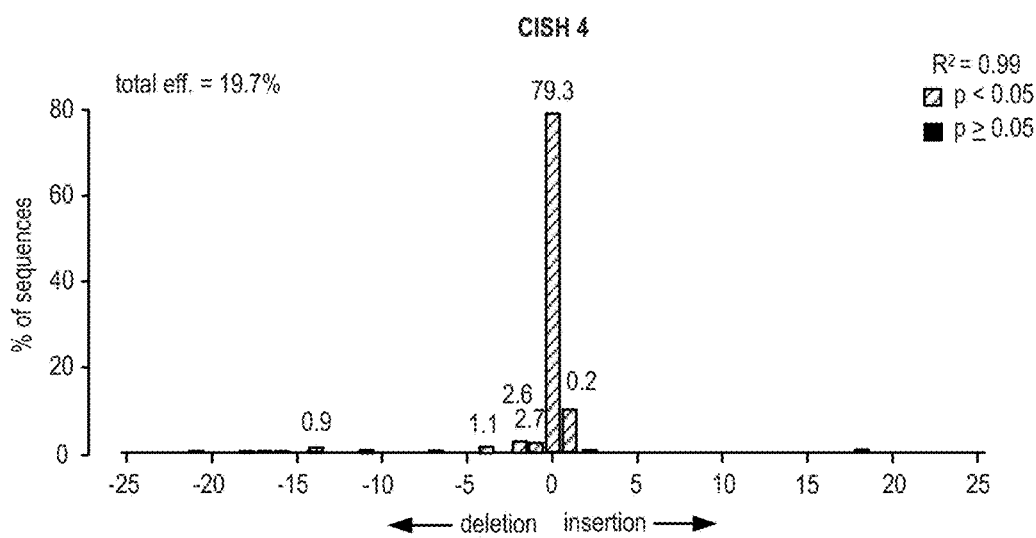
Figure 65A:
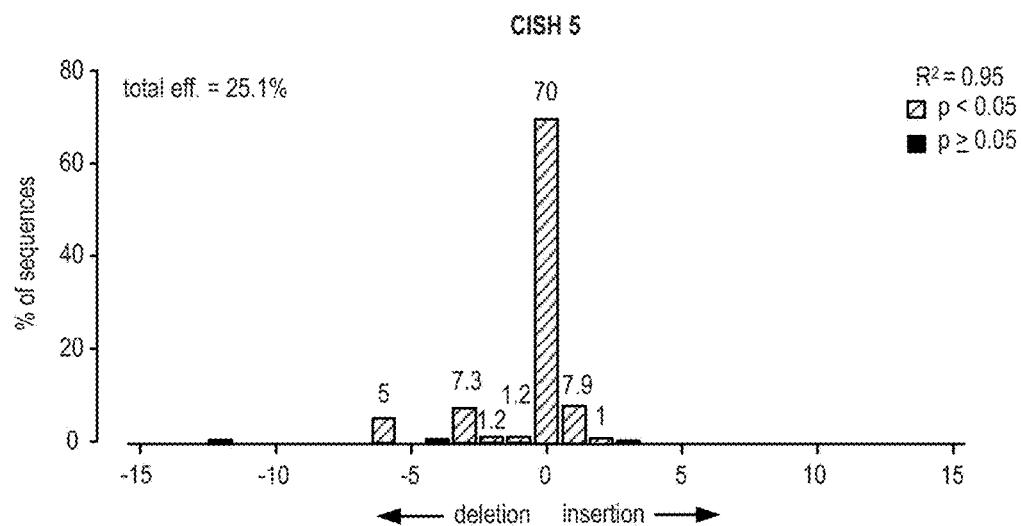
FIG. 65 A and FIG. 65 B show duplicate TIDE analyses of CISH gRNA 5.
Figure 65B:
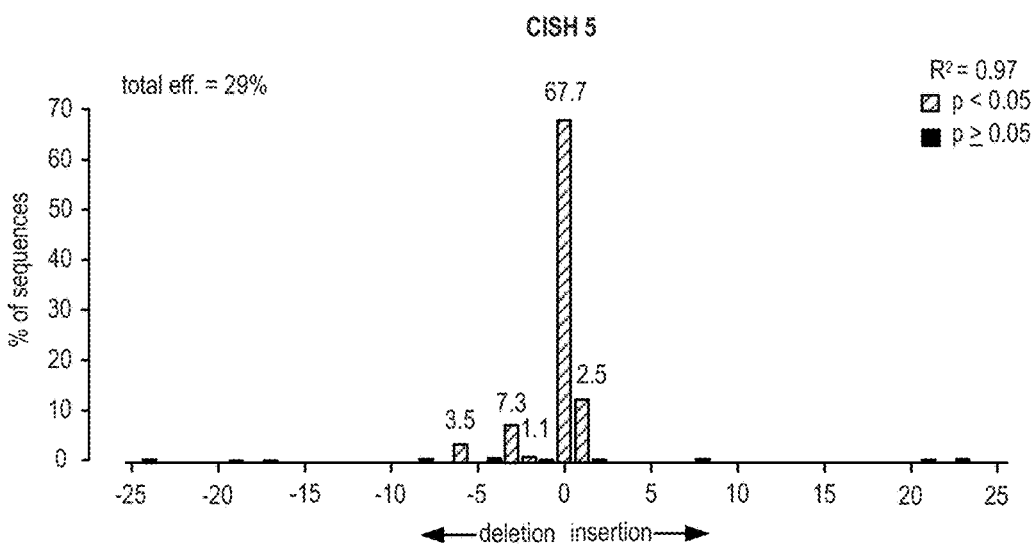
Figure 66A:
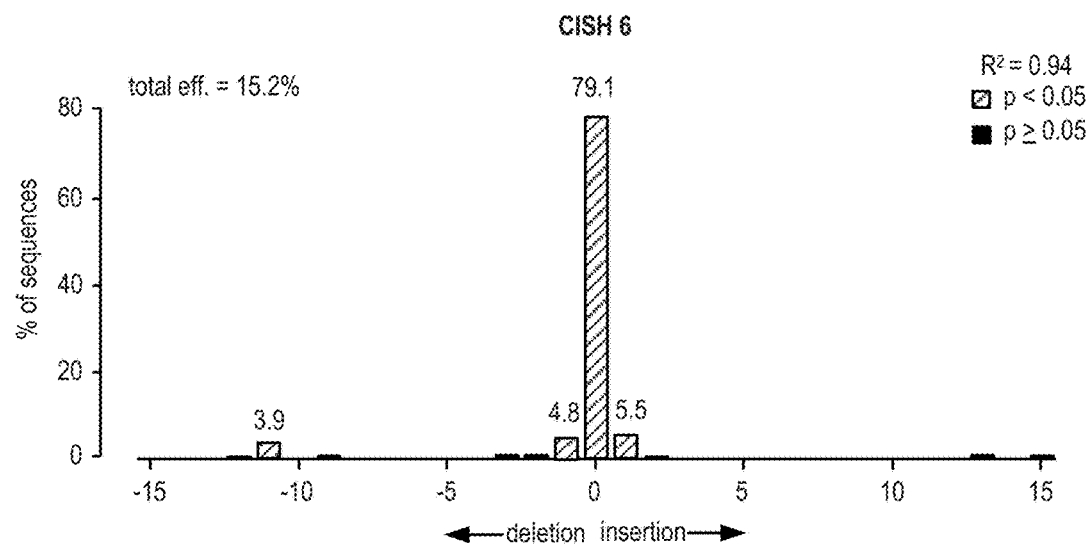
FIG. 66 A and FIG. 66 B show duplicate TIDE analyses of CISH gRNA 6.
Figure 66B:
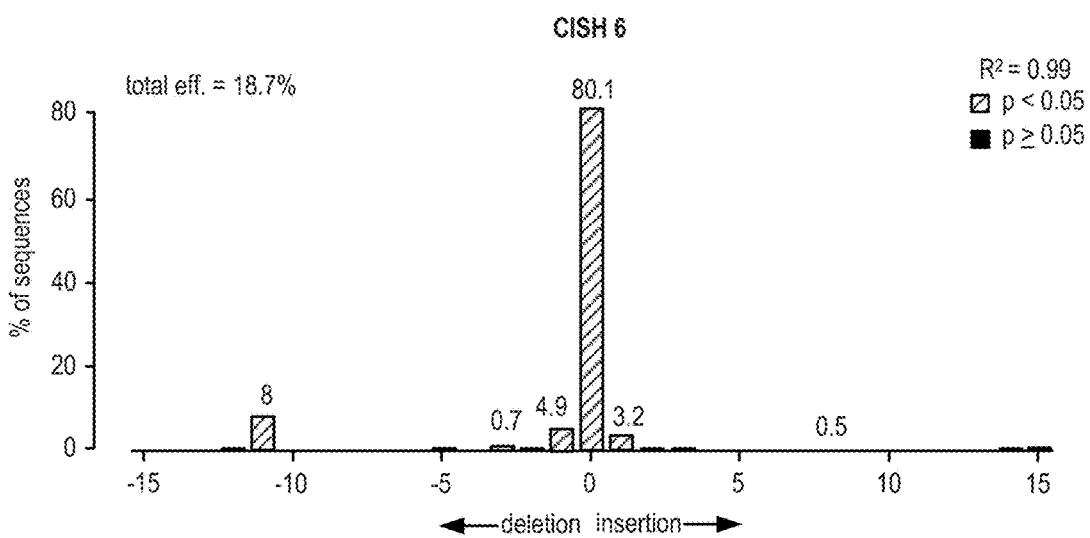
Figure 67:
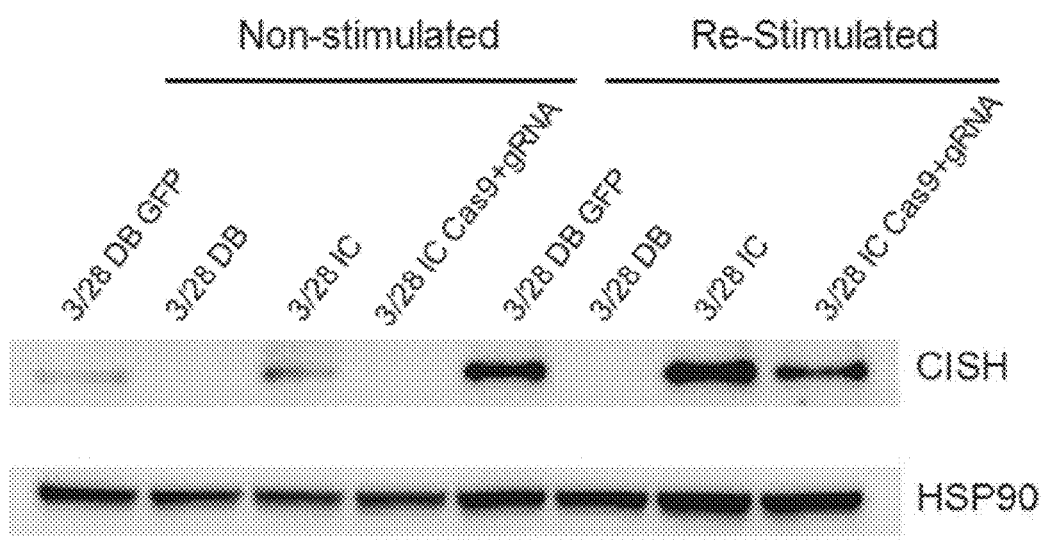
FIG. 67 shows a western blot showing loss of CISH protein after CRISPR knock out in primary T cells.
Figure 68A:
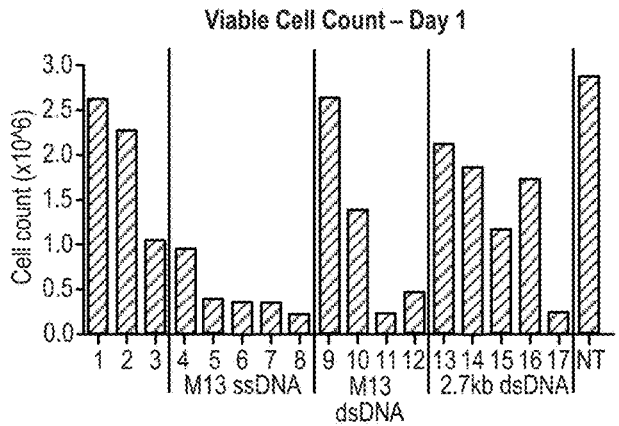
Figure 68B:
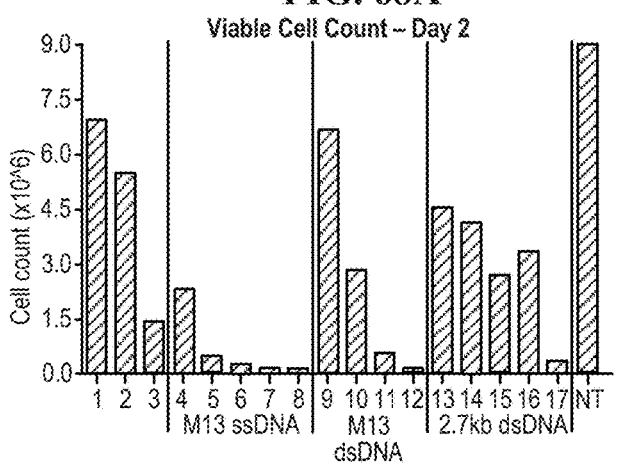
Figure 68C:
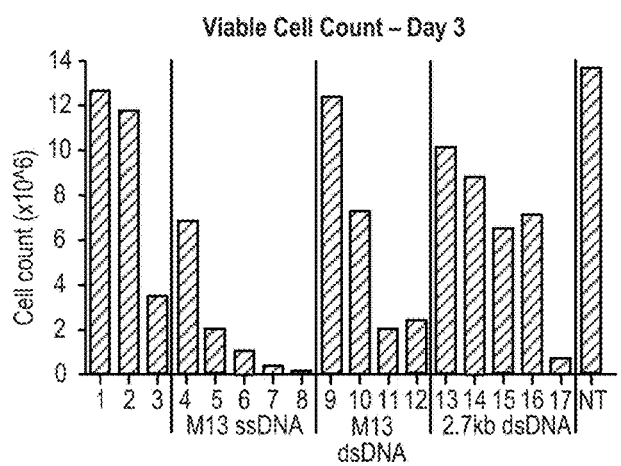

HEK293T cells were plated out at a density of 1×10^5 cells per well in a 24 well plate. 150 uL of Opti-MEM medium was combined with 1.5 ug of gRNA plasmid, 1.5 ug of Cas9 plasmid. Another 150 uL of Opti-MEM medium was combined with 5 ul of Lipofectamine 2000 Transfection reagent (Invitrogen). The solutions were combined together and incubated for 15 minutes at room temperature. The DNA-lipid complex was added dropwise to wells of the 24 well plate. Cells were incubated for 3 days at 37° C. and genomic DNA was collected using the GeneJET Genomic DNA Purification Kit (Thermo Scientific). Activity of the gRNAs was quantified by a Surveyor Digest, gel electrophoresis, and densitometry (FIG. 60 and FIG. 61) (Guschin, D. Y., et al., "A Rapid and General Assay for Monitoring Endogenous Gene Modification," Methods in Molecular Biology, 649: 247-256 (2010)).

Plasmid Targeting Vector Construction

Sequences of target integration sites were acquired from ensemble database. PCR primers were designed based on these sequences using Primer3 software to generate targeting vectors of carrying lengths, 1 kb, 2 kb, and 4 kb in size. Targeting vector arms were then PCR amplified using Accuprime Taq HiFi (Invitrogen), following manufacturer's instructions. The resultant PCR products were then sub cloned using the TOPO-PCR-Blunt II cloning kit (Invitrogen) and sequence verified. A representative targeting vector construct is shown in FIG. 16.

Results

The efficiencies of Cas9 in creating double strand break (DSB) with the assistance of different gRNA sequences were listed in Table 7. The percentage numbers in Table 7 indicated the percent of gene modifications in the sample.

TABLE 7

The efficiencies of Cas9/gRNA pair in creating double strand break (DSB) at each target gene site.

| | HPRT | AAVS1 | CCR5 | PD1 | CTLA4 |
|---|---|---|---|---|---|
| gRNA#1 | 27.85% | 32.99% | 21.47% | 10.83% | 40.96% |
| gRNA#2 | 30.04% | 27.10% | >60% | >60% | 56.10% |
| gRNA#3 | <1% | 39.82% | 55.98% | 37.42% | 39.33% |
| gRNA#4 | <5% | 25.93% | 45.99% | 20.87% | 40.13% |
| gRNA#5 | <1% | 27.55% | 36.07% | 30.60% | 15.90% |
| gRNA#6 | <5% | 39.62% | 33.17% | 25.91% | 36.93% |

DSB were created at all five tested target gene sites. Among them, CCR5, PD1, and CTLA4 provided the highest DSB efficiency. Other target gene sites, including hRosa26, will be tested using the same methods described herein.

Figure 15:
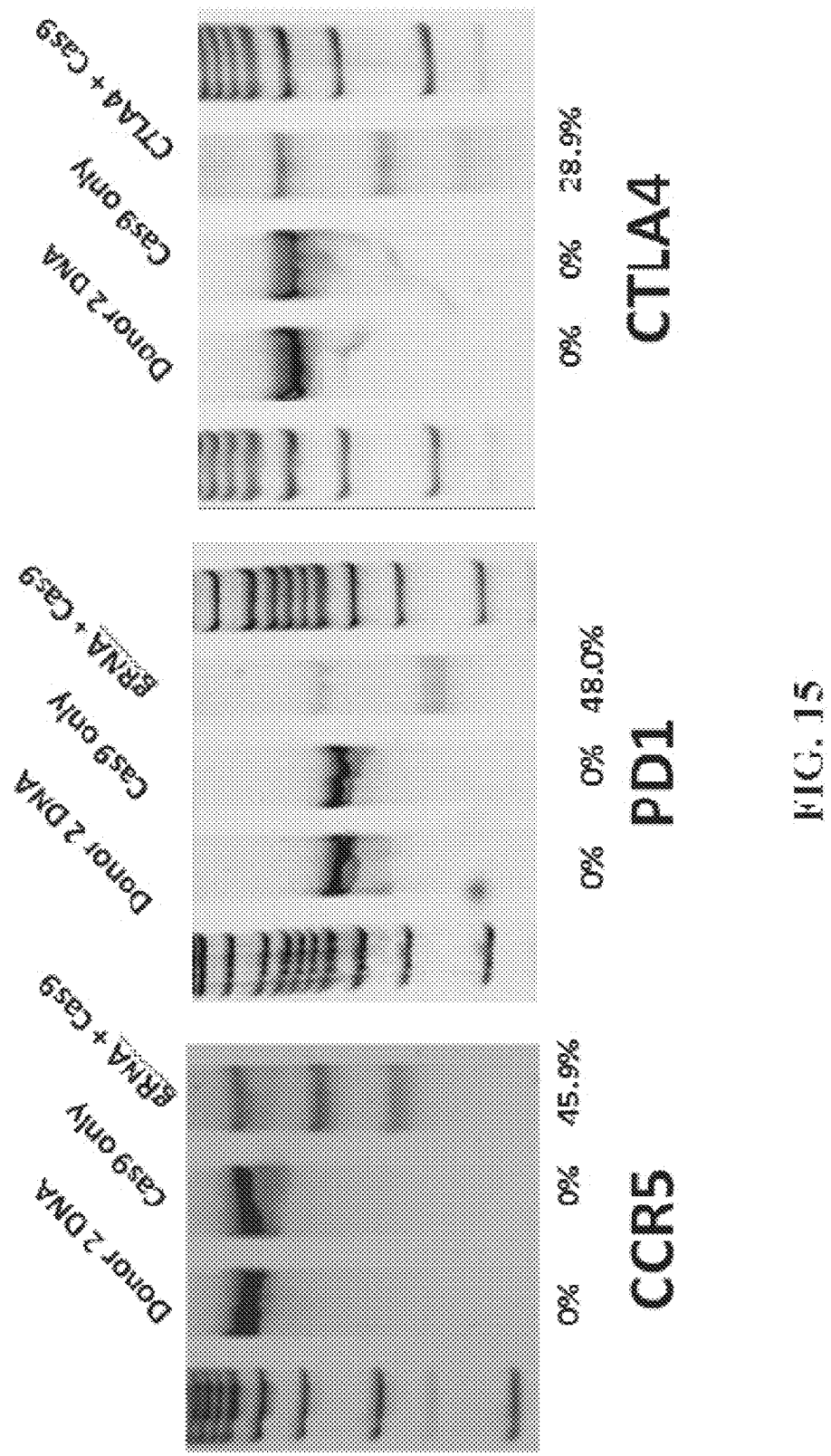
FIG. 15 demonstrates double strand breaks at target sites. The gene targeting was successful in inducing double strand breaks in T cells activated with anti-CD3 and anti-CD28 prior to introduction of the targeted CRISPR-Cas system. By way of example, immune checkpoint genes PD-1, CCR5, and CTLA4 were used to validate the system.

The rates of Cas9 in creating double strand break in conjunction with different gRNA sequences is shown in FIG. 15. The percent of double strand break compared to donor control and Cas9 only controls are listed. A three representative target gene sites (i.e., CCR5, PD1, and CTLA4) were tested.

Figure 6:
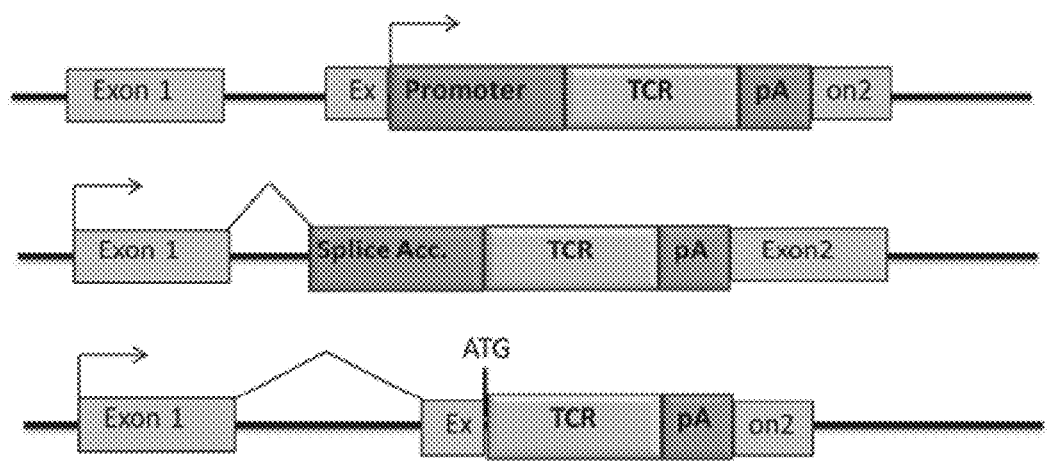
FIG. 6 demonstrates three potential TCR transgene knock-in designs targeting an exemplary gene (e.g., HPRT gene). (1) Exogenous promoter: TCR transgene ("TCR") transcribed by exogenous promoter ("Promoter"); (2) SA in-frame transcription: TCR transgene transcribed by endogenous promoter (indicated by the arrow) via splicing; and (3) Fusion in frame translation: TCR transgene transcribed by endogenous promoter via in frame translation. All three exemplary designs can knock-out the gene function. For example, when a HPRT gene or a PD-1 gene is knocked out by insertion of a TCR transgene, a 6-thiogaunine selection can be used as the selection assay.

Example 4: Generation of T Cells Comprising an Engineered TCR that Also Disrupts an Immune Checkpoint Gene To generate a T cell population that expresses an engineered TCR that also disrupts an immune checkpoint gene, CRISPR, TALEN, transposon-based, ZEN, meganuclease, or Mega-TAL gene editing method will be used. A summary of PD-1 and other endogenous checkpoints is shown in Table 9. Cells (e.g., PBMCs, T cells such as TILs, CD4+ or CD8+ cells) will be purified from a cancer patient (e.g., metastatic melanoma) and cultured and/or expanded according to standard procedures. Cells will be stimulated (e.g., using anti-CD3 and anti-CD28 beads) or unstimulated. Cells will be transfected with a target vector carrying a TCR transgene. For example, TCR transgene sequence of MBVb22 will be acquired and synthesized by IDT as a gBLOCK. The gBLOCK will be designed with flanking attB sequences and cloned into pENTR1 via the LR Clonase reaction (Invitrogen), following manufacturer's instructions, and sequence verified. Three transgene configurations (see FIG. 6) that express a TCR transgene in three different ways will be tested: 1) Exogenous promoter: TCR transgene is transcribed by an exogenous promoter; 2) SA in-frame transcription: TCR transgene is transcribed by endogenous promoter via splicing; and 3) Fusion in frame translation: TCR transgene transcribed by endogenous promoter via in frame translation.

When CRISPR gene editing method is used, a Cas9 nuclease plasmid and a gRNA plasmid (similar to the plasmids shown in FIG. 4) will be also transfected with the DNA plasmid with the target vector carrying a TCR transgene. 10 micrograms of gRNA and 15 micrograms of Cas9 mRNA can be utilized. The gRNA guides the Cas9 nuclease to an integration site, for example, an endogenous checkpoint gene such as PD-1. Alternatively, PCR product of the gRNA or a modified RNA (as demonstrated in Hendel, Nature biotechnology, 2015) will be used. Another plasmid with both the Cas9 nuclease gene and gRNA will be also tested. The plasmids will be transfected together or separately. Alternatively, Cas9 nuclease or a mRNA encoding Cas9 nuclease will be used to replace the Cas9 nuclease plasmid.

To optimize the rate of homologous recombination to integrate TCR transgene using CRISPR gene editing method, different lengths of target vector arms will be tested, including 0.5 kbp, 1 kbp, and 2 kbp. For example, a target vector with a 0.5 kbp arm length is illustrated in FIG. 5. In addition, the effect of a few CRISPR enhancers such as SCR7 drug and DNA Ligase IV inhibitor (e.g., adenovirus proteins) will be also tested.

In addition to delivering a homologous recombination HR enhancer carrying a transgene using a plasmid, the use of mRNA will be also tested. An optimal reverse transcription platform capable of high efficiency conversion of mRNA homologous recombination HR enhancer to DNA in situ will be identified. The reverse transcription platform for engineering of hematopoietic stem cells and primary T-cells will be also optimized and implemented.

Figure 2:
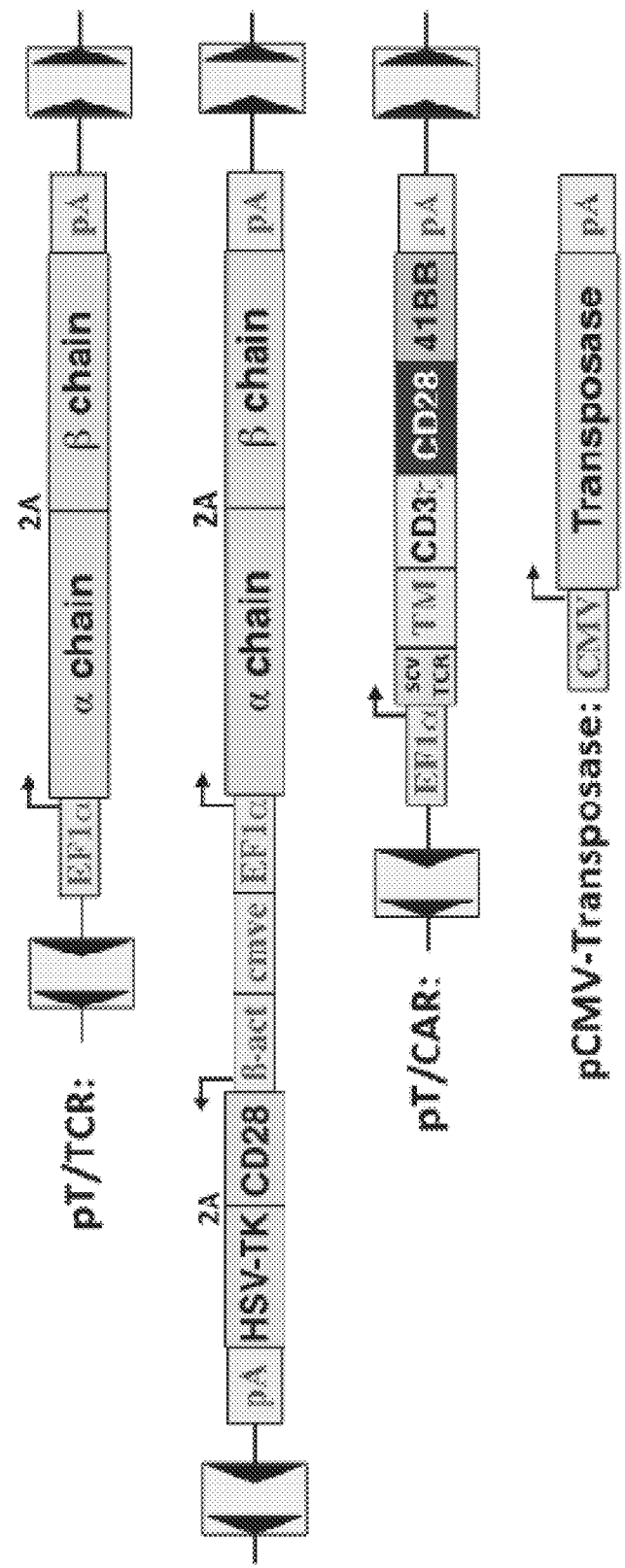
FIG. 2 shows some exemplary transposon constructs for TCR transgene integration and TCR expression.

When transposon-based gene editing method (e.g., PiggyBac, Sleeping Beauty) will be used, a transposase plasmid will be also transfected with the DNA plasmid with the target vector carrying a TCR transgene. FIG. 2 illustrates some of the transposon-based constructs for TCR transgene integration and expression.

Figure 28:
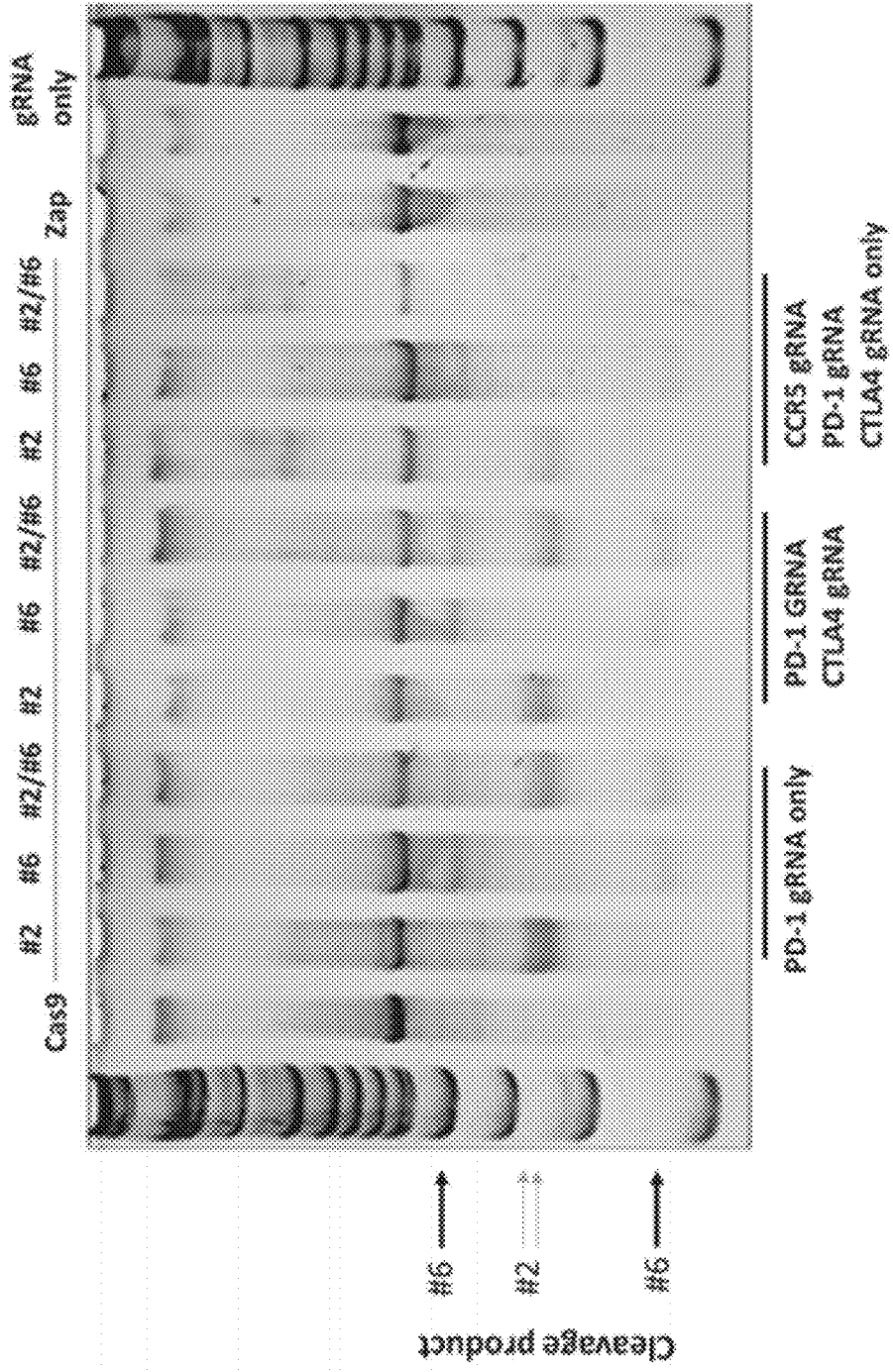
FIG. 28 results of a CEL-I assay showing cutting by PD-1 guide RNAs #2, #6, #2 and #6, under conditions where only PD-1 guide RNA is introduced, PD-1 and CTLA-4 guide RNAs are introduced or CCR5, PD-1, and CLTA-4 guide RNAs, Zap only, or gRNA only controls.
Figure 29:
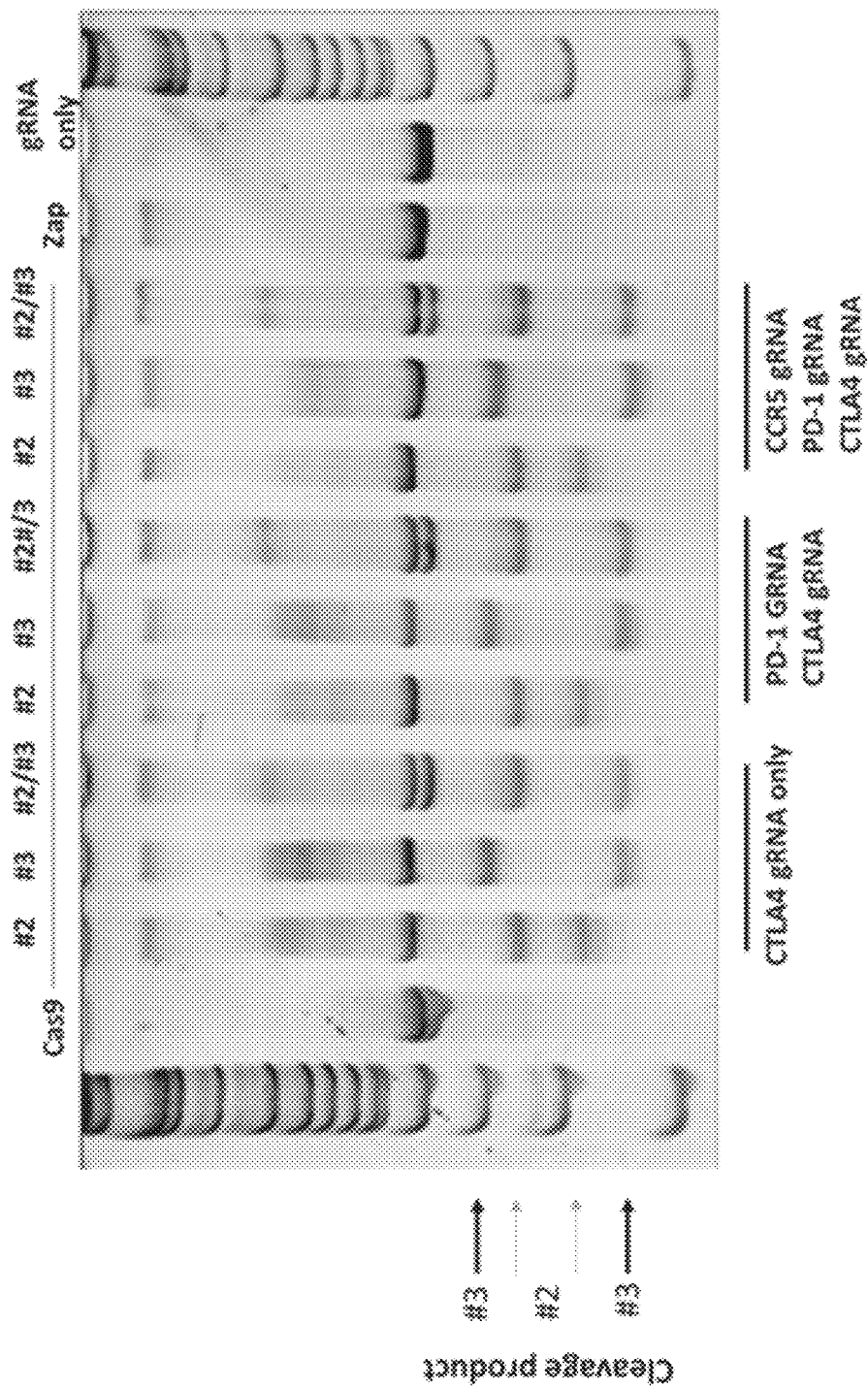
FIG. 29 results of a CEL-I assay showing cutting by CTLA-4 guide RNAs #2, #3, #2 and #3, under conditions where only CLTA-4 guide RNA is introduced, PD-1 and CTLA-4 guide RNAs are introduced or CCR5, PD-1, and CLTA-4 guide RNAs, Zap only, or gRNA only controls.
Figure 30:
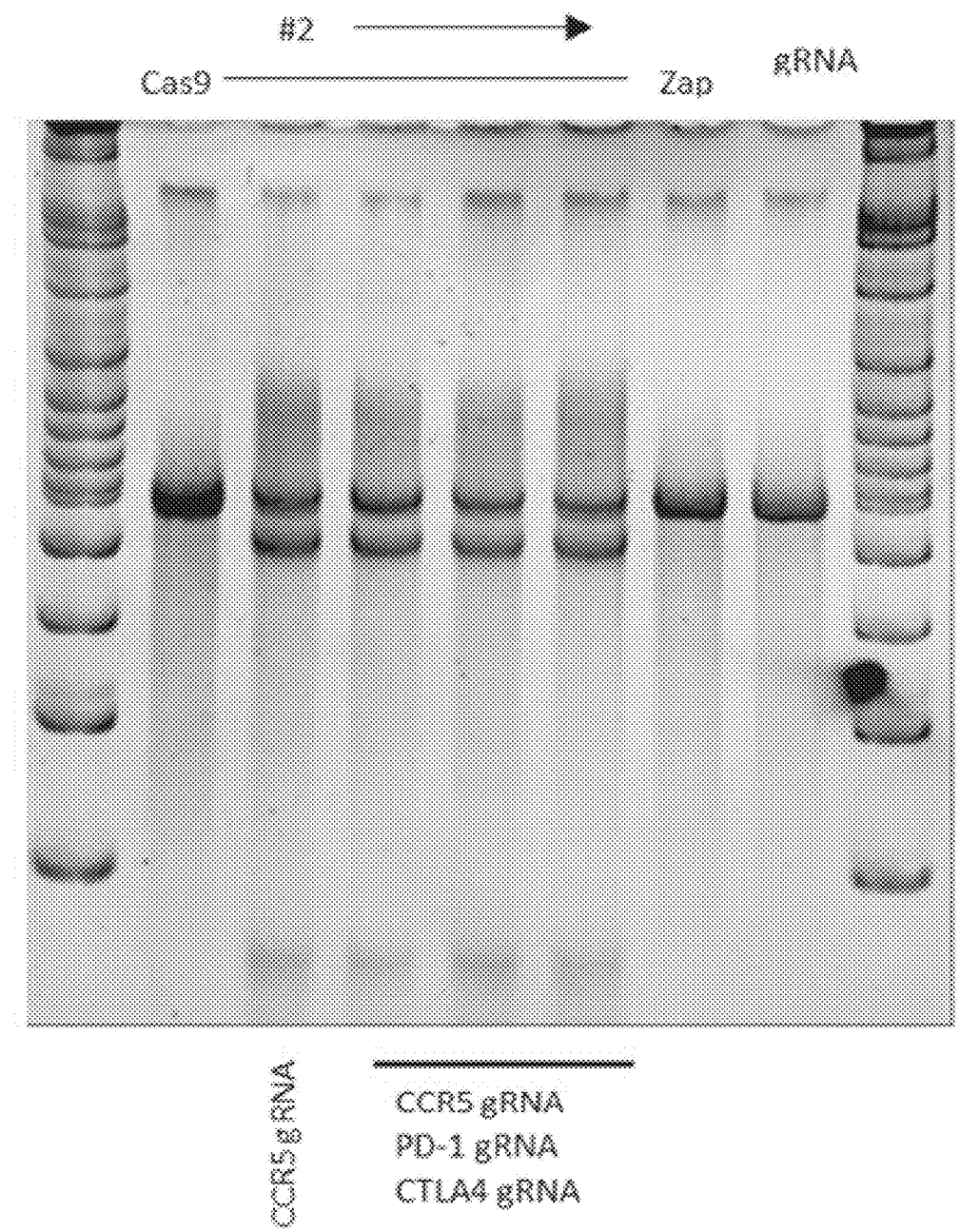
FIG. 30 results of a CEL-I assay showing cutting by CCR5 guide RNA #2 in conditions where CCR5 guide RNA is introduced, CCR5 guide RNA, PD-1 guide RNA, or CTLA-4 guide RNA, as compared to Zap only, Cas 9 only, or guide RNA only controls.
Figure 34:
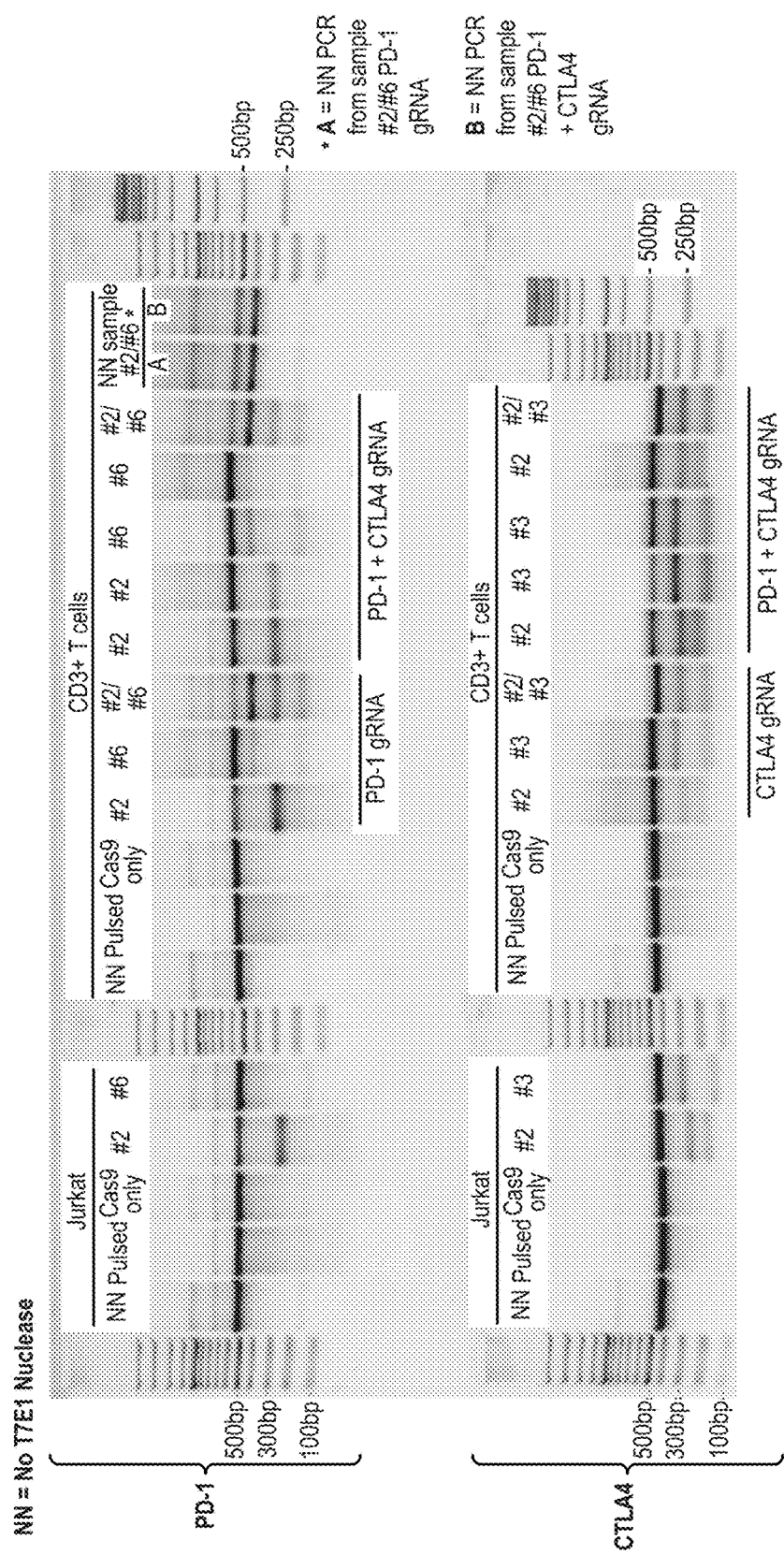
FIG. 34 shows results of a T7E1 assay to detect CRISPR gene editing on day 4 post transfection with PD-1 or CTKA-4 guide RNA of primary human T cells and Jurkat control. NN is a no T7E1 nuclease control.
Figure 37:
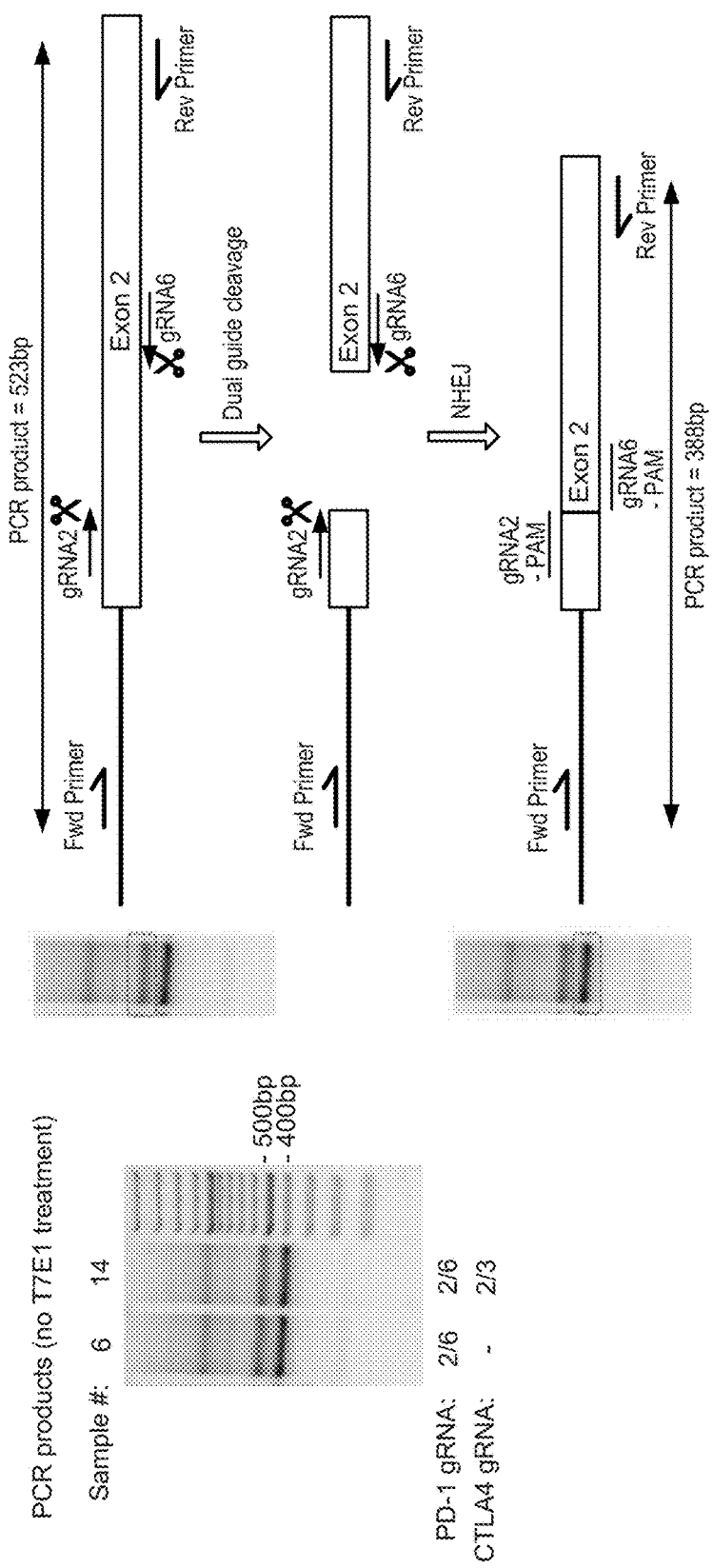
FIG. 37 shows PD-1 sequence deletion with dual targeting.
Figure 38:
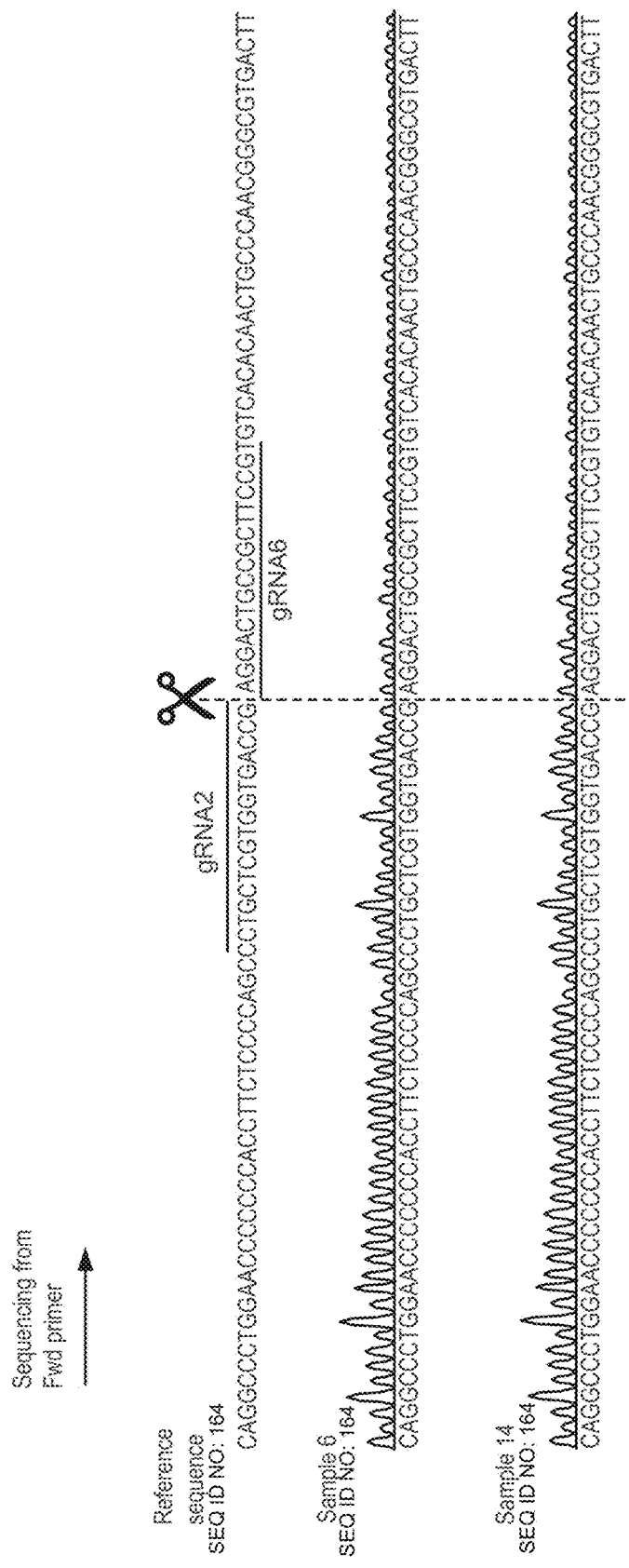
FIG. 38 shows sequencing results of PCR products of PD-1 sequence deletion with dual targeting. Samples 6 and 14 are shown with a fusion of the two gRNA sequences with the intervening 135 bp excised.
Figure 39:
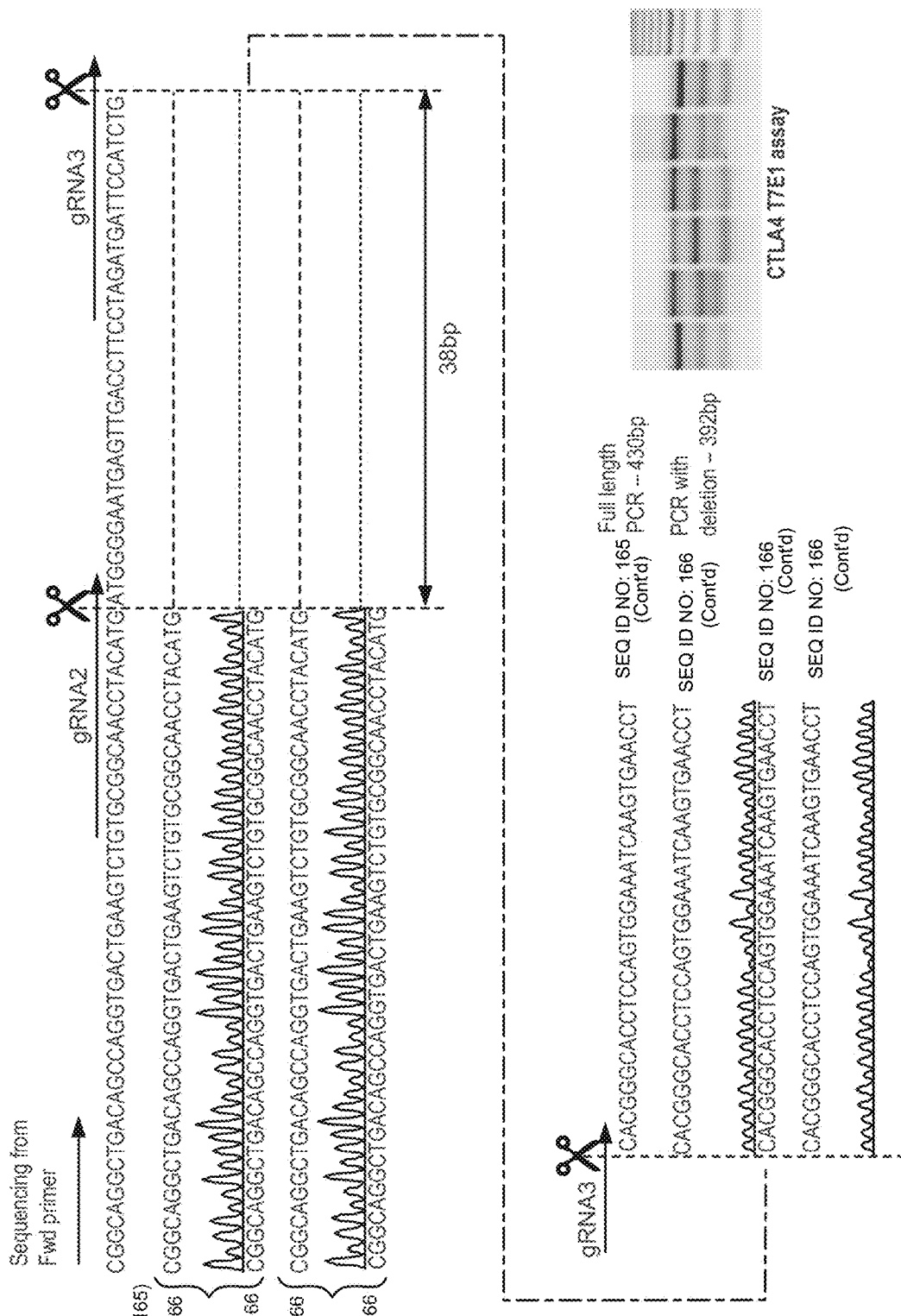
FIG. 39 shows dual targeting sequence deletion of CTLA-4. Deletion between the two guide RNA sequences is also present in the sequencing of dual guide targeted CTLA-4 (samples 9 and 14). A T7E1 Assay confirms the deletion by PCR.

The engineered cells will then be treated with mRNAs encoding PD1-specific nucleases and the population will be analyzed by the Cel-I assay (FIG. 28 to FIG. 30) to verify PD1 disruption and TCR transgene insertion. After the verification, the engineered cells will then be grown and expanded in vitro. The T7 endonuclease I (T7E1) assay can be used to detect on-target CRISPR events in cultured cells, FIG. 34 and FIG. 39. Dual sequencing deletion is shown in FIG. 37 and FIG. 38.

Figure 90A:
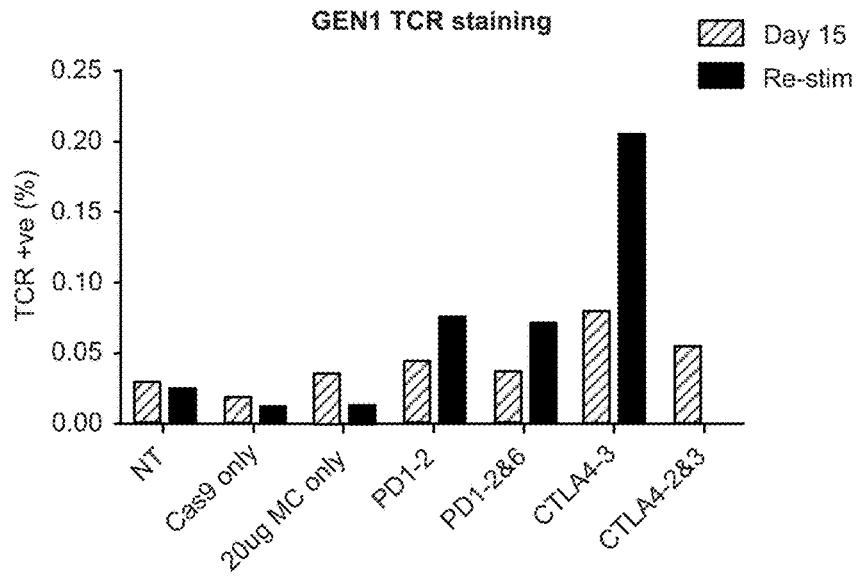
FIG. 90A and FIG. 90B show FACs data of human T cells electroporated with CRISPR and a minicircle DNA encoding an exogenous TCR (20 micrograms).
Figure 90B:
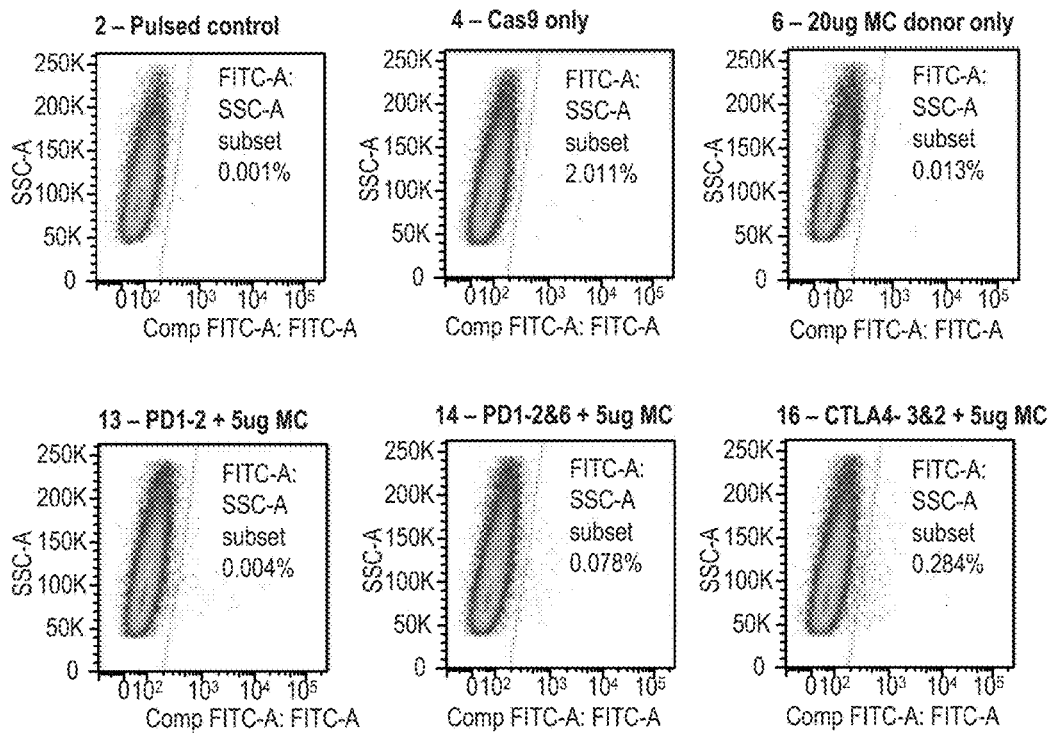

Some engineered cells will be used in autologous transplantation (e.g., administered back to the cancer patient whose cells were used to generate the engineered cells). Some engineered cells will be used in allogenic transplantation (e.g., administered back to a different cancer patient). The efficacy and specificity of the T cells in treating patients will be determined. Cells that have been genetically engineered can be restimulated with antigen or anti-CD3 and anti-CD28 to drive expression of an endogenous checkpoint gene, FIG. 90A and FIG. 90B.

Results

Figure 24A:
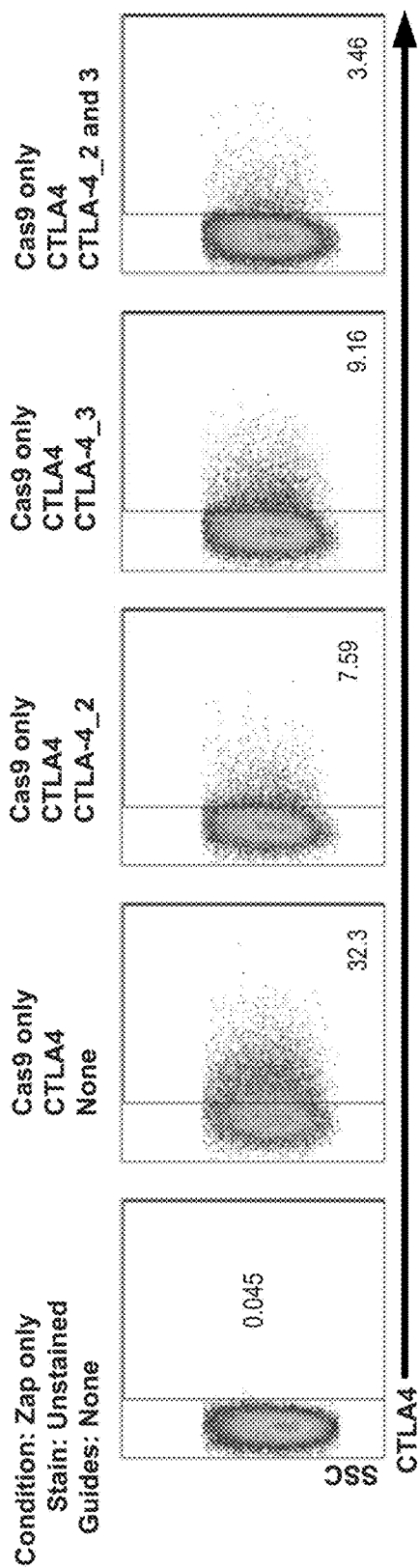
FIG. 24 A and FIG. 24 B shows CTLA-4 expression in primary human T cells after electroporation with CRISPR and CTLA-4 specific guideRNAs, guides #2 and #3, as compared to unstained and a no guide control.
Figure 24B:
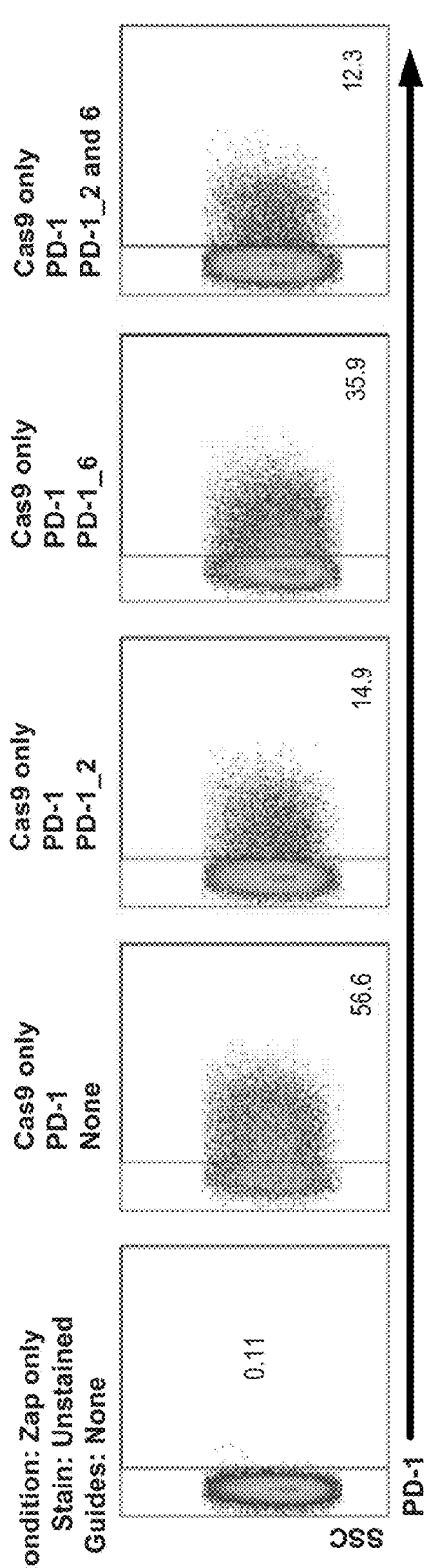
Figure 25:
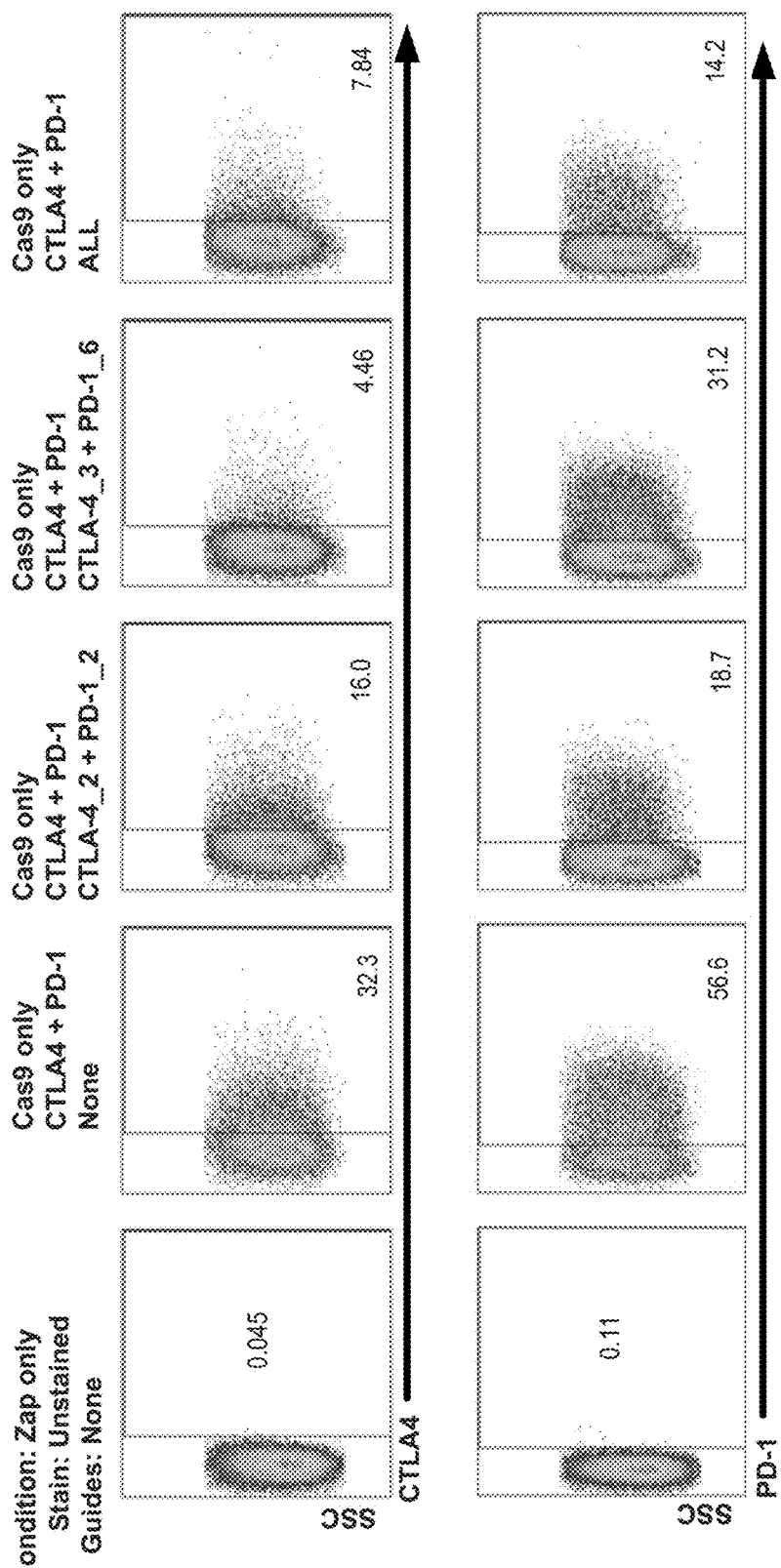
FIG. 25 shows FACs results of CTLA-4 and PD-1 expression in primary human T cells after electroporation with CRISPR and multiplexed CTLA-4 and PD-1 guide RNAs.
Figure 45:
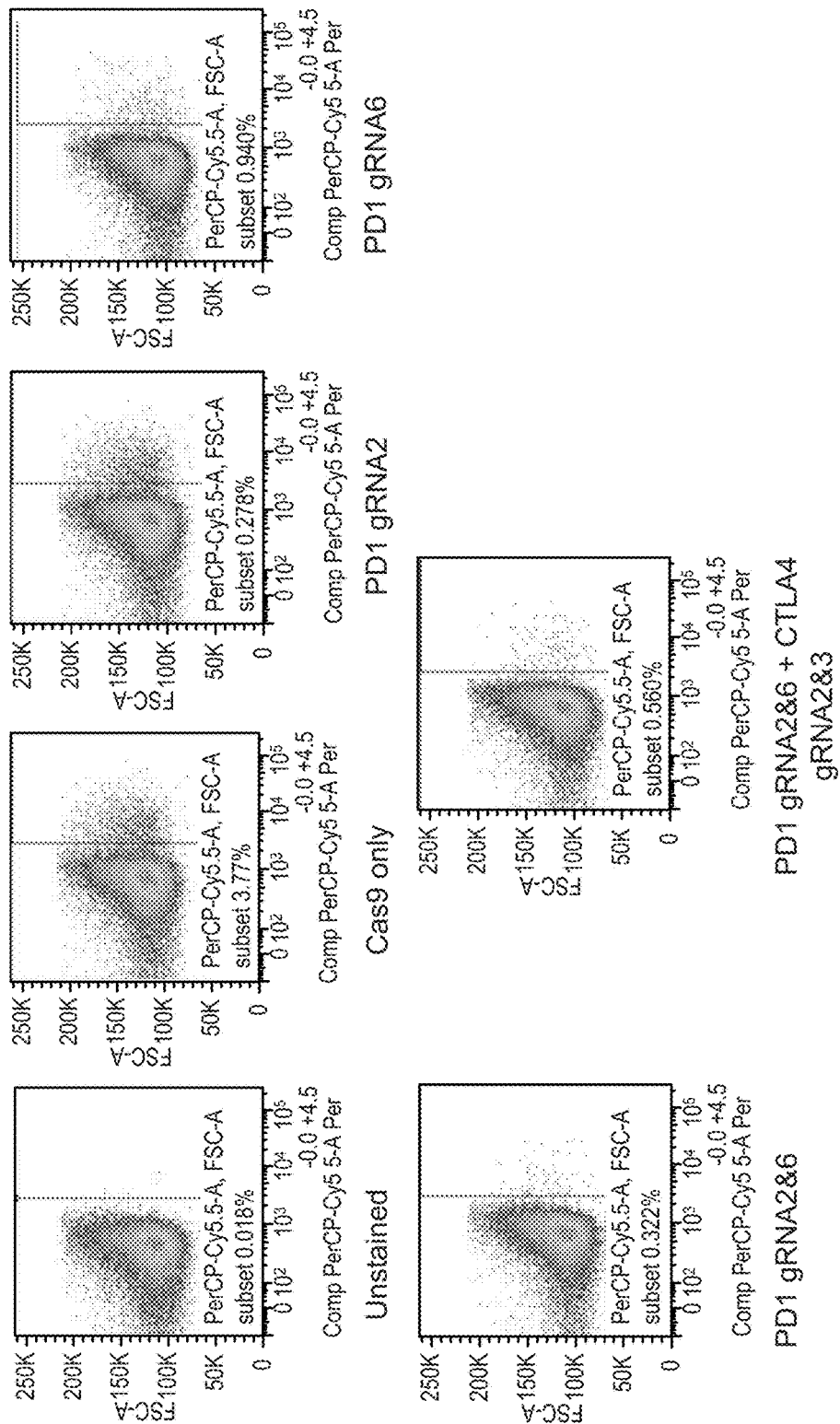
FIG. 45. Depicts FACs results of PD-1 KO on day 14 post transfection with CRISPR and anti-PD-1 guide RNAs. PerCP-Cy5.5 is mouse anti-human CD279 (PD-1).
Figure 51:
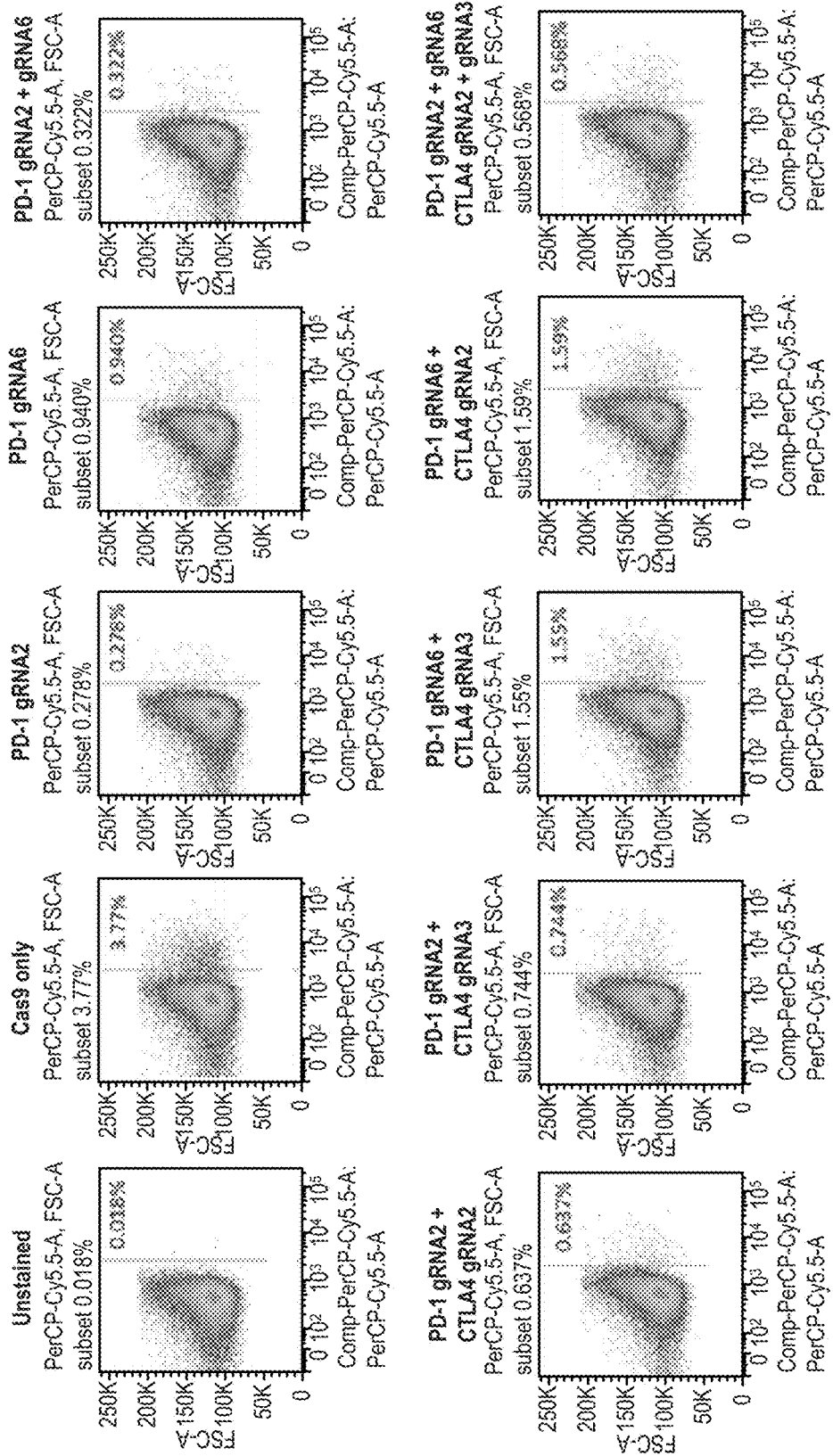
FIG. 51 shows FACs analysis of PD-1 stained human T cells transfected with CRISPR and anti-PD-1 guide RNAs. Day 14 post transfection data is shown of PD-1 expression (anti-human CD279 PerCP-Cy5.5)
Figure 52:
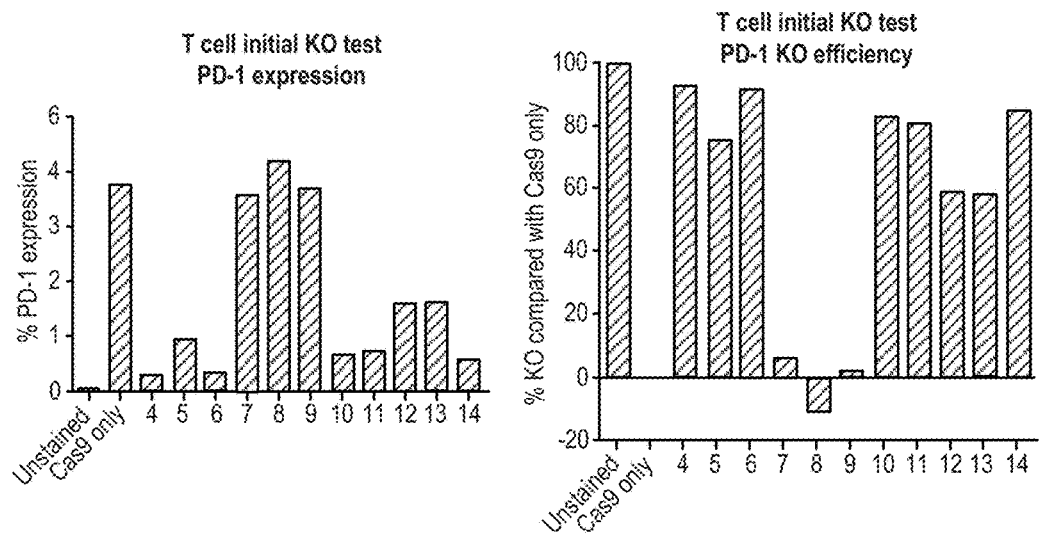
FIG. 52 shows percent PD-1 expression and percent knock out of PD-1 compared to Cas9 only control of human T cells transfected with CRISPR and anti-PD-1 guide RNAs.
Figure 53:
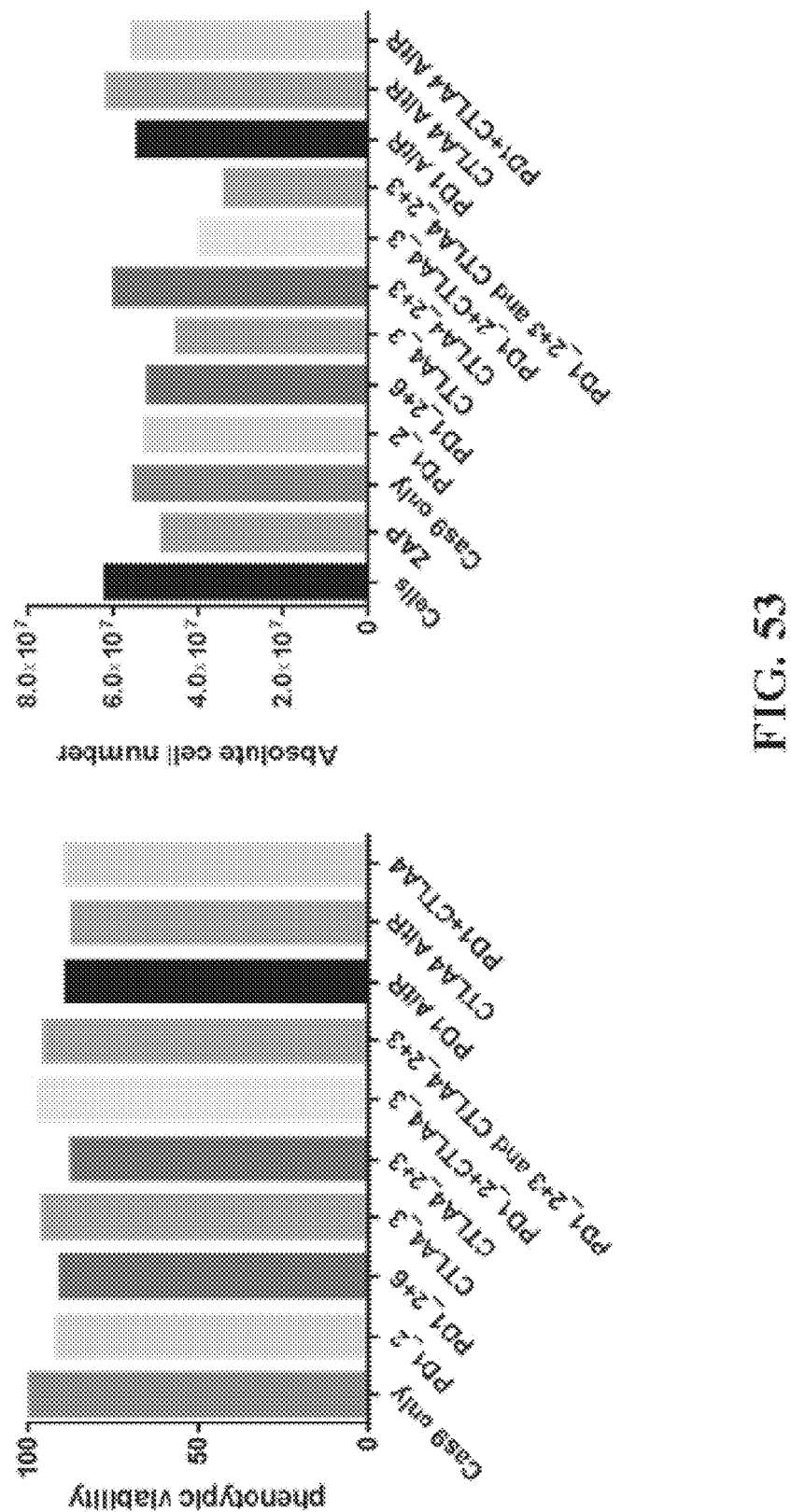
FIG. 53 shows day 14 cell count and viability of transfected human T cells with CRISPR, anti-CTLA-4, and anti-PD-1 guide RNAs.
Figure 54:
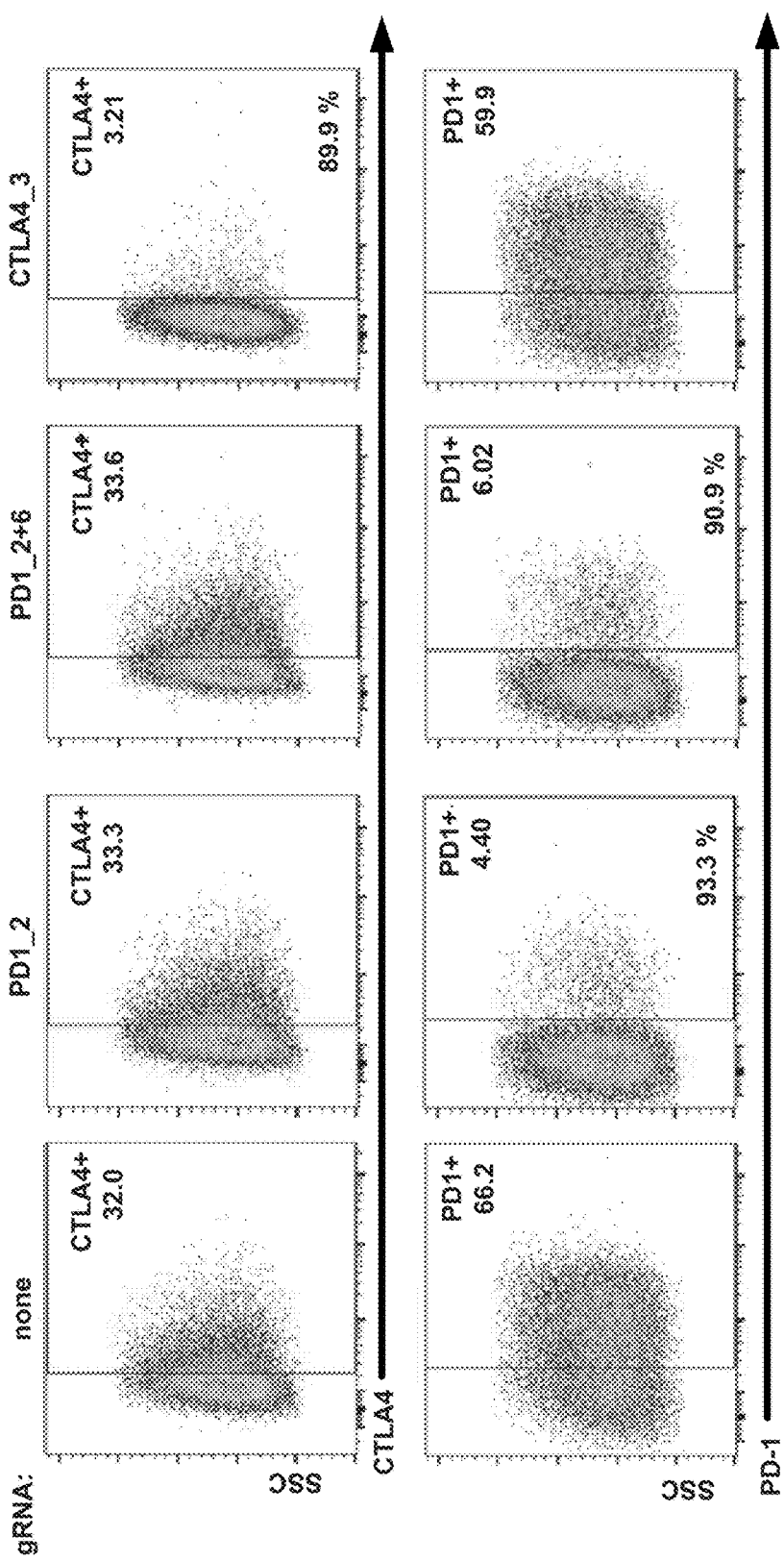
FIG. 54 shows FACs data for human T cells on day 14 post electroporation with CRISPR, and anti-PD-1 guide #2 alone, anti-PD-1 guide #2 and #6, or anti-CTLA-4 guide #3 alone. The engineered T cells were re-stimulated for 48 hours to assess expression of CTLA-4 and PD-1 and compared to control cells electroporated with no guide RNA.
Figure 55:
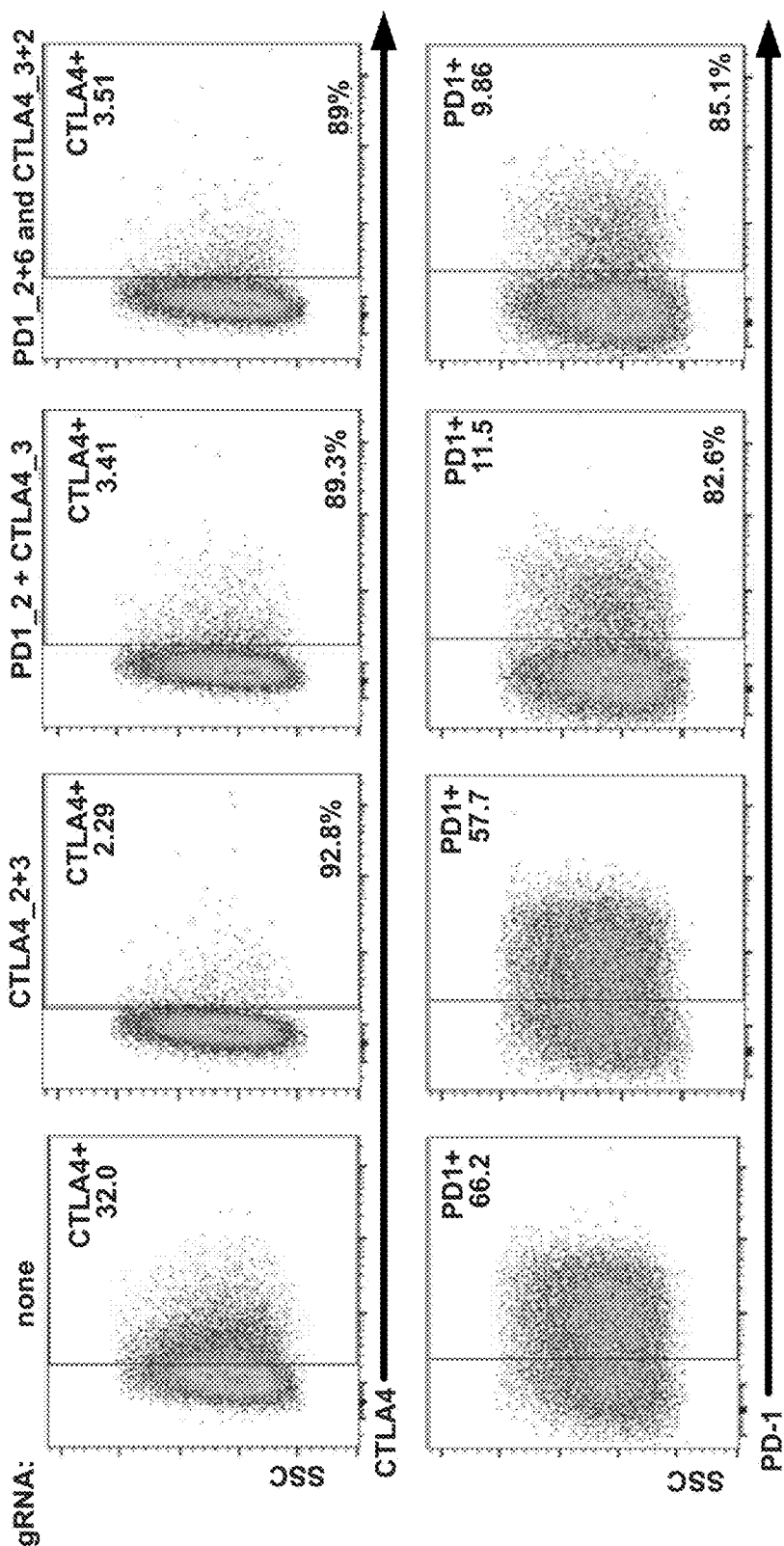
FIG. 55 shows FACs data for human T cells on day 14 post electroporation with CRISPR, and anti-CTLA-4 guide #2 and #3, anti-PD-1 guide #2 and anti-CTLA-4 guide #3, or anti-PD-1 guide #2 and #6, anti-CTLA-4 guide #3 and #2. The engineered T cells were re-stimulated for 48 hours to assess expression of CTLA-4 and PD-1 and compared to control cells electroporated with no guide RNA.

A representative example of the generating a T cell with an engineered TCR and an immune checkpoint gene disruption is shown in FIG. 17. Positive PCR results demonstrate successful recombination at the CCR5 gene. Efficiency of immune checkpoint knock out is shown in a representative experiment in FIG. 23 A, FIG. 23 B, FIG. 24 A, and FIG. 24 B. Flow cytometry data is shown for a representative experiment in FIG. 25. FIG. 26 A and FIG. 26 B show percent double knock out in primary human T cells post treatment with CRISPR. A representative example of flow cytometry results on day 14 post transfection with CRISPR and anti-PD-1 guide RNAs is shown in FIG. 45, FIG. 51, and FIG. 52. Cellular viability and gene editing efficiency 14 days post transfection is shown in FIG. 53, FIG. 54, and FIG. 55 for cells transfected with a CRISPR system and gRNA targeting CTLA-4 and PD-1.

Example 5: Detection of Homologous Recombination in T Cells

To generate an engineered T cell population that expresses an engineered TCR that also disrupts a gene, CRISPR, TALEN, transposon-based, ZEN, meganuclease, or MegaTAL gene editing method will be used. To determine if homologous recombination is facilitated with the use of a homologous recombination enhancer the following example embodies a representative experiment. Stimulated CD3+ T cells were electroporated using the NEON transfection system (Invitrogen). Cells were counted and resuspended at a density of $1.0$-$3.0 \times 10^6$ cells in 100 uL of T buffer. 15 ug mRNA Cas9 (TriLink BioTechnologies), 10 ug mRNA gRNA (TriLink BioTechnologies) and 10 ug of homologous recombination (HR) targeting vector were used for to examine HR. 10 ug of HR targeting vector alone or 15 ug Cas9 with 10 ug mRNA gRNA were used as controls. After electroporation cells were split into four conditions to test two drugs suggested to promote HR: 1) DMSO only (vehicle control), 2) SCR7 (1 uM), 3) L755507 (5 uM) and 4) SCR7 and L755507. Cells were counted using a Countess II Automated Cell Counter (Thermo Fisher) every three days to monitor growth under these various conditions. In order to monitor for HR, cells were analyzed by flow cytometry and tested by PCR. For flow cytometry, cells were analyzed once a week for three weeks. T cells were stained with APC anti-mouse TCRβ (eBiosciences) and Fixable Viability Dye eFluor 780 (eBiosciences). Cells were analyzed using a LSR II (BD Biosciences) and FlowJo v.9. To test for HR by PCR, gDNA was isolated from T cells and amplified by PCR using accuprime taq DNA polymerase, high fidelity (Thermo Fisher). Primers were designed to both the CCR5 gene and to both ends of the HR targeting vector to look for proper homologous recombination at both the 5' and 3' end.

Example 6: Preventing Toxicity Induced by Exogenous Plasmid DNA

Figure 69:
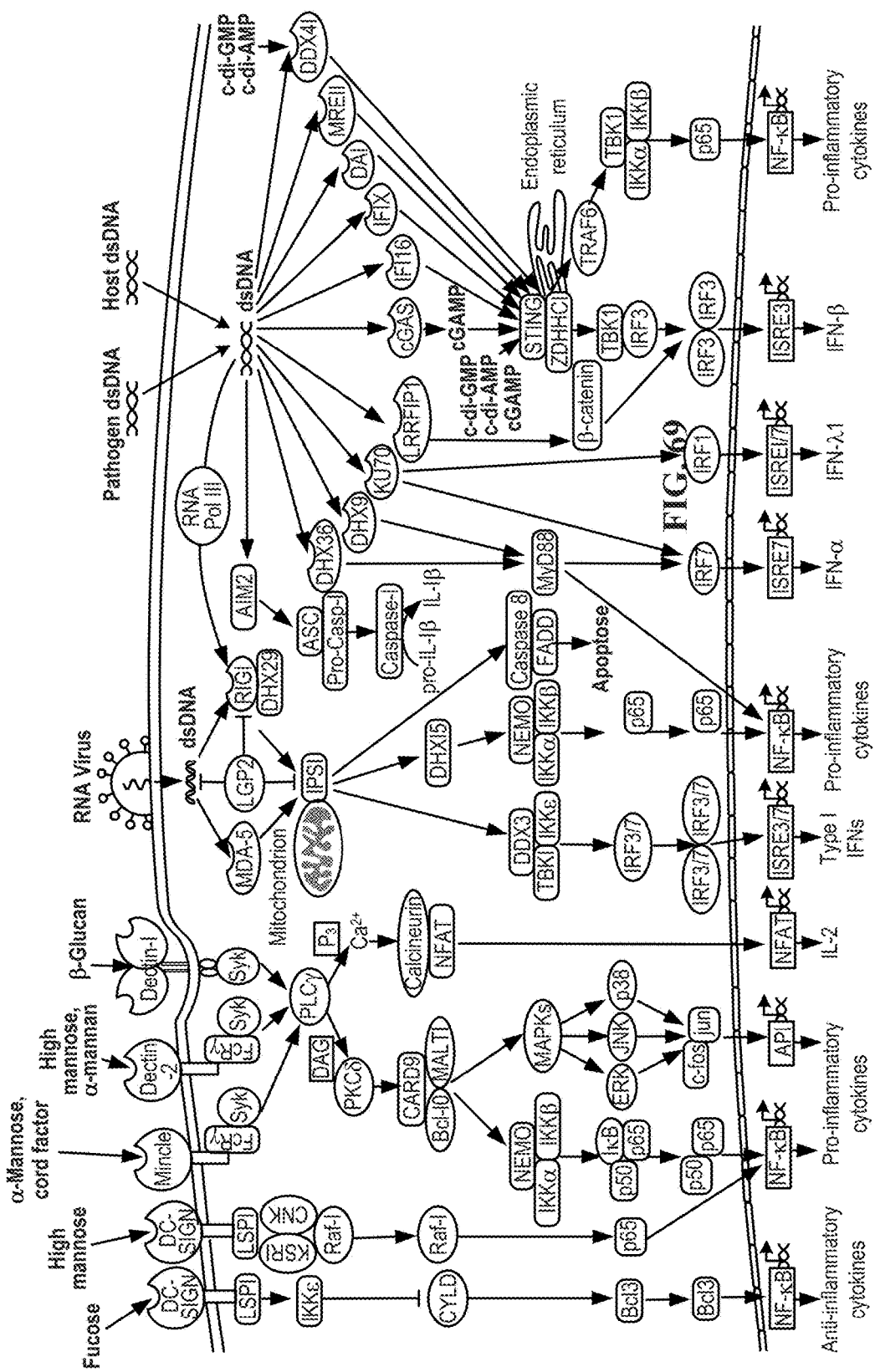
FIG. 69 shows a mechanistic pathway that can be modulated during preparation or post preparation of engineered cells.
Figure 91:
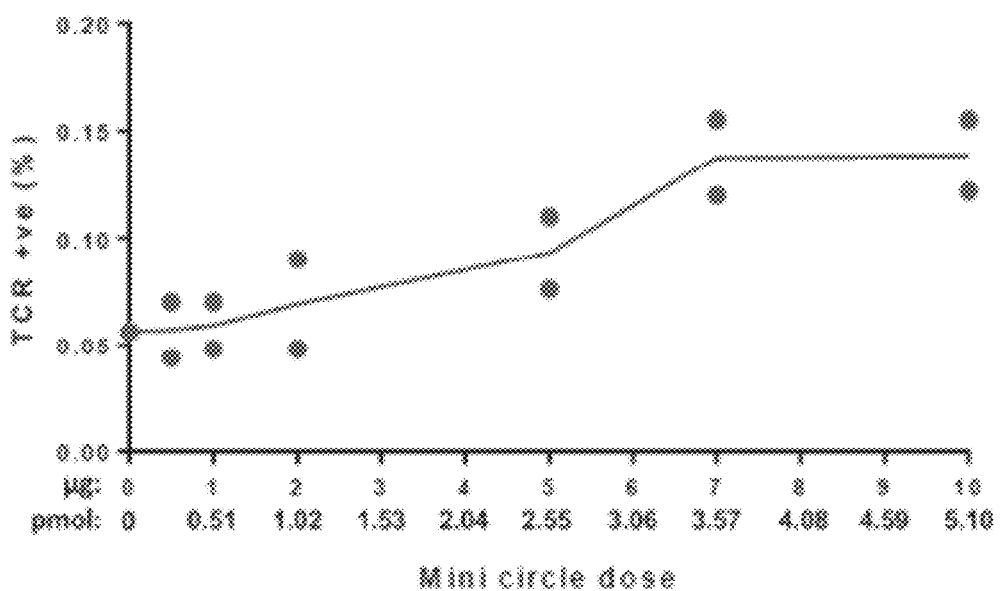
FIG. 91 shows TCR expression on day 13 post electroporation with CRISPR and a minicircle encoding an exogenous TCR at varying concentrations of minicircle.
Figure 92:
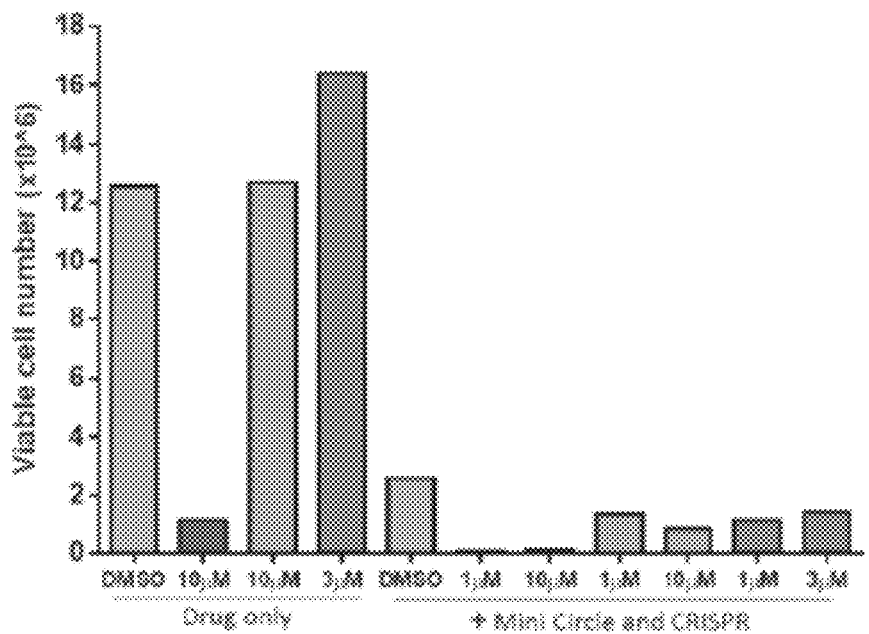
FIG. 92 A shows viability of T cells on day 3 post electroporation.
Figure 92:
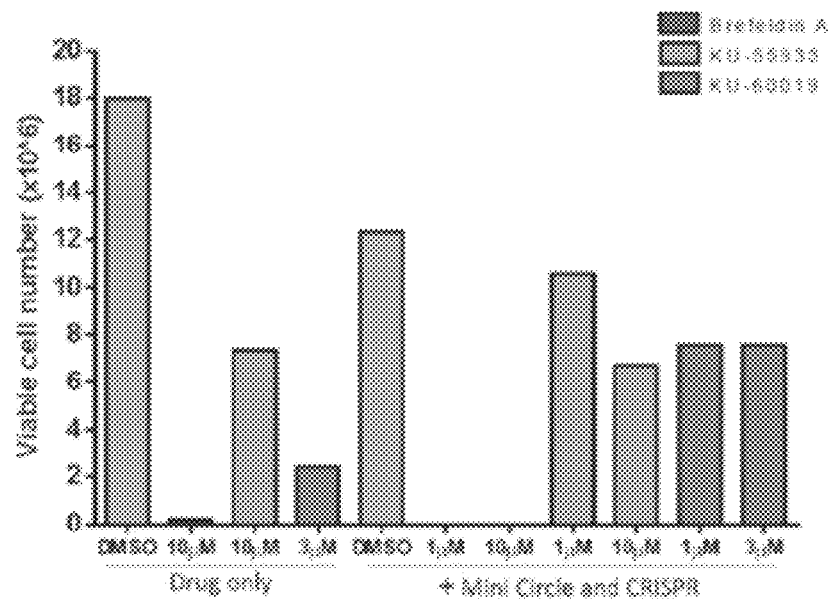
Figure 93:
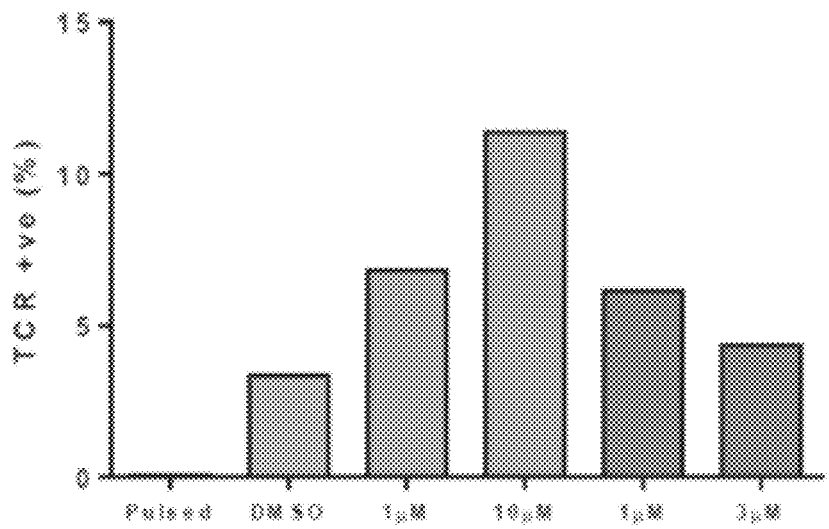
FIG. 93 A shows TCR expression on T cells on day 3 post electroporation.
Figure 93:
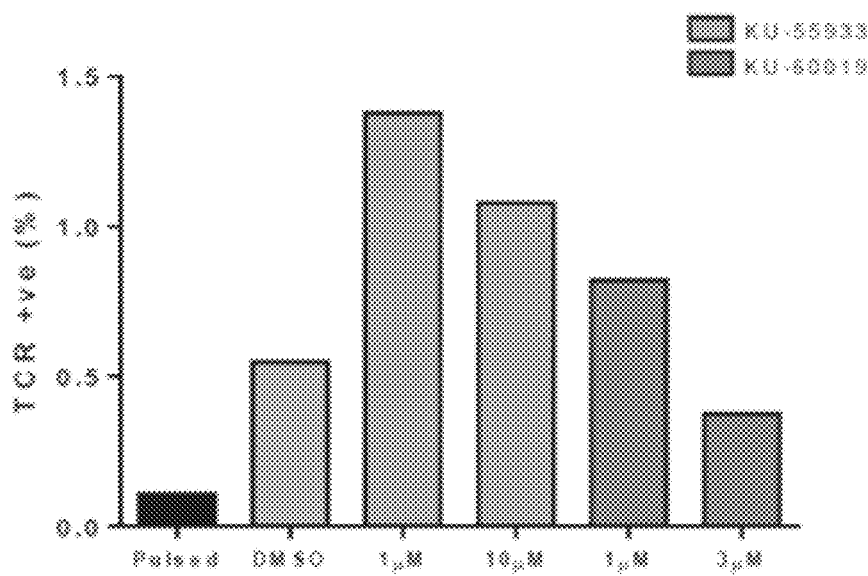

Exogenous plasmid DNA induces toxicity in T cells. The mechanism by which toxicity occurs is described by the innate immune sensing pathway of FIG. 19 and FIG. 69. To determine if cellular toxicity can be reduced by addition of a compound that modifies a response to exogenous polynucleic acids the following representative experiment was completed. CD3+ T cells were electroporated using the NEON transfection system (Invitrogen) with increasing amounts of plasmid DNA (0.1 ug to 40 ug), FIG. 91. After electroporation cells were split into four conditions to test two drugs capable of blocking apoptosis induced by the double stranded DNA: 1) DMSO only (vehicle control), 2) BX795 (1 uM, Invivogen), 3) Z-VAD-FMK (50 uM, R&D Systems) and 4) BX795 and Z-VAD-FMK. Cells were analyzed by flow 48 hours later. T cells were stained with Fixable Viability Dye eFluor 780 (eBiosciences) and were analyzed using a LSR II (BD Biosciences) and FlowJo v.9.

Results

A representative example of toxicity experienced by T cells in transfected with plasmid DNA is shown in FIG. 18, FIG. 27, FIG. 32 and FIG. 33. Viability by cell count is shown in FIG. 86. After the addition of innate immune pathway inhibitors, the percent of T cells undergoing death is reduced. By way of example, FIG. 20 shows a representation of the reduction of apoptosis of T cell cultures treated with two different inhibitors.

Figure 21:
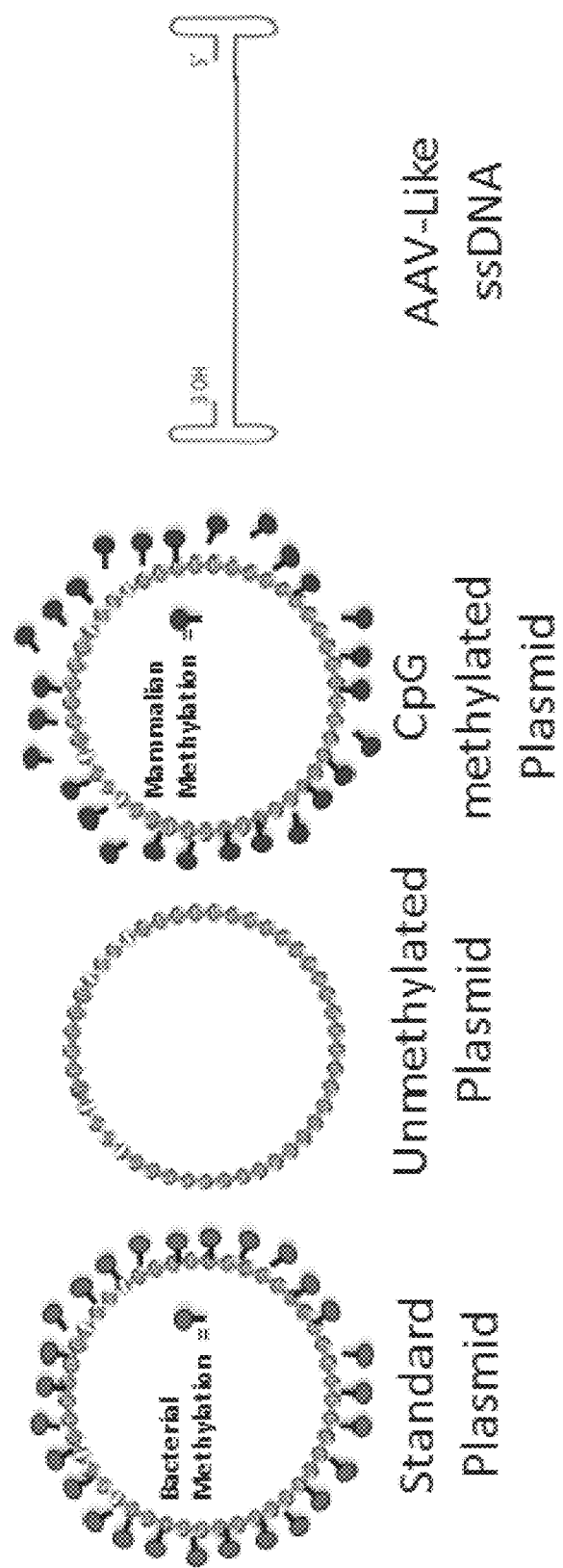
FIG. 21 shows a schematic of representative plasmid modifications. A standard plasmid contains bacterial methylation that can trigger an innate immune sensing system. Removing bacterial methylation can reduce toxicity caused by a standard plasmid. Bacterial methylation can also be removed and mammalian methylation added so that the vector looks like "self-DNA." A modification can also include the use of a synthetic single stranded DNA.

Example 7: An Unmethylated Polynucleic Acid Comprising at Least One Engineered Antigen Receptor with Recombination Arms to a Genomic Region Modifications to polynucleic acids can be performed as shown in FIG. 21. To determine if an unmethylated polynucleic acid can reduce toxicity induced by exogenous plasmid DNA and improve genomic engineering the following experimental example can be employed. To start the maxi prep, a bacterial colony containing the homologous recombination targeting vector was picked and inoculated in 5 mLs LB broth with kanamycin (1:1000) and grown for 4-6 hours at 37° C. The starter culture was then added to a larger culture of 250 mLs LB broth with kanamycin and grown 12-16 hours in the presence of SssI enzyme at 37° C. The maxi was prepped using the Hi Speed Plasmid Maxi Kit (Qiagen) following the manufacturers protocol with one exception. After lysis and neutralization of the prep, 2.5 mL of endotoxin toxin removal buffer was added to the prep and incubated for 45 minutes on ice. The prep was finished in a laminar flow hood to maintain sterility. The concentration of the prep was determined using a Nanodrop.

Example 8: GUIDE-Seq Library Preparation

Genomic DNA was isolated from transfected, control (untransfected and CRISPR transfected cells with minicircle DNA carrying an exogenous TCR, Table 10. Human T cells isolated using solid-phase reversible immobilization magnetic beads (Agencourt DNAdvance), were sheared with a Covaris S200 instrument to an average length of 500 bp, end-repaired, A-tailed, and ligated to half-functional adapters, incorporating a 8-nt random molecular index. Two rounds of nested anchored PCR, with primers complementary to the oligo tag, were used for target enrichment. End Repair Thermocycler Program: 12° C. for 15 min, 37° C. for 15 min; 72° C. for 15 min; hold at 4° C.

Figure 76A:
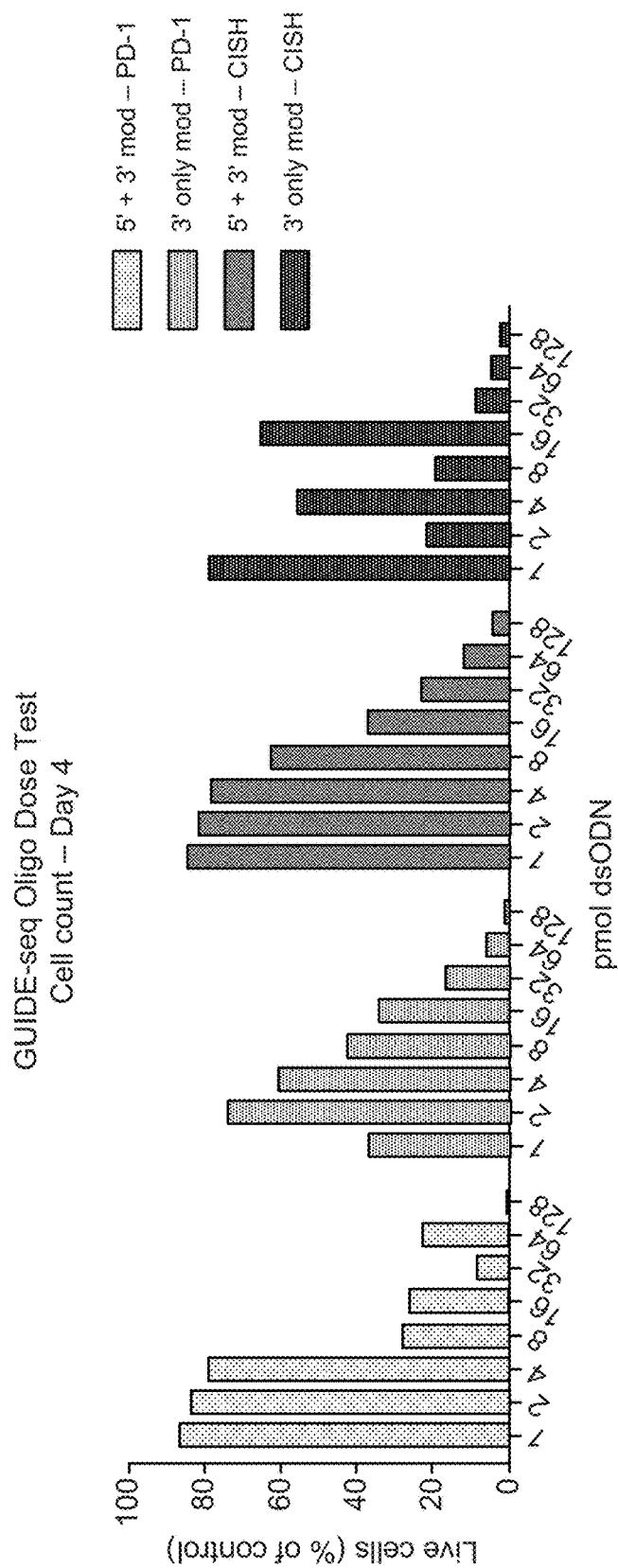
FIG. 76 A and FIG. 76 B show percentage of live cells at day 4 using a GUIDE-Seq dose test of human T cells transfected with CRISPR and PD-1 or CISH gRNAs with 5' or 3' modifications (or both) at increasing concentrations of a double stranded polynucleic acid donor.

Start sites of GUIDE-Seq reads mapped back to the genome enable localization of the DSB to within a few base pairs. Quantitate library using Kapa Biosystems kit for Illumina Library Quantification kit, according to manufacturer instruction. Using the mean quantity estimate of number of molecules per uL given by the qPCR run for each sample, proceed to normalize the total set of libraries to $1.2 \times 10^{10}$ molecules, divided by the number of libraries to be pooled together for sequencing. This will give a by molecule input for each sample, and also a by volume input for each sample Mapped reads for the on- and off-target sites of the three RGNs directed by truncated gRNAs we assessed by GUIDE-Seq are shown. In all cases, the target site sequence is shown with the protospacer sequence to the left and the PAM sequence to the right on the x-axis. Denature the library and load onto the Miseq according to Illumina's standard protocol for sequencing with an Illumina Miseq Reagent Kit V2—300 cycle (2×150 bp paired end). FIG. 76 A and FIG. 76 B show data for a representative GUIDE-Seq experiment.

Example 9: AAVS1 Mutant Protein Generation

Mutant cDNAs, Table 8, were codon optimized and synthesized as gBlock fragments by Integrated DNA technologies (IDT). Synthesized fragments were sub-cloned into an mRNA production vector for in vitro mRNA synthesis.

TABLE 8

| Mutant cDNA sequences for adenoviral proteins | | | |
|---|---|---|---|
| SEQ ID | Mutation | Name | Sequence (5' to 3') |
| 88 | None | Adenovirus serotype 5 E4orf6 | atgacaacaagtggcgtgccattcggcatgactttgcgccccac gagatcacgactgtctcgccgaactccctacagccggga tcgactccctccctttgagactgaaacacgggccacgata ctcgaggaccacccacttctgccggagtgtaacaccttga cgatgcataacgttagctatgtgagaggtctcccttgactg tcggctttacccttattcaagagtgggtcgtgccgtgggac atggttctcacgagagaggagctcgttatcctgagaaaat gtatgcacgtttgtctttgctgtgcaaatatagatataatgac ttctatgatgattcatgggtacgaatcttgggccttgcactg ccattgtagcagtcctggctccctccaatgcatcgcggga ggccaagttctcgcttcctggtttagaatggtcgtggacgg agcaatgttcaaccagcgctttatctggtatcgcgaggtag tcaactataatatgccgaaggaggttatgtttatgtctagtgt gttcatgcgagggagacatttgatttatcttagactgtggta tgatggccatgtgggaagcgtagttccggcgatgtccttc ggttactccgcattgcattgtgggattttgaataacatcgttg tactttgttgttcatactgcgccgatctgtcagaaataaggg tacgatgctgcgcacggcgaacccggaggctcatgctga gagccgttcgaataatcgctgaagaaacgacagcaatgtt gtattcatgccgaactgaaaggcgacggcaacagtttata cgcgcactcttgcagcaccacaggccgatcctgatgcat gactacgatagcactccgatgtag |
| 89 | H->A at amino acid 373 | Adenovirus serotype 5 H373A mutant | atggagagaaggaatcctagtgagaggggagtgcccgccggg ttttctggtcacgcctccgtggaatccggatgtgagactca ggagtccccgccaccgtggtgttccgcccaccaggag acaacactgacggtggcgcggcggctgctgcaggtgga agccaagccgccgctgctggggccgagccgatggaac ccgaatccagacccggtccctctggcatgaacgttgtgca ggtcgcagaactctaccccgaactccgcaggatcttgaca atcacggaggacggccagggcctcaagggagtgaaga gagagagagggcttgtgaggccactgaggaagctcgc aatctggcgttttcattgatgacaaggcacaggccggaat gcattacattccaacagattaaggacaactgcgcaaacga gctcgatctcctggcccagaagtatagcatcgagcagctg acaacctattggctgcagcccggcgacgattttgaagagg ccatccgcgtgtacgcaaaggtggcctgcgacctgact gcaaatataagatttccaaactggttaacatccggaattgtt gttatattagtggaaatggcgcagaagtgggagattgacac |

TABLE 8-continued

Mutant cDNA sequences for adenoviral proteins

| SEQ ID | Mutation | Name | Sequence (5' to 3') |
|---|---|---|---|
| | | | agaggatcgagtcgctttccggtgctctatgatcaacatgt<br>ggcccggtgtgctcggcatggatggcgtagtcattatgaa<br>tgtgaggttcaccggacctaattttagcggaaccgtcttcct<br>ggcaaacactaatctgatcctgcatggagtttctttctatgg<br>atttaataacacctgtgttgaagcttggaccgacgtgcggg<br>ttagagggtgtgcttttttattgctgctggaaaggcgtcgtgt<br>gtagacccaaaagtagagcttctatcaagaaatgcctgttc<br>gagaggtgtactctgggcattctcagtgaaggtaatagca<br>gggtcaggcataacgtggcctcagattgcggatgttttatg<br>ttggttaaatccgtggctgtgatcaagcacaacatggtgtg<br>tggcaattgtgaggaccgggcatctcaaatgctgacatgtt<br>ccgatggcaactgtcacctgctcaaaacaattgccgttgc<br>gagccattctcggaaggcctggccagttttcgagcataac<br>atcctgacgcgctgtagtctccacctgggtaacagacggg<br>gcgttttcctgccatatcagtgtaacctgtcacataccaaga<br>tactcctggaaccagaatctatgagtaaagtgaacctgaat<br>ggtgtattcgatatgaccatgaagatatggaaagtcctccg<br>ctatgacgaaactaggactaggtgtaggccctgcgagtgt<br>ggcggcaagcatatccgcaaccaacccgtgatgctggac<br>gtgaccgaggagctgcgcccgatcacctggtgctggc<br>ctgcaccagagcagaattcgggagctcagacgaagaca<br>ctgattaa |
| 90 | Amino acid<br>Insertion<br>(AGIPA) | Adenovirus<br>serotype 5<br>H354 mutant | atggagagaaggaatcctagtgagaggggagtgcccgccggg<br>ttttctggtcacgcctccgtggaatccggatgtgagactca<br>ggagtcccccgccaccgtggtgttccgcccaccaggag<br>acaacactgacggtggcggcggctgctgcaggtgga<br>agccaagccgccgctgctggggccgagccgatggaac<br>ccgaatccagacccggtccctctggcatgaacgttgtgca<br>ggtcgcagaactctaccccgaactccgcaggatcttgaca<br>atcacggaggacggccagggcctcaagggagtgaaga<br>gagagagggggcttgtgaggccactgaggaagctcgc<br>aatctggcgttttcattgatgacaaggcacaggccggaat<br>gcattacattccaacagattaaggacaactgcgcaaacga<br>gctcgatctcctggcccagaagtatagcatcgagcagctg<br>acaacctattggctgcagcccggcgacgattttgaagagg<br>ccatccgcgtgtacgcaaaggtggccctgcgacctgact<br>gcaaatataagatttccaaactggttaacatccggaattgtt<br>gttatattagtggaaatggcgcagaagtggagattgacac<br>agaggatcgagtcgctttccggtgctctatgatcaacatgt<br>ggcccggtgtgctcggcatggatggcgtagtcattatgaa<br>tgtgaggttcaccggacctaattttagcggaaccgtcttcct<br>ggcaaacactaatctgatcctgcatggagtttctttctatgg<br>atttaataacacctgtgttgaagcttggaccgacgtgcggg<br>ttagagggtgtgcttttttattgctgctggaaaggcgtcgtgt<br>gtagacccaaaagtagagcttctatcaagaaatgcctgttc<br>gagaggtgtactctgggcattctcagtgaaggtaatagca<br>gggtcaggcataacgtggcctcagattgcggatgttttatg<br>ttggttaaatccgtggctgtgatcaagcacaacatggtgtg<br>tggcaattgtgaggaccgggctggaattccagcatctcaa<br>atgctgacatgttccgatggcaactgtcacctgctcaaaac<br>aattcacgttgcgagccattctcggaaggcctggccagttt<br>tcgagcataacatcctgacgcgctgtagtctccacctgggt<br>aacagacggggcgttttcctgccatatcagtgtaacctgtc<br>acataccaagatactcctggaaccagaatctatgagtaaa<br>gtgaacctgaatggtgtattcgatatgaccatgaagatatg<br>gaaagtcctccgctatgacgaaactaggactaggtgtagg<br>ccctgcgagtgtggcggcaagcatatccgcaaccaaccc<br>gtgatgctggacgtgaccgaggagctgcgcccgatca<br>cctggtgctggcctgcaccagagcagaattcgggagctc<br>agacgaagacactgatta' |

Example 10. Genomic Engineering of TIL to Knock Out PD-1, CTLA-4, and CISH

Suitable tumors from eligible stage IIIc-IV cancer patients will be resected and cut up into small 3-5 mm$^2$ fragments and placed in culture plates or small culture flasks with growth medium and high-dose (HD) IL-2. The TIL will initially be expanded for 3-5 weeks during this "pre-rapid expansion protocol" (pre-REP) phase to at least 50×10$^6$ cells. TILs are electroporated using the Neon Transfection System (100 uL or 10 ul Kit, Invitrogen, Life Technologies). TILS will be pelleted and washed once with T buffer. TILs are resuspended at a density of 2×10^5 cells in 10 uL of T buffer for 10 ul tip, and 3×10^6 cells in 100 ul T buffer for 100 ul tips. TILs are then electroporated at 1400 V, 10 ms, 3 pulses utilizing 15 ug Cas9 mRNA, and 10-50 ug PD-1, CTLA-4, and CISH gRNA-RNA (100mcl tip). After transfection, TILs will be plated at 1000 cells/ul in antibiotic free culture media and incubated at 30C in 5% CO2 for 24 hrs. After 24 hr recovery, TILs can be transferred to antibiotic containing media and cultured at 37C in 5% CO2.

Figure 102:
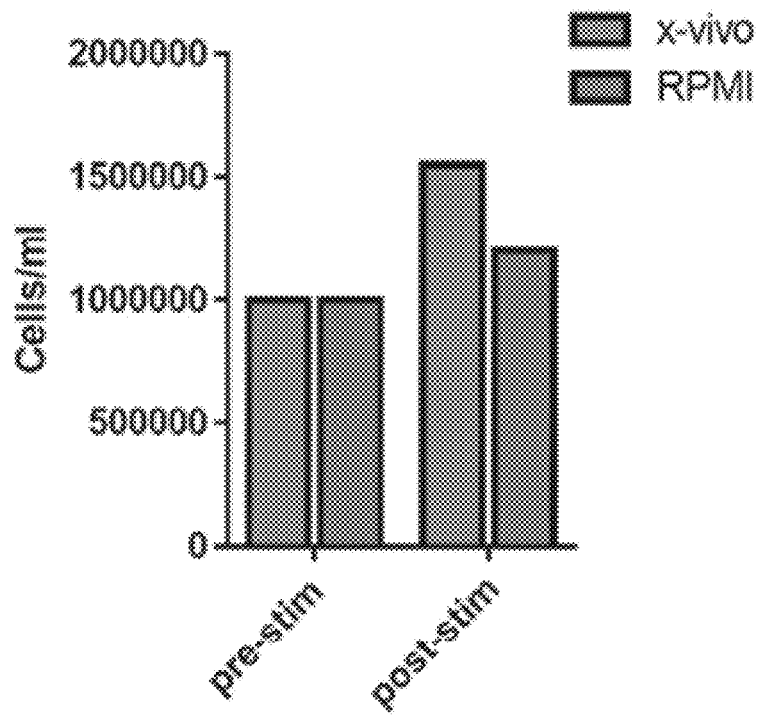
FIG. 102 A and FIG. 102 B show absolute cell count pre and post stimulation of human TILs.
Figure 102:
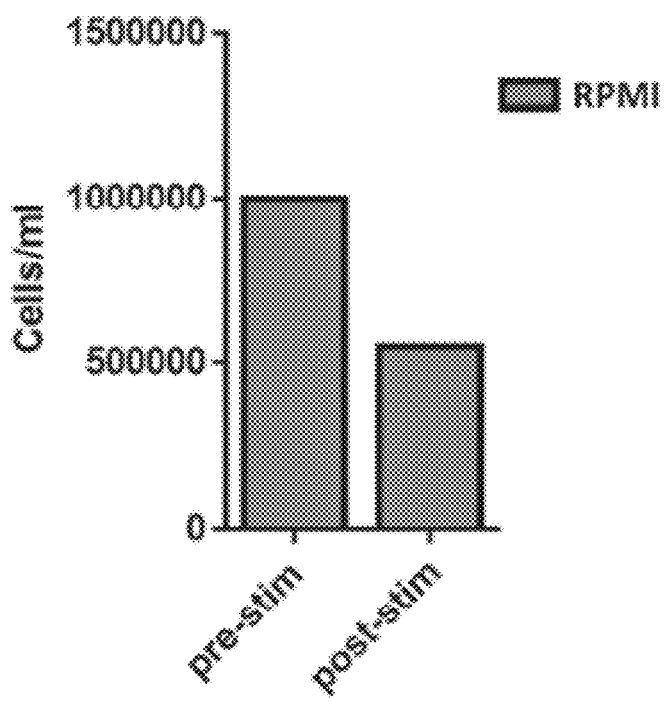
Figure 103:
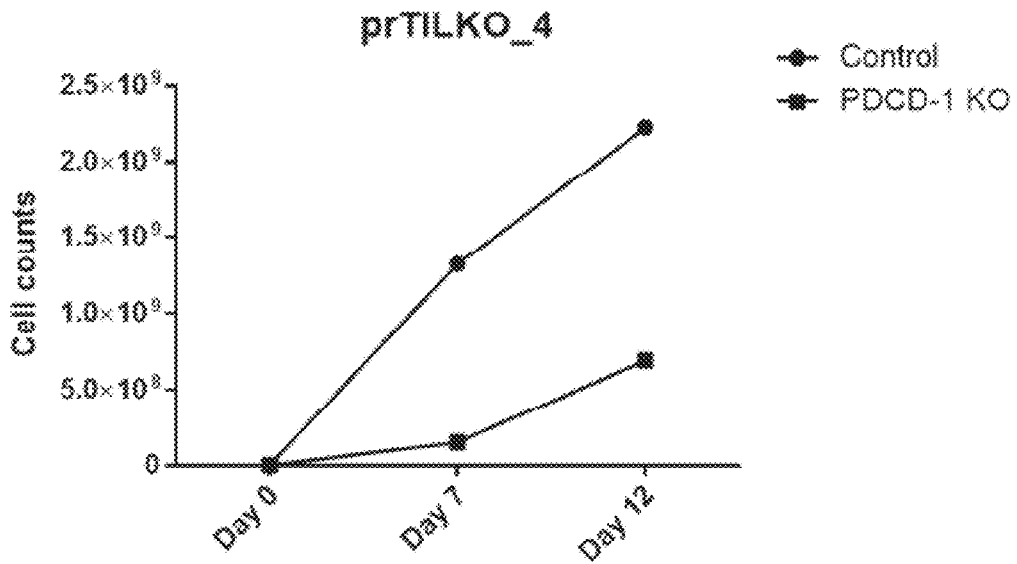
FIG. 103 A and FIG. 103 B show cellular expansion of human tumor infiltrating lymphocytes (TILs) electroporated with a CRISPR system targeting PD-1 locus or controls cells FIG. 103 A with the addition of autologous feeders or FIG. 103 B without the addition of autologous feeders.
Figure 103:
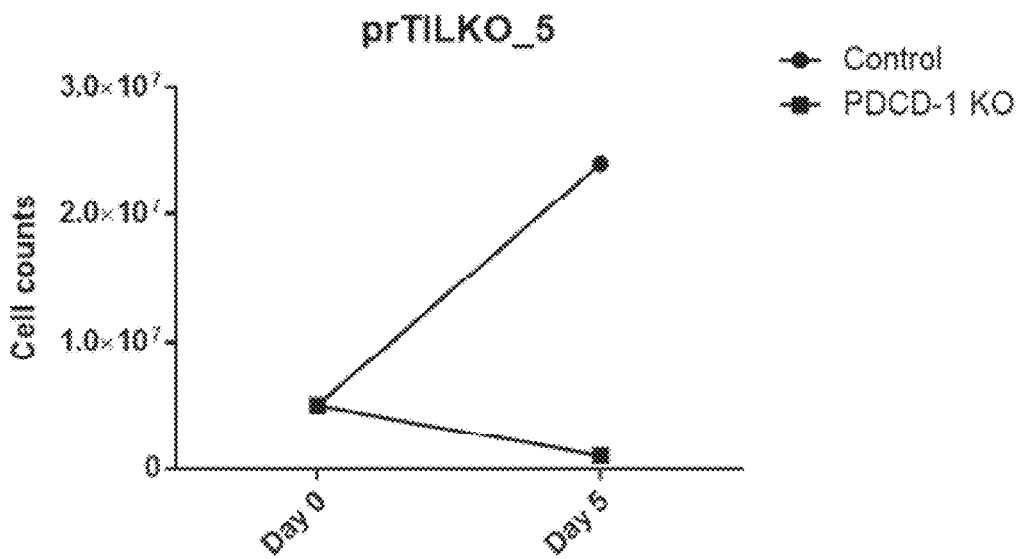

The cells are then subjected to a rapid expansion protocol (REP) over two weeks by stimulating the TILs using anti-CD3 in the presence of PBMC feeder cells and IL-2. The expanded TIL (now billions of cells) will be washed, pooled, and infused into a patient followed by one or two cycles of HD IL-2 therapy. Before TIL transfer, a patient can be treated with a preparative regimen using cyclophosphamide (Cy) and fludaribine (Flu) that transiently depletes host lymphocytes "making room" for the infused TIL and removing cytokine sinks and regulatory T cells in order to facilitate TIL persistence. Subjects will receive an infusion of their own modified TIL cells over 30 minutes and will remain in the hospital to be monitored for adverse events until they have recovered from the treatment. FIG. 102 A and FIG. 102 B show cellular expansion of TIL of two different subj11111111111111111ects. FIG. 103 A and FIG. 103 B show cellular expansion of TIL electroporated with a CRISPR system, and anti-PD-1 guides and cultured with the addition of feeders (A) or no addition of feeders (B).

TABLE 9

Endogenous checkpoint summary

| SEQ ID | Gene Symbol | Abbreviation | Name | NCBI number (GRCh38.p2) *AC010327.8 ** GRCh38.p7 | Original Start | Original Stop | Location in genome |
|---|---|---|---|---|---|---|---|
| 91 | ADORA2A | A2aR; RDC8; ADORA2 | adenosine A2a receptor | 135 | 24423597 | 24442360 | 22q11.23 |
| 92 | CD276 | B7H3; B7-H3; B7RP-2; 41g-B7-H3 | CD276 molecule | 80381 | 73684281 | 73714518 | 15q23-q24 |
| 93 | VTCN1 | B7X; B7H4; B7S1; B7-H4; B7h.5; VCTN1; PRO1291 | V-set domain containing T cell activation inhibitor 1 | 79679 | 117143587 | 117270368 | 1p13.1 |
| 94 | BTLA | BTLA1; CD272 | B and T lymphocyte associated | 151888 | 112463966 | 112499702 | 3q13.2 |
| 95 | CTLA4 | GSE; GRD4; ALPS5; CD152; CTLA-4; IDDM12; CELIAC3 | cytotoxic T-lymphocyte-associated protein 4 | 1493 | 203867788 | 203873960 | 2q33 |
| 96 | IDO1 | IDO; INDO; IDO-1 | indoleamine 2,3-dioxygenase 1 | 3620 | 39913809 | 39928790 | 8p12-p11 |
| 97 | KIR3DL1 | KIR; NKB1; NKAT3; NKB1B; NKAT-3; CD158E1; KIR3DL2; KIR3DL1/S1 | killer cell immunoglobulin-like receptor, three domains, long cytoplasmic tail, 1 | 3811 | 54816438 | 54830778 | 19q13.4 |
| 98 | LAG3 | LAG3;CD223 | lymphocyte-activation gene 3 | 3902 | 6772483 | 6778455 | 12p13.32 |
| 99 | PDCD1 | PD1; PD-1; CD279; SLEB2; hPD-1; hPD-1; hSLE1 | programmed cell death 1 | 5133 | 241849881 | 241858908 | 2q37.3 |
| 100 | HAVCR2 | TIM3; CD366; KIM-3; TIMD3; Tim-3; TIMD-3; HAVcr-2 | hepatitis A virus cellular receptor 2 | 84868 | 157085832 | 157109237 | 5q33.3 |
| 101 | VISTA | C10orf54, differentiation of ESC-1 (Dies 1); platelet receptor Gi24 precursor; PD1 homolog (PD1H) B7H5; GI24; B7-H5; SISP1; PP2135 | V-domain immunoglobulin suppressor of T-cell activation | 64115 | 71747556 | 71773580 | 10q22.1 |
| 102 | CD244 | 2B4; 2B4; NAIL; Nmrk; NKR2B4; SLAMF4 | CD244 molecule, natural killer cell receptor 2B4 | 51744 | 160830158 | 160862902 | 1q23.3 |
| 103 | CISH | CIS; G18; SOCS; CIS-1; BACTS2 | cytokine inducible SH2-containing protein | 1154 | 50606454 | 50611831 | 3p21.3 |
| 104 | HPRT1 | HPRT; HGPRT | hypoxanthine phosphoribosyl-transferase 1 | 3251 | 134452842 | 134500668 | Xq26.1 |

TABLE 9-continued

Endogenous checkpoint summary

| SEQ ID | Gene Symbol | Abbreviation | Name | NCBI number (GRCh38.p2) *AC010327.8 ** GRCh38.p7 | Original Start | Original Stop | Location in genome |
|---|---|---|---|---|---|---|---|
| 105 | AAV*S1 | AAV | adeno-associated virus integration site 1 | 14 | 7774 | 11429 | 19q13 |
| 106 | CCR5 | CKR5; CCR-5; CD195; CKR-5; CCCKR5; CMKBR5; IDDM22; CC-CKR-5 | chemokine (C-C motif) receptor 5 (gene/pseudogene) | 1234 | 46370142 | 46376206 | 3p21.31 |
| 107 | CD160 | NK1; BY55; NK28 | CD160 molecule | 11126 | 145719433 | 145739288 | 1q21.1 |
| 108 | TIGIT | VSIG9; VSTM3; WUCAM | T-cell immunorecept or with Ig and ITIM domains | 201633 | 114293986 | 114310288 | 3q13.31 |
| 109 | CD96 | TACTILE | CD96 molecule | 10225 | 111542079 | 111665996 | 3q13.13-q13.2 |
| 110 | CRTAM | CD355 | cytotoxic and regulatory T-cell molecule | 56253 | 122838431 | 122872643 | 11q24.1 |
| 111 | LAIR1 | CD305; LAIR-1 | leukocyte associated immunoglobulin like receptor 1 | 3903 | 54353624 | 54370556 | 19q13.4 |
| 112 | SIGLEC7 | p75; QA79; AIRM1; CD328; CDw328; D-siglec; SIGLEC-7; SIGLECP2; SIGLEC19P; p75/AIRM1 | sialic acid binding Ig like lectin 7 | 27036 | 51142294 | 51153526 | 19q13.3 |
| 113 | SIGLEC9 | CD329; CDw329; FOAP-9; siglec-9; OBBP-LIKE | sialic acid binding Ig like lectin 9 | 27180 | 51124880 | 51141020 | 19q13.41 |
| 114 | TNFRSF10B | DRS; CD262; KILLER; TRICK2; TRICKB; ZTNFR9; TRAILR2; TRICK2A; TRICK2B; TRAIL-R2; KILLER/DRS | tumor necrosis factor receptor superfamily member 10b | 8795 | 23006383 | 23069187 | 8p22-p21 |
| 115 | TNFRSF10B | DR4; APO2; CD261; TRAILR1; TRAIL-1 | tumor necrosis factor receptor superfamily member 10a | 8797 | 23191457 | 23225167 | 8p21 |
| 116 | CASP8 | CAP4; MACH; MCH5; FLICE; ALPS2B; Casp-8 | caspase 8 | 841 | 201233443 | 201287711 | 2q33-q34 |
| 117 | CASP10 | MCH4; ALPS2; FLICE2 | caspase 10 | 843 | 201182898 | 201229406 | 2q33-q34 |
| 118 | CASP3 | CPP32; SCA-1; CPP32B | caspase 3 | 836 | 184627696 | 184649475 | 4q34 |
| 119 | CASP6 | MCH2 | caspase 6 | 839 | 109688628 | 109713904 | 4q25 |
| 120 | CASP7 | MCH3; CMH-1; LICE2; CASP-7; ICE-LAP3 | caspase 7 | 840 | 113679162 | 113730909 | 10q25 |
| 121 | FADD | GIG3; MORT1 | Fas associated via death domain | 8772 | 70203163 | 70207402 | 11q13.3 |
| 122 | FAS | APT1; CD95; FAS1; APO-1; FASTM; ALPS1A; TNFRSF6 | Fas cell surface death receptor | 355 | 88969801 | 89017059 | 10q24.1 |
| 123 | TGFBRII | AAT3; FAA3; LDS2; MFS2; RIIC; LDS1B; LDS2B; TAAD2; TGFR-2; TGFbeta-RII | transforming growth factor beta receptor II | 7048 | 30606493 | 30694142 | 3p22 |
| 124 | TGFBR1 | AAT5; ALK5; ESS1; LDS1; MSSE; SKR4; ALK-5; LDS1A; | transforming growth factor beta receptor I | 7046 | 99104038 | 99154192 | 9q22 |

TABLE 9-continued

Endogenous checkpoint summary

| SEQ ID | Gene Symbol | Abbreviation | Name | NCBI number (GRCh38.p2) *AC010327.8 ** GRCh38.p7 | Original Start | Original Stop | Location in genome |
|---|---|---|---|---|---|---|---|
| 125 | SMAD2 | LDS2A; TGFR-1; ACVRLK4; tbetaR-I JV18; MADH2; MADR2; JV18-1; hMAD-2; hSMAD2 | SMAD family member 2 | 4087 | 47833095 | 47931193 | 18q21.1 |
| 126 | SMAD3 | LDS3; LDS1C; MADH3; JV15-2; HSPC193; HsT17436 | SMAD family member 3 | 4088 | 67065627 | 67195195 | 15q22.33 |
| 127 | SMAD4 | JIP; DPC4; MADH4; MYHRS | SMAD family member 4 | 4089 | 51030213 | 51085042 | 18q21.1 |
| 128 | SKI | SGS; SKV | SKI proto-oncogene | 6497 | 2228695 | 2310213 | 1p36.33 |
| 129 | SKIL | SNO; SnoA; SnoI; SnoN | SKI-like proto-oncogene | 6498 | 170357678 | 170396849 | 3q26 |
| 130 | TGIF1 | HPE4; TGIF | TGFB induced factor homeobox 1 | 7050 | 3411927 | 3458411 | 18p11.3 |
| 131 | IL10RA | CD210; IL10R; CD210a; CDW210A; HIL10R; IL-10R1 | interleukin 10 receptor subunit alpha | 3587 | 117986391 | 118001483 | 11q23 |
| 132 | IL10RB | CRFB4; CRF2-4; D21S58; D21S66; CDW210B; IL10R2 | interleukin 10 receptor subunit beta | 3588 | 33266360 | 33297234 | 21q22.11 |
| 133 | HMOX2 | HO-2 | heme oxygenase 2 | 3163 | 4474703 | 4510347 | 16p13.3 |
| 134 | IL6R | IL6Q; gp80; CD126; IL6RA; IL6RQ; IL6RA; IL-6R-1 | interleukin 6 receptor | 3570 | 154405193 | 154469450 | 1q21 |
| 135 | IL6ST | CD130; GP130; CDW130; IL-6RB | interleukin 6 signal transducer | 3572 | 55935095 | 55994993 | 5q11.2 |
| 136 | CSK | CSK | c-src tyrosine kinase | 1445 | 74782084 | 74803198 | 15q24.1 |
| 137 | PAG1 | CBP; PAG | phosphoprotein membrane anchor with glycosphingolipid microdomains 1 | 55824 | 80967810 | 81112068 | 8q21.13 |
| 138 | SIT1 | SIT1 | signaling threshold regulating transmembrane adaptor 1 | 27240 | 35649298 | 35650950 | 9p13-p12 |
| 139 | FOXP3 | JM2; AIID; IPEX; PIDX XPID; DIETER | forkhead box P3 | 50943 | 49250436 | 49269727 | Xp11.23 |
| 140 | PRDM1 | BLIMP1; PRDI-BF1 | PR domain 1 | 639 | 106086320 | 106109939 | 6q21 |
| 141 | BATF | SFA2; B-ATF; BATF1; SFA-2 | basic leucine zipper transcription factor, ATF-like | 10538 | 75522441 | 75546992 | 14q24.3 |
| 142 | GUCY1A2 | GC-SA2; GUC1A2 | guanylate cyclase 1, soluble, alpha 2 | 2977 | 106674012 | 107018445 | 11q21-q22 |
| 143 | GUCY1A3 | GUCA3; MYMY6; GC-SA3; GUC1A3; GUCSA3; GUCY1A1 | guanylate cyclase 1, soluble, alpha 3 | 2982 | 155666568 | 155737062 | 4q32.1 |
| 144 | GUCY1B2 | GUCY1B2 | guanylate cyclase 1, soluble, beta 2 (pseudogene) | 2974 | 50994511 | 51066157 | 13q14.3 |
| 145 | GUCY1B3 | GUCB3; GC-SB3; GUC1B3; GUCSB3; GUCY1B1; GC-S-beta-1 | guanylate cyclase 1, soluble, beta 3 | 2983 | 155758973 | 155807642 | 4q31.3-q33 |

TABLE 9-continued

Endogenous checkpoint summary

| SEQ ID | Gene Symbol | Abbreviation | Name | NCBI number (GRCh38.p2) *AC010327.8 ** GRCh38.p7 | Original Start | Original Stop | Location in genome |
|---|---|---|---|---|---|---|---|
| 146 | TRA | IMD7; TCRA; TCRD; TRAalpha; TRAC | T-cell receptor alpha locus | 6955 | 21621904 | 22552132 | 14q11.2 |
| 147 | TRB | TCRB; TRBbeta | T cell receptor beta locus | 6957 | 142299011 | 142813287 | 7q34 |
| 148 | EGLN1 | HPH2; PHD2; SM20; ECYT3; HALAH; HPH-2; HIFPH2; ZMYND6; C1orf12; HIF-PH2 | egl-9 family hypoxia-inducible factor 1 | 54583 | 231363751 | 231425044 | 1q42.1 |
| 149 | EGLN2 | EIT6; PHD1; HPH1; HPH-3; HIFPHI; HIF-PH1 | egl-9 family hypoxia-inducible factor 2 | 112398 | 40799143 | 40808441 | 19q13.2 |
| 150 | EGLN3 | PHD3; HIFPH3; HIFP4H3 | egl-9 family hypoxia-inducible factor 3 | 112399 | 33924215 | 33951083 | 14q13.1 |
| 151 | PPP1R12C** | p84; p85; LENG3; MBS85 | protein phosphatase 1 regulatory subunit 12C | 54776 | 55090913 | 55117600 | 19q13.42 |

TABLE 10

Engineered T cell receptor (TCR)

| SEQ ID | Sequence 5'-3' |
|---|---|
| 152 | atggccttggtaacctctataactgtgctgctcagtctcggg atcatgggagatgctaagactactcagcctaatagtatggaa agtaatgaggaggagcctgtccacctgccttgtaatcactct accataagcgggacagattacatacattggtatcggcagctc ccttcacaaggtccagagtatgtgattcatggcctcacatca aatgtgaacaatcggatggcttctcttgccattgcagaggat cggaaaagctcaacactcatcctgcatagggcgacactcaga gatgcggccgtttatta |

TABLE 11

Streptococcus pyogenes Cas9 (SpCas9)

| SEQ ID | Sequence 5' to 3' |
|---|---|
| 153 | atggactataaggaccacgacggagactacaaggatcatgat attgattacaaagacgatgacgataagatggcccccaaagaag |

TABLE 11-continued

Streptococcus pyogenes Cas9 (SpCas9)

| SEQ ID | Sequence 5' to 3' |
|---|---|
| | aagcggaaggtcggtatccacggagtcccagcagccgacaag aagtacagcatcggcctggacatcggcaccaactctgtgggc tgggccgtgatcaccgacg |

Example 11: gRNA Modification

Design and Construction of Modified Guide RNAs:
Guide RNAs (gRNAs) were designed to the desired region of a gene using the CRISPR Design Program (Zhang Lab, M I T 2015). Multiple gRNAs (shown in Table 12) were chosen based on the highest ranked values determined by off-target locations. The gRNAs targeting PD-1, CTLA-4, and CISH gene sequences were modified to contain 2-O-Methyl 3phosphorothioate additions, FIG. 44 and FIG. 59.

TABLE 12

Sequence listings for modified gRNAs targeting the PD-1, CTLA-4, AAVS1, or CISH genes.

| SEQ ID | gRNA | Sequence 5'-3' |
|---|---|---|
| 154 | PD-1 gRNA #2 | gcctgctcgtggtgaccgaagguuuuagagcuagaaauagcaaguu aaaauaaggcuaguccguuaucaacuugaaaaaguggcac cgagucggugcuuuu |
| 155 | PD-1 gRNA #6 | gacggaagcggcagtcctggcguuuuagagcuagaaauagcaagu uaaaauaaggcuaguccguuaucaacuugaaaaaguggca ccgagucggugcuuuu |
| 156 | CTLA4 gRNA #3 | gctagatgattccatctgcacguuuuagagcuagaaauagcaaguua aaauaaggcuaguccguuaucaacuugaaaaaguggcacc gagucggugcuuuu |

TABLE 12-continued

Sequence listings for modified gRNAs targeting
the PD-1, CTLA-4, AAVS1, or CISH genes.

| SEQ ID | gRNA | Sequence 5'-3' |
|---|---|---|
| 157 | CTLA4 gRNA #2 | gtgcggcaacctacatgatgguuuuagagcuagaaauagcaaguua aaauaaggcuaguccguuaucaacuugaaaaaguggcacc gagucggugcuuuu |
| 158 | CISH gRNA #2 | gggttccattacggccagcgguuuuagagcuagaaauagcaaguua aaauaaggcuaguccguuaucaacuugaaaaaguggcacc gagucggugcuuuu |
| 159 | AAVS1 | gtcaccaatcctgtccctagguuuuagagcuagaaauagcaaguuaa aauaaggcuaguccguuaucaacuugaaaaaguggcaccg agucggugcuuuu |

TABLE 13

| SEQ ID | Construct | Sequence 5'-3' |
|---|---|---|
| 174 | pPBSB-Cagg-RTreporter (Puro)( ) | gtggcacttttcggggaaatgtgcgcggaaccccctatttgtttattttttctaaatacattcaaatatgtatccgctcatgag acaataaccctgataaatgcttcaataatattgaaaaaggaagagtatgagtattcaacattttccgtgtcgcccttattcc cttttttgcggcattttgccttcctgttttgctcacccagaaacgctggtgaaagtaaaagatgctgaagatcagttggg tgcacgagtgggttacatcgaactggatctcaacagcggtaagatccttgagagttttcgccccgaagaacgttttcc aatgatgagcacttttaaagttctgctatgtggcgcggtattatcccgtattgacgccgggcaagagcaactcggtcg ccgcatacactattctcagaatgacttggttgagtactcaccagtcacagaaaagcatcttacggatggcatgacagt aagagaattatgcagtgctgccataaccatgagtgataacactgcggccaacttacttctgacaacgatcggaggac cgaaggagctaaccgcttttttgcacaacatgggggatcatgtaactcgccttgatcgttgggaaccggagctgaat gaagccataccaaacgacgagcgtgacaccacgatgcctgtagcaatggcaacaacgttgcgcaaactattaact ggcgaactacttactctagcttcccggcaacaattaatagactggatggaggcggataaagttgcaggaccacttct gcgctcggcccttccggctggctggtttattgctgataaatctggagccggtgagcgtgggtctcgcggtatcattgc agcactggggccagatggtaagccctcccgtatcgtagttatctacacgacggggagtcaggcaactatggatgaa cgaaatagacagatcgctgagataggtgcctcactgattaagcattggtaactgtcagaccaagtttactcatatatac tttagattgatttaaaacttcatttttaatttaaaaggatctaggtgaagatcctattgataatctcatgaccaaaatcccta acgtgagttttcgttccactgagcgtcagacccccgtagaaaagatcaaaggatcttcttgagatcctttttttctgcgcg taatctgctgcttgcaaacaaaaaaaccaccgctaccagcggtggtttgtttgccggatcaagagctaccaactcttt tccgaaggtaactggcttcagcagagcgcagataccaaatactgtccttctagtgtagccgtagttaggccaccactt caagaactctgtagcaccgcctacatacctcgctctgctaatcctgttaccagtggctgctgccagtggcgataagtc gtgtcttaccgggttggactcaagacgatagttaccggataaggcgcagcggtcgggctgaacggggggttcgtg cacacagcccagcttggagcgaacgacctacaccgaactgagatacctacagcgtgagctatgagaaagcgcca cgcttcccgaagggagaaaggcggacaggtatccggtaagcggcagggtcggaacaggagagcgcacgagg gagcttccagggggaaacgcctggtatctttatagtcctgtcgggtttcgccacctctgacttgagcgtcgatttttgtg atgctcgtcaggggggcggagcctatggaaaaacgccagcaacgcggcctttttacggttcctggccttttgctggc cttttgctcacatgttctttcctgcgttatcccctgattctgtggataaccgtattaccgcctttgagtgagctgataccgct cgccgcagccgaacgaccgagcgcagcgagtcagtgagcgaggaagcggaagagcgcccaatacgcaaacc gcctctccccgcgcgttggccgattcattaatgcagctggcacgacaggtttcccgactggaaagcgggcagtgag cgcaacgcaattaatgtgagttagctcactcattaggcaccccaggctttacactttatgcttccggctcgtatgttgtgt ggaattgtgagcggataacaatttcacacaggaaacagctatgaccatgattacgccaagcgcgcccgccgggta actcacggggtatccatgtccatttctgcggcatccagccaggatacccgtcctcgctgacgtaatatcccagcgcc gcaccgctgtcattaatctgcacaccgggcacggttccgctcgtcgccgtcgcgacgttgttcgggttgctgatgcgttc gggctgaccatccggaactgtgtccggaaaagccgcgaactggtatcccaggtggcctgaacgaacagttca ccgttaaaggcgtgcatggccacaccttcccgaatcatcatggtaaacgtgcgttttcgctcaacgtcaatgcagcag cagtcatcctcggcaaactctttccatgccgcttcaacctcgcgggaaaaggcacgggcttcttcctcccgatgcc cagatagccgcagcttgggcgatgactgagccggaaaaagaccgacgatatgatcctgatgcagctagattaa ccctagaaagatagtctgcgtaaaattgacgcatgcattcttgaaatattgctctctcttttctaaatagcgcgaatccgtc gctgtgcatttaggacatctcagtcgccgcttggagctcccgtgaggcgtgcttgtcaatgcggtaagtgtcactgatt ttgaactataacgaccgcgtgagtcaaaatgacgcatgattatcttttacgtgactttttaagatttaactcatacgataatt atattgttattttcatgttctacttgctgataacttattatatatattttcttgttatagataaatggtaccgatccctatac agttgaagtcggaagtttacatacaccttagccaaatacatttaaactcactttttcacaattcctgacatttaatcctagt aaaaattccctgtcttaggtcagttaggatcaccacttttatttaagaatgtgaaatatcagaataatagtagagagaatg attcattcagcttttatttctttcatcacattcccagtgggtcagaagtttacatacactcaattagtatttggtagcattgc ctttaaattgtttaactgctctcccctttagtgagggttaattgatatgcgaattcagatgctgcatagttaataatagtcaattt acggggtcattagttcatagcccatatatggagttccgcgttacataacttacggtaaatggcccgcctggctgaccg cccaacgacccccgcccattgacgtcaataatgacgtatgttcccatagtaacgccaatagggactttccattgacgt caatgggtggactatttacggtaaactgcccacttggcagtacatcaagtgtatcatatgccaagtacgccccctattg acgtcaatgacggtaaatggcccgcctggcattatgcccagtacatgaccttatgggactttcctacttggcagtacat ctacgtattagtcatcgctattaccatgggtcgaggtgagccccacgttctgcttcactctccccatctcccccccctcc ccacccccaattttgtatttatttattttttaattattttgtgcagcgatgggggcgggggggggggggggcgcgcgcca ggcggggcggggcggggcgaggggcggggcggggcgaggcggagaggtgcggcggcagccaatcagag cggcgcgctccgaaagtttccttttatggcgaggcggcggcggcggcggccctataaaaagcgaagcgcgcggc gggcgggagtcgctgcgttgccttcgccccgtgccccgctccgccgccgcctcgcgccgcccgccccggctctga ctgaccgcgttactcccacaggtgagcgggcgggacgggcccttctcctccgggctgtaattagcgcttggtttaatg acggctcgtttctttttctgtggctgcgtgaaagccttaaagggctccgggagggccctttgtgcgggggggagcgg ctcggggggtgcgtgcgtgtgtgtgtgcgtggggagcgccgcgtgcggcccgcgctgcccggcggctgtgagc gctgcgggcgcggcgcggggctttgtgcgctccgcgtgtgcgcgaggggagcgcggccgggggcggtgccc TABLE 13-continued

| SEQ ID | Construct | Sequence 5'-3' |
|---|---|---| gcggtgcggggggggctgcgaggggaacaaaggctgcgtgcggggtgtgtgcgtgggggggtgagcagggggg
tgtgggcgcggcggtcgggctgtaacccccccctgcaccccctccccgagttgctgagcacggcccggcttcg
ggtgcggggctccgtgcggggcgtggcgcgggctcgccgtgccgggcgggggtggcggcaggtgggggt
gccgggcggggcggggccgcctcgggcggggagggctcgggggaggggcgcggcggcccggagcgcc
ggcggctgtcgaggcgcggcgagccgcagccattgccttttatggtaatcgtgcgagagggcgcagggacttcct
ttgtcccaaatctggcggagccgaaatctggaggcgccgccgcacccctctagcggggcgcgggcgaagcgg
tgcggcgccggcaggaaggaaatgggcgggaggggccttcgtgcgtcgccgcgccgccgtcccttctccatct
ccagcctcggggctgccgcaggggacggctgccttcgggggggacggggcagggcggggttcggcttctgg
cgtgtgaccggcggctctagagcctctgctaaccatgttcatgccttcttcttttcctacagctcctgggcaacgtgct
ggttgttgtgctgtctcatcattttggcaaagaattcataacttcgtatagcatacattatacgaagttatgagctctctgg
ctaactagagaacccactgatactggcttatcgaaattaatacgactcactatagggagacccaagctggctagtta
agctatcaagcctgcttttttgtacaaacttgtgctcttgggctgcaggtcgaggatctccataagagaagagggac
agctatgactgggagtagtcaggagaggaggaaaaatctggctagtaaaacatgtaaggaaaattttagggatgtta
aagaaaaaataacacaaaacaaaatataaaaaaaatctaacctcaagtcaaggcttttctatggaataaggaatgg
acagcaggggctgttcatatactgatgacctctttatagccaacctttgttcatggcagccagcatatgggcatatgt
tgccaaactctaaaccaaatactcattctgatgtttaaatgatttgccctcccatatgtccttccgagtgagagacacaa
aaaattccaacacactattgcaatgaaaataaatttcctttattagccagaagtcagatgctcaagggcttcatgatgt
ccccataattttggcagagggaaaaagatctcagtggtatttgtgagccagggcattggccacaccaccaccacc
ttctgataggcagcctgcacctgaggagtgaattatcgaattcctattacacccactcgtgcaggctgcccagggct
tgcccaggctggtcagctgggcgatggcggtcgtgctgctccacgaagccgccgtcctccacgtaggtcttctc
caggcggtgctggatgaagtggtactcggggaagtccttcaccacgcccttgctcttcatcagggtgcgcatgtgg
cagctgtagaacttgccgctgttcaggcggtacaccaggatcacctggcccaccagcacgccgtcgttcatgtaca
ccacctcgaagctgggctgcaggccggtgatggtcttatcatccaggggccgtcgttggggaagttgcggccctt
gtactccacgcggtacacgaacatctcctcgatcaggttgatgtcgctgcggatctccaccaggccgccgtcctcgt
agcgcagggtgcgctcgtacacgaagccggcggggaagctctggatgaagaagtcgctgatgtcctcggggtac
ttggtgaaggtgcggttgccgtactggaaggcggggctcaggtgagtccaggagatgtttcagcactgttgcctta
gtctcgaggcaacttagacaactgagtattgatctgagcacagcagggtgtgagctgtttgaagatactgggggttgg
gggtgaagaaactgcagaggactaactgggctgagaccagtggcaatgtttagggcctaaggaatgcctctga
aaatctagatggacaactttgactttgagaaagagaggtggaaatgaggaaaatgacttttctttattagatttcggta
gaaagaactttcatctttcccctattttgttattcgttttaaaacatctatctggaggcaggacaagtatggtcattaaaaa
gatgcaggcagaaggcatatattggctcagtcaaacatgggggaacttggtggccaaacatacattgctaaggctat
tcctatatcagctggacacatataaatgctgctaatgcttcattacaaacttatatcctttaattccagatgggggcaaa
gtatgtccaggggtgaggaacaattgaaacatttgggctggagtagattttgaaagtcagctctgtgtgtgtgtgtg
tgtgtgtgtgtgtgtgtgtgcgcgcacgtgtgtttgtgtgtgtgagagcgtgtgtttcttttaacgtatcagcctacag
catacagggttcagtggtggcaagaagtaacaagatttaaattatggccagtgactagtgctgcaagaagaacaact
acctgcatttaatgggaaagcaaaatctcaggctttgagggaagttaacataggcttgattctgggtggaagctgggt
gtgtagttatctggaggccaggctggagctctcagctcactatgggttcatctttattgtctcctttcatctcatcaggat
gtcgaaggcgaagggcagggggggcgccatggtcacgcggatctgcaccagctggttgccgaacaggatgttgc
ccttgccgcagccctccatggtgaacacgtggttgttcaccacgccctccaggttcaccttgaagctcatgatctcct
gcaggccggtgttcttcaggatctgcttgctcaccatgtaattcctcacgacacctgaaatggaagaaaaaactttt
gaaccactgtctgaggcttgagaatgaaccaagatccaaactcaaaagggcaaattccaaggagaattacatcaa
gtgccaagctggcctaacttcagtctccacccactcagtgtggggaaactccatcgcataaaaccctcccccaac
ctaaagacgacgtactccaaaagctcgaagaactaatcgaggtgcctggacgggcccggtactccgtggagtcac
atgaagcgacgggctgaggacggaaaggccctatcctttgtgtgggtgactcacccgcccgctctcccgagcgcc
cgtcctccattttgagctccctgcagcagggccgggaagcggccatctttccgctcacgcaactggtgccgaccgg
gccagccttgccgcccagggcggggcgatacacggcggcgcgaggccaggcaccagagcaggccggccagc
ttgagactacccccgtccgattctcggtgccgcgctcgcaggcccccgcctcgccgaacatgtgcgctgggacgc
acgggccccgtcgccgcccgcggccccaaaaaccgaaataccagtgtgcagatcttggcccgcatttacaagact
atcttgccagaaaaaaagccttgccagaaaaaaagcgtcgcagcaggtcatcaaaaattttaaatggctagagactt
atcgaaagcagcgagacaggcgcgaaggtgccaccagattccgcacgcggcggccccagcgcccaggccag
gcctcaactcaagcacgaggcgaaggggctccttaagcgcaaggcctcgaactctcccacccacttccaacccga
agctcgggatcaagaatcacgtactgcagccaggggcgtggaagtaattcaaggcacgcaaggggccataaccg
taaagaggccaggcccgcgggaaccacacacggcacttacctgtgttctggcggcaaaccgttgcgaaaaga
acgttcacggcgactactgcacttatatacggttctccccacccctcggggaaaaaggcggagccagtacacgacat
cactttcccagtttacccccgcgccaccttctctaggcaccggttcaattgccgaccccctccccccaacttctcggggga
ctgtgggcgatgtgcgctctgcccactgacgggcaccggagcctcacgcatgctcttctccacctcagtgatgacg
agagcggggcgggtgaggggcgggaaccagcgatctctgggttctacgttagtgggagtttaacgacggtccct
gggattcccaaggcaggggcgagtcctttgtatgaattactctcagctccggtcggggcgggttgggggggtg
gtgacggggaggccgcctggaagggacgtgcagaatcttccctctaccattgctggcttagctccaaaggttgtatt
gagattagggtgcacttcgcctctcaatcagcctcccgtcctcagcctgccatctcgctagtccgggacaaatccct
agagcgtcttcctctgcgggtctcagcccagcccgggttggctcctcctccgccccgcttccgcgccctcccg
tgtggcaaggagtaccaggcccgggaccccgaggggcttgggcgaagggtcgggactggggccttccttaa
cggctcacggacttgcgagaggttcggctcgatggccgtgaaagcgacgaatccgctcctgtgctggcctcttggc
tccttccattcaaagccagctgcttttatggaagcccgtaacagtctcccccctggtactccagatgtccagggctttt
cagtttagaatagactcagtcctacagttagctttagatctaattctagttttgttacgccaaaagttcctgcgagtgtgt
gtgtgcctcatggtacttttttaaattaaaaggtgtacagttatttgattgcaaacataaggaacctaaatgctttcag
atttttccacatgatctcatgtagaggctaagatctacagcatcagcaagtttatccaccccagtttcctaaccccaacact
tgctatgaagtcacagcttctcctatttaaatagtgcctattatattttaaataagtgctgtcgttttctgtcatcctatcgatt
gtaactgcattttagcataaatctagggcaagttggagcttggccttttttggatgctgcatcaaggcaggccttgg
gaaatgctcctcgagggaaagaagaacgttatttttaatgagctaattactagatcattatgtgttcttcttccagctgtag
aatatcattgcccagcttctcgaacaaacttatttattaacaagtatttgagaacctactatgtggccaacgctaagtgac
ctgcaggcatgcaagcttggcgtaatcatggtcatagctgtttcctgtgtgaaattgttatccgctcacaattccacaca
acatacgagccggaagcataaagtgtaaagcctggggtgcctaatgagtgagctaactcacattaattgcgttgcgct
cactgcccgctttccagtcgggaaacctgtcgtgccagctgcattaatgaatcggccaacgcgcggggagaggcggtt
tgcgtattgggcgctcttccgcttcctcgctcactgactcgctgcgctcggtcgttcggctgcggcgagcggtatcagct
cactcaaaggcggtaatacggttatccacagaatcaggggataacgcaggaaagaacatgtgagcaaaaggccag
caaaaggccaggaaccgtaaaaaggccgcgttgctggcgtttttccataggctccgcccccctgacgagcatcaca
aaaatcgacgctcaagtcagaggtggcgaaacccgacaggactataaagataccaggcgtttccccctggaagct
ccctcgtgcgctctcctgttccgaccctgccgcttaccggatacctgtccgcctttctcccttcgggaagcgtggcgctt
tctcatagctcacgctgtaggtatctcagttcggtgtaggtcgttcgctccaagctgggctgtgtgcacgaaccccccg
ttcagcccgaccgctgcgccttatccggtaactatcgtcttgagtccaacccggtaagacacgacttatcgccactgg
cagcagccactggtaacaggattagcagagcgaggtatgtaggcggtgctacagagttcttgaagtggtggcctaa
ctacggctacactagaagaacagtatttggtatctgcgctctgctgaagccagttaccttcggaaaaagagttggta
gctcttgatccggcaaacaaaccaccgctggtagcggtggtttttttgtttgcaagcagcagattacgcgcagaaaaa
aaggatctcaagaagatcctttgatcttttctacggggtctgacgctcagtggaacgaaaactcacgttaagggattt
tggtcatgagattatcaaaaaggatcttcacctagatccttttaaattaaaaatgaagttttaaatcaatctaaagtatata
tgagtaaacttggtctgacagttaccaatgcttaatcagtgaggcacctatctcagcgatctgtctatttcgttcatccat
agttgcctgactccccgtcgtgtagataactacgatacgggagggcttaccatctggccccagtgctgcaatgatac
cgcgagacccacgctcaccggctccagatttatcagcaataaaccagccagccggaagggccgagcgcagaag
tggtcctgcaactttatccgcctccatccagtctattaattgttgccgggaagctagagtaagtagttcgccagttaata
gtttgcgcaacgttgttgccattgctacaggcatcgtggtgtcacgctcgtcgtttggtatggcttcattcagctccggt
tcccaacgatcaaggcgagttacatgatcccccatgttgtgcaaaaaagcggttagctccttcggtcctccgatcgt
tgtcagaagtaagttggccgcagtgttatcactcatggttatggcagcactgcataattctcttactgtcatgccatccg
taagatgcttttctgtgactggtgagtactcaaccaagtcattctgagaatagtgtatgcggcgaccgagttgctcttg
cccggcgtcaatacgggataataccgcgccacatagcagaactttaaaagtgctcatcattggaaaacgttcttcggg
gcgaaaactctcaaggatcttaccgctgttgagatccagttcgatgtaacccactcgtgcacccaactgatcttcagc
atcttttactttcaccagcgtttctgggtgagcaaaaacaggaaggcaaaatgccgcaaaaaagggaataagggcg
acacggaaatgttgaatactcatactcttcctttttcaatattattgaagcatttatcagggttattgtctcatgagcggata
catatttgaatgtatttagaaaaataaacaaataggggttccgcgcacatttccccgaaaagtgccacctgacgtctaa
gaaaccattattatcatgacattaacctataaaaataggcgtatcacgaggccctttcgtctcgcgcgtttcggtgatg
acggtgaaaacctctgacacatgcagctcccggagacggtcacagcttgtctgtaagcggatgccgggagcagac (Note: The final portion of the table exceeds the visible content. The above reflects the sequence as transcribed from the visible portion of the page.)

TABLE 13-continued

| SEQ ID | Construct | Sequence 5'-3' |
|---|---|---|
| | | tggcctcgcacacattccacatccaccggtaggcgccaaccggctccgttctttggtggccccttcgcgccaccttct<br>actcctcccctagtcaggaagttccccccccgccccgcagctcgcgtcgtgcaggacgtgacaaatggaagtagca<br>cgtctcactagtctcgtgcagatggacagcaccgctgagcaatggaagcgggtaggccttggggcagcggccaa<br>tagcagctttggctccttcgctttctgggctcagaggctgggaaggggtgggtccgggggcgggctcaggggcgg<br>gctcaggggcggggcgggcgcccgaaggtcctccggaggcccggcattctgcacgcttcaaaagcgcacgtct<br>gccgcgctgttctcctcttcctcatctccgggccttttcgacctgcatccatctagatctcgagcagctgaagcttaccat<br>gaccgagtacaagcccacggtgcgcctcgccaccccgcgacgacgtccccagggccgtacgcaccctcgccgcc<br>gcgttcgccgactaccccgcacgcgccacaccgtcgatccagaccgccacatcgagcgggtcaccgagctgca<br>agaactcttcctcacgcgcgtcgggctcgacatcggcaaggtgtgggtcgcggacgacggcgcagcagtggcg<br>gtctggaccacgccggagagcgtcgaagcgggggcggtgttcgccgagatcggcccgcgcatggccgagttga<br>gcggttcccggctggccgcgcagcaacagatggaaggcctcctggccgccgcaccggcccaaggagcccgcgt<br>ggttcctggccaccgtcggcgtctcgcccgaccaccagggcaagggtctgggcagcgccgtcgtgctcccgga<br>gtggaggcggccgagcgcgccggggtgcccgccttcctggagacctccgcgccccgcaacctcccccttctacga<br>gcggctcggcttcaccgtcaccgccgcatcgaggtgcccgaaggaccgcacttggtgcatgacccgcaagc<br>ccggtgcctgacgcccgcccacaagacccgcagcgcccgaccgaaaggagcgcacgaccccatgcatcgatg<br>atctagagctcgctgatcagcctcgactgtgccttctagttgccagccatctgttgtttgcccctcccccgtgccttcctt<br>gaccctggaaggtgccactcccactgtcctttcctaataaaatgaggaaattgcatcgcattgtctgagtaggtgtcat<br>tctattctggggggtggggtggggcaggacagcaagggggaggattgggagacaataagcaggcatgctgggg<br>atgcggtgggctctatggcttctgaggcggaagttcctattctctagaaagtataggaacttctcgagtctagaagatg<br>ggcgggagtcttctgggcaggcttaaaggctaacctggtgtgtgggcgttgtcctgcaggggaattgaacaggtga<br>ttaccctgttatccctagtaatcccgggatctaatacgactcactatagggagaccatcattttctggaattttccaagct<br>gtttaaaggcacagtcaacttagtgtatgtaaacttctgacccactcggaattgtgatacagtgaattataagtgaaataa<br>tctgtctgtaaacaattgttggaaaaatgacttgtgtcatgcacaaagtagatgtcctaactgacttgtgccaaaactattgt<br>ttgttaacaagaaatttgtggagtagttgaaaaacgagttttaatgactccaacttaagtgtatgtaaacttccgacttca<br>actgtatagggatcccccggctgcaggaattcgataaaagttttgttacttttatagaagaaattttgagttttttgattttttttt<br>taataaataaataaacataaaataaattgtttgttgaatttattattagtatgtaagtgtaaatataataaaacttaatatctatt<br>caaattaatataaaacctcgatatacagaccgataaaacacatgcgtcaatttacgcatgattatctttaacgtacgtc<br>acaatatgattatctttctagggttaatctagctgcgtgttctgcagcgtgtcgagcatcttcatctgctccatcacgctgt<br>aaaacacatttgcaccgcgagtctgcccgtcctccacgggttcaaaaacgtgaatgaacgaggcgcgctcactggc<br>cgtcgttttacaacgtcgtgactgggaaaaccctggcgttacccaacttaatcgccttgcagcacatcccccttcgcc<br>agctggcgtaatagcgaagaggcccgcaccgatcgcccttcccaacagttgcgcagcctgaatggcgaatggga<br>cgcgccctgtagcggcgcattaagcgcggcgggtgtggtggttacggcgcagcgtgaccgctacacttgccagcg<br>ccctagcgcccgctcctttcgctttcttcccttccttctcgccacgttcgccggctttccccgtcaagctctaaatcggg<br>ggctcccttttagggttccgatttagtgattacggcacctcgaccccaaaaaacttgattagggtgatggttcacgtag<br>tgggccatcgccctgatagacggtttttcgccctttgacgttggagtccacgttctttaatagtggactcttgttccaaac<br>tggaacaacactcaaccctatctcggtctattatttgatttataagggattttgccgatttcggcctattggttaaaaaat<br>gagctgatttaacaaaaatttaacgcgaattttaacaaaatattaacgcttacaatttag |
| 175 | AMVlarge pcDNA Dest40 | gacggatcgggagatctcccgatccccatggtgcactctcagtacaatctgctctgatgccgcatagttaagccagt<br>atctgctccctgcttgtgtgttggaggtcgctgagtagtgcgcgagcaaaatttaagctacaacaaggcaaggcttga<br>ccgacaattgcatgaagaatctgcttagggttaggcgttttgcgctgcttcgcgatgtacgggccagatatacgcgtt<br>gacattgattattgactagttattaatagtaatcaattacggggtcattagttcatagcccatatatggagttccgcgttac<br>ataacttacggtaaatggcccgcctggctgaccgcccaacgacccccgcccattgacgtcaataatgacgtatgttc<br>ccatagtaacgccaatagggactttccattgacgtcaatgggtggagtatttacggtaaactgcccacttggcagtac<br>atcaagtgtatcatatgccaagtacgccccctattgacgtcaatgacggtaaatggcccgcctggcattatgcccagt<br>acatgaccttatgggactttcctacttggcagtacatctacgtattagtcatcgctattaccatggtgatgcggttttggc<br>agtacatcaatgggcgtggatagcggtttgactcacggggatttccaagtctccaccccattgacgtcaatgggagtt<br>tgttttggcaccaaaatcaacgggactttccaaaatgtcgtaacaactccgccccattgacgcaaatgggcggtagg<br>cgtgtacggtgggaggtctatataagcagagctctctggctaactagagaacccactgcttactggcttatcgaaatt<br>aatacgactcactatagggagacccaagctggctagttaagctatcaacaagtttgtacaaaaaagctgaacgagaa<br>acgtaaaatgatataaatcaatatattaaattagattttgataaaaaacagactacataatactgtaaaacacaacat<br>atccagtcactatggctgccaccatggactacaaagacgatgacgacaagagcagggcgtgaccccaagaagaag<br>aggaaggtgactgtcgctctgcacctggcaatacctcttaaatggaaacctaatcacactccagtttggatcgatcaat<br>ggccacttcctgagggcaagttggtggcattgactcagttggtagagaaagaactccaacttgggcacatcgaacc<br>gtccctgtcctgaggaacaccccagtattcgtcataaggaaagcctccggaagttaccgcttgcttcatgacctgag<br>ggcggtgaatgcaaagcttgtacctttttggccgccgtccagcaaggacctccagtcttgagtgccttgccacgggga<br>tggccgcttatggttctcgatttgaaggactgcattttttcagcattccgcttgcggaacaggactgagaggctttcgcctt<br>tacgctgcccagcgtcaacaaccaggccccggctagacgcttccaatggaaagtcctccctcagggtatgacctgt<br>tcacctacaaatttgtcaacttattgttggtcaaatcctggaaccgcttagattgaagcatccgtcccttagaatgctgcat<br>tatatgacgacctgctttctcgcagcgagtttctcacgacgggttggaggctgccggagaagaagttattagcaccct<br>tgaacgagcagggttcaccattttcaccggataaggtacagcgggaacccggctacagtacttgggctacaagctc<br>ggttcaacatacgttggccccccgtaggactggttgccgagccaaggattgcaactattgggatgtacaaaaactcgtt<br>ggttcacttcagtggttgaggcccgctacggcattccgccgagacttatgggccattctatgagcagcttagagga<br>tctgacccgaacgaagcacgagaatggaacctggacatgaaaatggcctggcgagatgcgtacagctctcaacg<br>acggtgctcttgaacgtgggaccccgcccttcccctcgaaggggtcgtggcacgctgtgaacaaggagctata<br>ggggtcctcggtcagggactttccacccatccccgcccatgtctttggctttttttcaactcaacccaccaaagcatttac<br>agcgtggctggaggtacttacccttacattaccaaattgcgagcgtccgcggtccgaacttttcgggaaagaagtag<br>atatattgttgctgccagcctgttttagagaagatttgccccttccagaagggattcttcttgccttgagaggtttcgcag<br>gtaagattagaagtagcgacacaccgtccatcttcgacatcgcgcgccgctccacgtgagcctgaaggttagagt<br>caccgaccatcccgttccggtcccacagttttaccgatgcatcagtagtacccacaaaggagtagtagtctggcg<br>cgagggacctcgatgggaaataaaggagatcgcagatttggggctagtgttcagcagttggaagcacgcgccgt<br>ggcctgtatctcctgtggcccacgacaccaactaatgttgtaacgactcagctttgtactgactaaaatgcctctg<br>aaaatgggccaggaaggggtcccatccactgcagctgcatttatccttgaagcagcactcagccaaaggtcagcaa<br>tggctgcggtgctccatgtgcggtcccattccgaagtacctggtactttacagaggggaatgatgtcgccgactctc<br>aagcaaccttccaggcgtatcctcttagggaagctaaagacctccatacagctcttcatataggtccgagagctctga<br>gcaaggcgtgtaatattagcatgcagcaagctagggaggtcgtccagacatgtccacactgtaactccgcacctgc<br>cctcgaggcagggtaaatccgcgagggttgggccgctccagatctggcaaactgatttcacgttggaaccaag |

TABLE 13-continued

| SEQ ID | Construct | Sequence 5'-3' |
|---|---|---|
| | | gatggctccgcggagttggctggcagtaaccgtagacacagcgtcttctgcaattgttgtaactcagcatggccgcg<br>tgactagcgtggccgcgcagcatcactgggcaacggctatagcggtcctcggacgacctaaagcaataaagacg<br>gacaatggcagttgttttacttcaaaatcaaccagagagtggctcgctaggtggggcatagcacacacgactggaat<br>ccccggtaatagccaagggcaggctatggtagagagagcaaatcgactgctcaaagataagatccgggtccttgct<br>gaaggggacggctttatgaagcggataccaactagtaaacagggagaacttcttgcaaaggccatgtacgcgctca<br>atcattttgaacgagggggaaaatactaaaaccccgatccaaaaacactggcgacctaccgtgttgacggagggacc<br>tccagtaaaaatcaggattgagacgggcgagtgggaaaaaggttggaacgtgctggtctgggggcgagggtatg<br>ctgcagtaaaaaacagagacactgacaaagtaatatggttccatctcgcaaggttaaaccggacatcgctcaaaa<br>ggatgaagtgacaaaaaaagacgaagcgtcaccactattgcataatgaacccatagtgactggatatgttgtgttta<br>cagtattatgtagtctgttttttatgcaaaatctaatttaatatattgatatttatatcattttacgtttctcgttcagcttttcttg<br>tacaaagtggttgatctagagggcccgcggttcgaaggtaagcctatccctaaccctctcctcggtctcgattctacgcg<br>taccggtcatcatcaccatcaccattgagtttaaacccgctgatcagcctcgactgtgccttctagttgccagccatctg<br>ttgtttgcccctcccccgtgccttccttgaccctggaaggtgccactcccactgtcctttcctaataaaatgaggaaatt<br>gcatcgcattgtctgagtaggtgtcattctattctggggggtggggtggggcaggacagcaaggggaggattgg<br>gaagacaatagcaggcatgctggggatgcggtgggctctatggcttctgaggcggaaagaaccagctggggctct<br>agggggtatccccacgcgccctgtagcggcgcattaagcgcggcgggtgtggtggttacgcgcagcgtgaccgc<br>tacacttgccagcgccctagcgcccgctcctttcgctttcttcccttcctttctcgccacgttcgccggctttccccgtca<br>agctctaaatcgggggctccctttagggttccgatttagtgctttacggcacctcgaccccaaaaaacttgattagggt<br>gatggttcacgtagtgggccatcgccctgatagacggtttttcgccctttgacgttggagtccacgttctttaatagtgg<br>actcttgttccaaactggaacaacactcaaccctatctcggtctattcttttgatttataagggattttgccgatttcggcct<br>attggttaaaaaatgagctgatttaacaaaaatttaacgcgaattaattctgtggaatgtgtgtcagttagggtgtgaa<br>agtcccaggctcccagcaggcagaagtatgcaaagcatgcatctcaattagtcagcaaccaggtggaaagtc<br>cccaggctccccaggcagaagtatgcaaagcatgcatctcaattagtcagcaaccatagtcccgcccctaact<br>ccgcccatcccgcccctaactccgcccagttccgcccattctccgccccatggctgactaattttttttatttatgcaga<br>ggccgaggccgcctctgcctctgagctattccagaagtagtgaggaggcttttttggaggcctaggcttttgcaaaa<br>agctcccgggagctgtatatccattttcggatctgatcaagagacaggatgaggatcgtttcgcatgattgaacaag<br>atggattgcacgcaggttctccggccgcttgggtggagaggctattcggctatgactgggcacaacagacaatcgg<br>ctgctctgatgccgccgtgttccggctgtcagcgcaggggcgcccggttcttttttgtcaagaccgacctgtccggtg<br>ccctgaatgaactgcaggacgaggcagcgcggctatcgtggctggccacgacgggcgttccttgcgcagctgtg<br>ctcgacgttgtcactgaagcgggaagggactggctgctattgggcgaagtgccggggcaggatctcctgtcatctc<br>accttgctcctgccgagaaagtatccatcatggctgatgcaatgcggcggctgcatacgcttgatccggctacctgc<br>ccattcgaccaccaagcgaaacatcgcatcgagcgagcacgtactcggatggaagccggtcttgtcgatcaggat<br>gatctggacgaagagcatcaggggctcgcgccagccgaactgttcgccaggctcaaggcgcgcatgcccgacg<br>gcgaggatctcgtcgtgacccatggcgatgcctgcttgccgaatatcatggtggaaaatggccgcttttctggattca<br>tcgactgtggccgctgggtgtggcggaccgctatcaggacatagcgttggctacccgtgatattgctgaagagctt<br>ggcggcgaatgggctgaccgcttcctcgtgctttacggtatcgccgctcccgattcgcagcgcatcgccttctatcg<br>ccttcttgacgagttcttctgagcgggactctggggttcgcgaaatgaccgaccaagcgacgcccaacctgccatca<br>cgagatttcgattccaccgccgccttctatgaaaggttgggcttcggaatcgttttccgggacgccggctggatgatc<br>ctccagcgcggggatctcatgctggagttatcgcccaccccaacttgtttattgcagcttataatggttacaaataaag<br>caatagcatcacaaatttcacaaataaagcatttttttcactgcattctagttgtggtttgtccaaactcatcaatgtatctta<br>tcatgtctgtataccgtcgacctctagctagagcttggcgtaatcatggtcatagctgtttcctgtgtgaaattgttatcc<br>gctcacaattccacacaacatacgagccggaagcataaagtgtaaagcctggggtgcctaatgagtgagctaactc<br>acattaattgcgttgcgctcactgcccgctttccagtcgggaaacctgtcgtgccagctgcattaatgaatcggccaa<br>cgcgcggggagaggcggtttgcgtattgggcgctcttccgcttcctcgctcactgactcgctgcgctcggtcgttcg<br>gctgcggcgagcggtatcagctcactcaaaggcggtaatacggttatccacagaatcaggggataacgcaggaaa<br>gaacatgtgagcaaaaggccagcaaaaggccaggaaccgtaaaaaggccgcgttgctggcgtttttccataggct<br>ccgcccccctgacgagcatcacaaaaatcgacgctcaagtcagaggtggcgaaacccgacaggactataaagat<br>accaggcgtttccccctggaagctccctcgtgcgctctcctgttccgaccctgccgcttaccggatacctgtccgcct<br>ttctcccttcgggaagcgtggcgctttctcatagctcacgctgtaggtatctcagttcggtgtaggtcgttcgctccaag<br>ctgggctgtgtgcacgaaccccccgttcagcccgaccgctgcgccttatccggtaactatcgtcttgagtccaaccc<br>ggtaagacacgacttatcgccactggcagcagccactggtaacaggattagcagagcgaggtatgtaggcggtgc<br>tacagagttcttgaagtggtggcctaactacggctacactagaagaacagtatttggtatctgcgctctgctgaagcc<br>agttaccttcggaaaaagagttggtagctcttgatccggcaaacaaaccaccgctggtagcggtggtttttttgtttgc<br>aagcagcagattacgcgcagaaaaaaaggatctcaagaagatcctttgatcttttctacggggtctgacgctcagtg<br>gaacgaaaactcacgttaagggattttggtcatgagattatcaaaaaggatcttcacctagatccttttaaattaaaaat<br>gaagttttaaatcaatctaaagtatatatgagtaaacttggtctgacagttaccaatgcttaatcagtgaggcacctatct<br>cagcgatctgtctatttcgttcatccatagttgcctgactccccgtcgtgtagataactacgatacgggagggcttacc<br>atctggccccagtgctgcaatgataccgcgagacccacgctcaccggctccagatttatcagcaataaaccagcca<br>gccggaagggccgagcgcagaagtggtcctgcaactttatccgcctccatccagtctattaattgttgccgggaagc<br>tagagtaagtagttcgccagttaatagtttgcgcaacgttgttgccattgctacaggcatcgtggtgtcacgctcgt<br>cgtttggtatggcttcattcagctccggttcccaacgatcaaggcgagttacatgatcccccatgttgtgcaaaaaagcggt<br>tagctccttcggtcctccgatcgttgtcagaagtaagttggccgcagtgttatcactcatggttatggcagcactgcat<br>aattctcttactgtcatgccatccgtaagatgcttttctgtgactggtgagtactcaaccaagtcattctgagaatagtgt<br>atgcggcgaccgagttgctcttgcccggcgtcaatacgggataataccgcgccacatagcagaactttaaaagtgct<br>catcattggaaaacgttcttcggggcgaaaactctcaaggatcttaccgctgttgagatccagttcgatgtaacccact<br>cgtgcacccaactgatcttcagcatcttttactttcaccagcgtttctgggtgagcaaaaacaggaaggcaaaatgcc<br>gcaaaaaagggaataagggcgacacggaaatgttgaatactcatactcttcctttttcaatattattgaagcatttatca<br>gggttattgtctcatgagcggatacatatttgaatgtatttagaaaaataaacaaatagggggttccgcgcacatttcccc<br>gaaaagtgccacctgacgtc |
| 176 | AMVsmall pcDNA Dest40 | gacggatcgggagatctcccgatccctatggtgcactctcagtacaatctgctctgatgccgcatagttaagccagt<br>atctgcctcctgtgtgttggaggtcgctgagtagtgcgcgagcaaaatttagctacaacaaggcaaggcttga<br>ccgacaattgcatgaagaatctgctagggttaggcgttttgcgctgcttcgcgatgtacgggccagatatgcgtt<br>gacattgattattgactagttattaatagtaatcaattacggggtcattagttcatagcccatatatggagttccgcgttac<br>ataacttacggtaaatggcccgcctggctgaccgcccaacgacccccgcccattgacgtcaataatgacgtatgttc<br>ccatagtaacgccaatagggactttccattgacgtcaatgggtggagtatttacggtaaactgcccacttggcagtac<br>atcaagtgtatcatatgccaagtacgccccctattgacgtcaatgacggtaaatggcccgcctggcattatgcccagt |

TABLE 13-continued

| SEQ ID | Construct | Sequence 5'-3' |
|---|---|---|
| | | acatgacccttatgggactttcctacttggcagtacatctacgtattagtcatcgctattaccatggtgatgcggttttggc
agtacatcaatgggcgtggatagcggtttgactcacggggatttccaagtctccaccccattgacgtcaatgggagtt
tgttttggcaccaaaatcaacgggactttccaaaatgtcgtaacaactccgccccattgacgcaaatgggcggtagg
cgtgtacggtgggaggtctatataagcagagactctggctaactagagaacccactgcttactggcttatcgaaatt
aatacgactcactatagggagacccaagctggctagttaagctatcaacaagtttgtacaaaaaagctgaacgagaa
acgtaaaatgatataaatatcaatatattaaattagattttgcataaaaaacagactactataactgtaaaacaacat
atccagtcactatggctgccaccatggactacaaagacgatgacgacaagagcagggctgaccccaagaagaag
aggaaggtgactgttgcgctccatcttgcgataccgttgaagtggaaaccgaatcacactcctgtgtggatcgacca
gtggccactcccagaagggaaactggtagcgttgacacaacttgtcgaaaaggagcttcaacttggccatatagaa
cctagtagtcctgttggaacactcctgtgtttgtcatcaggaaggcctccgggagttatcgcctgttgcacgaccttcg
agctgttaatgcaaaactcgtacccttggcgcggtgcaacaaggggctccagttttgagtgcattgcctcggggggt
ggccgcttatggtcttggatctgaaggattgctttttttagtatacctctggcagagcaggatagagaggcctttgccttc
acgcttccttcagtgaacaaccaggctccggccaggcggtttcaatgaaggttttgcccaagggatgacttgctc
cccgacgatatgtcaactgatcgtgggccagatactggaaccactccgattgaagcaccttctttgcgcatgctcca
ttacatggatgacctcttgttggcggccagctcccatgacggtctggaggcggcgggtgaagaagtgataagcacc
ctggaacgagcgggattcacaatcagcccggacaaagtgcaaagagagcccggagtccaatatctgggctacaa
gttgggttccacatacgtcgccctgtaggcctggtagcggaaccgcgcattgccacgttgtgggatgtgcaaaaa
ctcgttggatctctccaatggtttgcgcccggcactggttatcccacccagactgatgggtccattctatgaacaactg
aggggctctgacccgaatgaggcgcgggaatgaatttggacatgaagatggcgtggcgcgaaatagtccaactt
tcaacaacgcggctcttgaacgctgggatcctgccttgccgcttgaaggcgcagtagccaggtgcgagcaggg
ggcgataggagtgttgggacaaggtctcagcacacacccgaggccgtgcctgtggttgttcagtactcaacctacg
aaggctttttacagcatggctggaagtcctcaccttgttgattacaaaactcagagcatctgccgtcaggaccttcggc
aaggaagtagatatccttcttctgccccgcctgcttccgcgaagaccttccactgccagagggaatactgcttgcattg
agggttttgccggtaagatccggtccagcgatactccgagcatatttgcatcgctagaccttcacgtctcactca
aggttcgcgtgactgaccacccagttccgggacccaccgtattcaccgatgccagtagtagcactcataaaggggt
agtcgtctggcgggaaggacctcgctgggagataaaggaaatagcagacttgggtgccagcgtgcaacaactgg
aggcccgggcgtcgcgatggcactccttttgtggccaaccaccccgacgaacgtagttacagattcagctttcgta
gccaaaatgttgttgaaaatgggtcaggaaggtgtcccttccactgccgcagcattcatattggaggatgccctgagt
caaagaagtgcaatggccgcagttcttcacgtgcgatcccatagcgaagtacctggcttttttactgagggcaatgat
gtggctgactcacaggctacatttcaggcttattaatgaaccatagtgactggatatgttgtgttttacagtattatgta
gtctgtttttatgcaaaactcaattaatatattgatatttatatcattttacgtttctcgttcagctttctcttgtacaaagtggttg
atctagagggcccgcggttcgaaggtaagcctatccctaaccctctcctcggtctcgattctacgcgtaccggtcatc
atcaccatcaccattgagttaaacccgctgatcagcctcgactgtgccttctagttgccagccatctgttgtttgcccct
cccccgtgccttccttgaccctggaaggtgccactcccactgtccttcctaataaaatgaggaaattgcatcgcattg
tctgagtaggtgtcattctattctggggggtggggtggggcaggacagcaaggggaggattgggaagacaatag
caggcatgctggggatgcggtgggctctatggcttctgaggcggaaagaaccagctggggctctaggggtatcc
ccacgcgccctgtagcggcgcattaagcgcggcgggtgtggtggttacgcgcagcgtgaccgctacacttgcca
gcgccctagcgcccgctcctttcgctttcttcccttcctttctcgccacgttcgccggctttccccgtcaagctctaaatc
gggggctcccttttagggttccgatttagtgctttacggcacctcgaccccaaaaaacttgattagggtgatggttcac
gtagtgggccatcgccctgatagacggtttttcgccctttgacgttggagtccacgttctttaatagtggactcttgttcc
aaactggaacaacactcaaccctatctcggtctattcttttgatttataagggattttgccgatttcggcctattggttaaa
aaatgagctgatttaacaaaaatttaacgcgaattaattctgtggaatgtgtgtcagttagggtgtggaaagtccccag
gctcccccagcaggcagaagtatgcaaagcatgcatctcaattagtcagcaaccaggtgtggaaagtccccaggctc
cccagcaggcagaagtatgcaaagcatgcatctcaattagtcagcaaccatagtcccgcccctaactccgcccatc
ccgcccctaactccgcccagttccgcccattctccgccccatggctgactaatttttttatttatgcagaggccgagg
ccgcctctgcctctgagctattccagaagtagtgaggaggcttttttggaggcctaggcttttgcaaaaagctcccgg
gagcttgtatatccattttcggatctgatcaagagacaggatgaggatcgtttcgcatgattgaacaagatggattgca
cgcaggttctccggccgcttgggtggagaggctattcggctatgactgggcacaacagacaatcggctgctctgat
gccgccgtgaccggctgtcagcgcaggggcgcccggttctttttgtcaagaccgacctgtccggtgccctgaatga
actgcaggacgaggcagcgcggctatcgtggctggccacgacgggcgttccttgcgcagctgtgctcgacgttgt
cactgaagcgggaagggactggctgctattgggcgaagtgccggggcaggatctcctgtcatctcaccttgctcct
gccgagaaagtatccatcatggctgatgcaatgcggcggctgcatacgcttgatccggctacctgcccattcgacca
ccaagcgaaacatcgcatcgagcgagcacgtactcggatggaagccggtcttgtcgatcaggatgatctggacga
agagcatcaggggctcgcgccagccgaactgttcgccaggctcaaggcgcgcatgcccgacggcgaggatctc
gtcgtgacccatggcgatgcctgcttgccgaatatcatggtggaaaatggccgcttttctggattcatcgactgtggc
cggctgggtgtggcggaccgctatcaggacatagcgttggctacccgtgatattgctgaagagcttggcggcgaat
gggctgaccgcttcctcgtgctttacggtatcgccgctcccgattcgcagcgcatcgccttctatcgccttcttgacga
gttcttctgagcgggactctggggttcgcgaaatgaccgaccaagcgacgcccaacctgccatcacgagatttcga
ttccaccgccgccttctatgaaaggttgggcttcggaatcgttttccgggacgccggctggatgatcctccagcgcg
gggatctcatgctggagttcttcgcccaccccaacttgtttattgcagcttataatggttacaaataaagcaatagcatc
acaaatttcacaaataaagcattttttttcactgcattctagttgtggtttgtccaaactcatcaatgtatcttatcatgtctgta
taccgtcgacctctagctagagcttggcgtaatcatggtcatagctgtttcctgtgtgaaattgttatccgctcacaattc
cacacaacatacgagccggaagcataaagtgtaaagcctggggtgcctaatgagtgagctaactcacattaattgc
gttgcgctcactgcccgctttccagtcgggaaacctgtcgtgccagctgcattaatgaatcggccaacgcgcgggg
agaggcggtttgcgtattgggcgctcttccgcttcctcgctcactgactcgctgcgctcggtcgttcggctgcggcga
gcggtatcagctcactcaaaggcggtaatacggttatccacagaatcaggggataacgcaggaaagaacatgtga
gcaaaaggccagcaaaaggccaggaaccgtaaaaaggccgcgttgctggcgtttttccataggctccgcccccct
gacgagcatcacaaaaatcgacgctcaagtcagaggtggcgaaacccgacaggactataaagataccaggcgttt
ccccctggaagctccctcgtgcgctctcctgttccgaccctgccgcttaccggatacctgtccgcctttctcccttcgg
gaagcgtggcgctttctcatagctcacgctgtaggtatctcagttcggtgtaggtcgttcgctccaagctgggctgtgt
gcacgaacccccgttcagcccgaccgctgcgccttatccggtaactatcgtcttgagtccaacccggtaagacac
gacttatcgccactggcagcagccactggtaacaggattagcagagcgaggtatgtaggcggtgctacagagttct
tgaagtggtggcctaactacggctacactagaagaacagtatttggtatctgcgctctgctgaagccagttaccttcg
gaaaaagagttggtagctcttgatccggcaaacaaaccaccgctggtagcggtggtttttttgtttgcaagcagcaga
ttacgcgcagaaaaaaaggatctcaagaagatcctttgatcttttctacggggtctgacgctcagtggaacgaaaact
cacgttaagggattttggtcatgagattatcaaaaaggatcttcacctagatccttttaaattaaaaatgaagttttaaatc
aatctaaagtatatatgagtaaacttggtctgacagttaccaatgcttaatcagtgaggcacctatctcagcgatctgtct |

TABLE 13-continued

| SEQ ID | Construct | Sequence 5'-3' |
|---|---|---|
| | | atttcgttcatccatagttgcctgactcccgtcgtgtagataactacgatacgggagggcttaccatctggccccagt gctgcaatgataccgcgagacccacgctcaccggctccagatttatcagcaataaaccagccagccggaagggcc gagcgcagaagtggtcctgcaactttatccgcctccatccagtctattaattgttgccgggaagctagagtaagtagtt cgccagttaatagtttgcgcaacgttgttgccattgctacaggcatcgtggtgtcacgctcgtcgtttggtatggcttca ttcagctccggttcccaacgatcaaggcgagttacatgatcccccatgttgtgcaaaaaagcggttagctccttcggt cctccgatcgttgtcagaagtaagttggccgcagtgttatcactcatggttatggcagcactgcataattctcttactgt catgccatccgtaagatgcttttctgtgactgtgagtactcaaccaagtcattctgagaatagtgtatgcggcgaccg agttgctcttgcccggcgtcaatacgggataataccgcgccacatagcagaactttaaaagtgctcatcattggaaaa cgttcttcggggcgaaaactctcaaggatcttaccgctgttgagatccagttcgatgtaacccactcgtgcacccaac tgatcttcagcatcttttactttcaccagcgtttctgggtgagcaaaaacaggaaggcaaaatgccgcaaaaaaggga taagggcgacacggaaatgttgaatactcatactcttcctttttcaatattattgaagcatttatcagggttattgtctcat gagcggatacatatttgaatgtatttagaaaaataaacaaataggggttccgcgcacatttccccgaaaagtgccacc tgacgtc |
| 177 | HIVp51 pcDNA Dest40 | gacggatcggagatctcccgatcccctatggtgcactctcagtacaatctgctctgatgccgcatagttaagccagt atctgctccctgcttgtgtgttggaggtcgctgagtagtgcgcgagcaaaatttaagctacaacaaggcaaggcttga ccgacaattgcatgaagaatctgcttagggttaggcgttttgcgctgatcgcgatgtacgggccagatatacgcgtt gacattgattattgactagttattaatagtaatcaattacggggtcattagttcatagcccatatatggagttccgcgttac ataacttacggtaaatggcccgcctggctgaccgcccaacgacccccgcccattgacgtcaataatgacgtatgttc ccatagtaacgccaataggactttccattgacgtcaatgggtggagtatttacggtaaactgcccacttggcagtac atcaagtgtatcatatgccaagtacgccccctattgacgtcaatgacggtaaatggcccgcctggcattatgcccagt acatgaccttatgggactttcctacttggcagtacatctacgtattagtcatcgctattaccatggtgatgcggttttggc agtacatcaatgggcgtggatagcggtttgactcacggggatttccaagtctccaccccattgacgtcaatgggagtt tgttttggcaccaaaatcaacgggactttccaaaatgtcgtaacaactccgccccattgacgcaaatgggcggtagg cgtgtacggtgggaggtctatataagcagagctctctggctaactagagaacccactgcttactggcttatcgaaatt aatacgactcactatagggagacccaagctggctagttaagcttcaacaagtttgtacaaaaaagctgaacgagaa acgtaaaatgatataaatatcaatatattaaattagattagcataaaaaacagactacataatactgtaaaacacaacat atccagtcactatggctgccaccatggactacaaagacgatgacgacaagagcagggctgaccccaagaagaag aggaaggtgccaatctcacccatcgaaacagtccccgtgaaactcaagccgggtatggatgggccgaaggttaag caatggcccttgactgaggaaaaaataaaggcgctcgtagagatatgcacggaaatggagaaggagggcaagat aagcaagattggcccagagaatccctaataatacccccgttttcgcgataagaagaaggactcaaccaaatggcgg aaacttgtagattttcgggaacttaataagcgaacccaagactctgggaggtccaacttggcattccgcatcccgcc ggtttgaaaagaagaaatcagttacggtgcttgacgttggcgacgcctattttagcgttcctcttgacgaggacttta gaaaatacacagccttcacaatacccaagtattaacaacgagacacccggaatccggtatcaatacaacgtgctcccc caaggatggaaagggtctccagcaattttttcagtctagcatgaccaaaaatcttggaacctttccgcaagcagaaccc ggatattgttatttatcagtatatggatgaccttatgtcggttcagatcttgaaattggtcagcaccgaacgaagataga ggaacttcgacagcacttgttgcgctggggtcttacaaccccagacaaaaacaccagaaggaaccaccttttcttt ggatgggttatgaacttcacccagataagtggaccgtgcagcccattgtcttgccggaaaaggactcctggacagta aatgatattcagaagctcgtaggaaaactgaatttgggcaaccagatacccaggtattaagtttaggcaattgtgc aaactttgtcggggcacgaaggcacttactgaggttataccactgactgaagaggcggagctgaactcgcagaga atagagaaatactcaaggaaccggtacatggcgtatactatgatccaagtaaggatttgattgcggagattcagaaa cagggtcagggacaatgacgtaccaaatttaccaagaacctttcaaaaatcttaagacgggaaagtatgcacgaat gcgcggcgcacatacgaatgatgtcaagcagttgactgaagcatacagaagattacaaccgatctcatcgttatat ggggaaagactcccaaatttaagctcccaatacaaaaagaaacttgggagaccctggtggaccgaatattggcagg cgacatggataccggagtggggaatttgttaacacaccgccgctggtaaagttgtggtatcagctcgaaaagagcc aattgtgggagcagagacgttctaatgaacccatagtgactggatatgttgtgttttacagtattatgtagtctgtttttat gcaaaatctaatatattgatatttatatcattttcacgtttctcgttcagctttcttgtacaaagtggttgatctagaggg cccgcggttcgaaggtaagcctatccctaaccctctcctcggtctcgattctacgcgtaccggtcatcatcaccatca ccattgagtttaaacccgctgatcagcctcgactgtgccttctagttgccagccatctgttgtttgcccctcccccgtgc cttccttgaccctggaaggtgccactcccactgtcctttcctaataaaatgaggaaattgcatcgcattgtctgagtagg tgtcattctattctggggggtggggtggggcaggacagcaaggggaggattgggaagacaatagcaggcatgc tggggatgcggtgggctctatggcttctgaggcggaaaagaaccagctggggctctagggggtatccccacgcgc cctgtagcggcgcattaagcgcggcgggtgtggtggttacgcgcagcgtgaccgctacacttgccagcgccctag cgcccgctcctttcgctttcttcccttcctttctcgccacgttcgccggctttccccgtcaagctctaaatcgggggctcc ctttagggttccgatttagtgctttacggcacctcgaccccaaaaaacttgattagggtgatggttcacgtagtgggcc atcgccctgatagacggtttttcgccctttgacgttggagtccacgttctttaatagtggactcttgttccaaactggaac aacactcaacccctatctcggtctattcttttgatttataagggattttgccgatttcggcctattggttaaaaaatgagctg atttaacaaaaatttaacgcgaattaattctgtggaatgtgtgtcagttagggtgtggaaagtccccaggctccccagc aggcagaagtatgcaaagcatgcatctcaattagtcagcaaccaggtgtggaaagtccccaggctccccagcagg cagaagtatgcaaagcatgcatctcaattagtcagcaaccatagtcccgcccctaactccgcccagttccgcccatt ctccgccccatggctgactaatttttttatttatgcagaggccgaggccgcctctgcc tctgagctattccagaagtagtgaggaggcttttttggaggcctaggcttttgcaaaaagctcccgggagcttgtatat ccattttcggatctgatcaagagacaggatgaggatcgtttcgcatgattgaacaagatggattgcacgcaggttctc cggccgcttgggtggagaggctattcggctatgactgggcacaacagacaatcggctgctctgatgccgccgtgtt ccggctgtcagcgcaggggcgcccggttctttttgtcaagaccgacctgtccggtgccctgaatgaactgcaggac gaggcagcgcggctatcgtggctggccacgacgggcgttccttgcgcagctgtgctcgacgttgtcactgaagcg ggaagggactggctgctattgggcgaagtgccggggcaggatctcctgtcatctcaccttgctcctgccgagaaag tatccatcatggctgatgcaatgcggcggctgcatacgcttgatccggctacctgcccattcgaccaccaagcgaaa catcgcatcgagcgagcacgtactcggatggaagccggtcttgtcgatcaggatgatctggacgaagagcatcag gggctcgcgccagccgaactgttcgccaggctcaaggcgcgcatgcccgacggcgaggatctcgtcgtgaccca tggcgatgcctgcttgccgaatatcatggtggaaaatggccgcttttctggattcatcgactgtggccggctgggtgt ggcggaccgctatcaggacatagcgttggctacccgtgatattgctgaagagcttggcggcgaatgggctgaccg cttcctcgtgctttacggtatcgccgctcccgattcgcagcgcatcgccttctatcgccttcttgacgagttcttctgagc gggactctggggttcgcgaaatgaccgaccaagcgacgcccaacctgccatcacgagatttcgattccaccgccg ccttctatgaaaggttgggcttcggaatcgttttccgggacgccggctggatgatcctccagcgcggggatctcatg ctggagttcttcgcccaccccaacttgtttattgcagcttataatggttacaaataaagcaatagcatcacaaatttcaca aataaagcatttttttcactgcattctagttgtggtttgtccaaactcatcaatgtatcttatcatgtctgtataccgtcgacc |

TABLE 13-continued

| SEQ ID | Construct | Sequence 5'-3' |
|---|---|---|
| | | tctagctagagcttggcgtaatcatggtcatagctgtttcctgtgtgaaattgttatccgctcacaattccacacaacata cgagccggaagcataaagtgtaaagcctggggtgcctaatgagtgagctaactcacattaattgcgttgcgctcact gcccgctttccagtcgggaaacctgtcgtgccagctgcattaatgaatcggccaacgcgcggggagaggcggttt gcgtattgggcgctcttccgcttcctcgctcactgactcgctgcgctcggtcgttcggctgcggcgagcggtatcag ctcactcaaaggcggtaatacggttatccacagaatcaggggataacgcaggaaagaacatgtgagcaaaaggcc agcaaaaggccaggaaccgtaaaaaggccgcgttgctggcgtttttccataggctccgcccccctgacgagcatc acaaaaatcgacgctcaagtcagaggtggcgaaacccgacaggactataaagataccaggcgtttccccctggaa gctccctcgtgcgctctcctgttccgaccctgccgcttaccggatacctgtccgcctttctcccttcgggaagcgtggc gctttctcatagctcacgctgtaggtatctcagttcggtgtaggtcgttcgctccaagctgggctgtgtgcacgaaccc cccgttcagcccgaccgctgcgccttatccggtaactatcgtcttgagtccaacccggtaagacacgacttatcgcc actggcagcagccactggtaacaggattagcagagcgaggtatgtaggcggtgctacagagttcttgaagtggtg gcctaactacggctacactagaagaacagtatttggtatctgcgctctgctgaagccagttaccttcggaaaaagagt tggtagctcttgatccggcaaacaaaccaccgctggtagcggtggtttttttgtttgcaagcagcagattacgcgcag aaaaaaaggatctcaagaagatcctttgatcttttctacggggtctgacgctcagtggaacgaaaactcacgttaagg gattttggtcatgagattatcaaaaaggatcttcacctagatccttttaaattaaaaatgaagttttaaatcaatctaaagta tatatgagtaaacttggtctgacagttaccaatgcttaatcagtgaggcacctatctcagcgatctgtctatttcgttcatc catagttgcctgactccccgtcgtgtagataactacgatacgggagggcttaccatctggccccagtgctgcaatgat accgcgagacccacgctcaccggctccagatttatcagcaataaaccagccagccggaagggccgagcgcaga agtggtcctgcaactttatccgcctccatccagtctattaattgttgccgggaagctagagtaagtagttcgccagttaa tagtttgcgcaacgttgttgccattgctacaggcatcgtggtgtcacgctcgtcgtttggtatggcttcattcagctccg gttcccaacgatcaaggcgagttacatgatcccccatgttgtgcaaaaaagcggttagctccttcggtcctccgatcg ttgtcagaagtaagttggccgcagtgttatcactcatggttatggcagcactgcataattctcttactgtcatgccatcc gtaagatgcttttctgtgactggtgagtactcaaccaagtcattctgagaatagtgtatgcggcgaccgagttgctcttg cccggcgtcaatacgggataataccgcgccacatagcagaactttaaaagtgctcatcattggaaaacgttcttcgg ggcgaaaactctcaaggatcttaccgctgttgagatccagttcgatgtaacccactcgtgcacccaactgatcttcag catcttttactttcaccagcgtttctgggtgagcaaaaacaggaaggcaaaatgccgcaaaaaagggaataagggc gacacggaaatgttgaatactcatactcttcctttttcaatattattgaagcatttatcagggttattgtctcatgagcggat acatatttgaatgtatttagaaaaataaacaaataggggttccgcgcacatttccccgaaaagtgccacctgacgtc |
| 178 | HIVp66 pcDNA Dest40 | gacggatcgggagatctcccgatccctatggtgcactctcagtacaatctgctctgatgccgcatagttaagccagt atctgctccctgcttgtgtgttggaggtcgctgagtagtgcgcgagcaaaatttaagctacaacaaggcaaggcttga ccgacaattgcatgaagaatctgcttagggttaggcgttttgcgctgcttcgcgatgtacgggccagatatacgcgtt gacattgattattgactagttattaatagtaatcaattacggggtcattagttcatagcccatatatggagttccgcgttac ataacttacggtaaatggcccgcctggctgaccgcccaacgacccccgcccattgacgtcaataatgacgtatgttc ccatagtaacgccaatagggactttccattgacgtcaatgggtggagtatttacggtaaactgcccacttggcagtac atcaagtgtatcatatgccaagtacgccccctattgacgtcaatgacggtaaatggcccgcctggcattatgcccagt acatgaccttatgggactttcctacttggcagtacatctacgtattagtcatcgctattaccatggtgatgcggttttggc agtacatcaatgggcgtggatagcggtttgactcacggggatttccaagtctccaccccattgacgtcaatgggagtt tgttttggcaccaaaatcaacgggactttccaaaatgtcgtaacaactccgccccattgacgcaaatgggcggtagg cgtgtacggtgggaggtctatataagcagagctctctggctaactagagaacccactgcttactggcttatcgaaatt aatacgactcactatagggagacccaagctggctagttaagctatcaacaagtttgtacaaaaaagctgaacgagaa acgtaaaatgatataaatatcaatatattaaattagatttgcataaaaaacagactacataatactgtaaaacacaacat atccagtcactatggctcctatatctccaatcgaaacagtcccattgaaaccgaatgccgcaaaatctatccaggaattaaagtc caaacaatggcctctcaccgaggagaagattaaggcattggtcgaaatctgcactgagatggagaaagagggg aaaattagcaaaatcgggccagagaaccccctacaatcacccgtatttgccatcaaaaaaaaagatagcactaagt ggcgaaagctcgtggacttccgcgaactcaataaaagaacccaggattttgggaggtacagcttggcattccgcat ccggcaggactttaagaagaaaaatccgtaaccgtgctggattgtgggcatgcagtctttagcgtaccactggatg aggattttaggaagtatactgcattcacaataccttcaattaacaacgaaacgccagggataaggtaccaatataacg tcctcccccaaggctggaagggctctcagcgatcttccagtcttcaatgactaagatacttgagccgttcaggaagc aaaaccccgacatcgtaatttaccagtacatggatgacttgtacgtcggtagtgatctcgaaattggccagcatcgaa caaaaatcgaggaattgaggcaacaccttctgcggtggggtttgacgacgcccgacaaaaagcatcaaaaagagc cgccgtttctgtggatgggttatgagctccatccggacaaatggacagtccagcccatcgtcttgccagaaaaagat agttggactgtaaatgacattcaaaaattggtcggaaattgaactgggcgtcccagatctatccaggaattaaagtc cggcagctttgcaagcttctccggggaacgaaggcacttacagaggtcataccccttacggaagaagcggaattg gagcttgcggagaaccgcgagatactcaaagagccggtccacgggtctactacgatccatccaaagatcttattg cagagattcagaaacaagggcagggtcaatggacatatccaggacgcgttcaagattgaagcag gaaagtacgcgaggatgaggggcgcacatactaacgatgttaaacaactcactgaggctgtacaaaagattactac ggagtcaatagtaatatgggcaaaacacctaagttcaagctcccgatccaaaggagacttgggaaacctggtgg accgagtattggcaagctacgtggattcctgagtgggaatttgtgaacacacctccctcgtgaagctgtggtatcaa cttgaaaaggccaatagtcggcgcggagacctctatgtggcgcggcgaaccgagagacaaagctcgg caaggcgggttatgtaacgaaccgaggtaggcaaaaggtcgtaacgcttactgatacgaccaaccaaaaaccga actgcaggctatttatctgcgcattgcaagactcaggactgaagtcaatatcgtgacggacagtcaatatgcactggg gattattcaggcgcaaccggatcagagtgaaagcgagctggtaaaccaaattattgagcagttgataaaaaaggag aaagtgtatctcgttgggtaccagcccatcaaggggataagtgataaacttgtatttgatcttaaggcgctgg aattcggaaagtacttacccatagtgactggatatgttgtgttttacagtattatgtagtctgttttttatgcaaaatctaattt aatatattgatatttatatcattttacgtttctcgttcagctttatgtacaaagtggttgatctgagggccgcggttcga aggtaagcctatccctaaccctctcctcggtctcgattctacgcgtaccggtcatcatcaccatcaccattgagtttaa cccgctgatcagcctcgactgtgccttctagttgccagccatctgttgtttgcccctcccccgtgccttccttgacctg gaaggtgccactcccactgtccttcctaataaaatgaggaaattgcatcgcattgtctgagtaggtgtcattctattctg gggggtggggtggggcaggacagcaagggggaggattgggaagacaatagcaggcatgctggggatgcggt gggctctatggcttctgaggcggaaagaaccagctggggctctagggggtatccccacgcgccctgtagcggcg cattaagcgcggcgggtgtggtggttacgcgcagcgtgaccgctacacttgccagcgccctagcgcccgctcctt tcgctttcttcccttcctttctcgccacgttcgccggctttccccgtcaagctctaaatcggggggctccctttagggttccg atttagtgctttacggcacctcgaccccaaaaaacttgattagggtgatggttcacgtagtgggccatcgccctgata gacggtttttcgccctttgacgttggagtccacgttctttaatagtggactcttgttccaaactggaacaacactcaacc ctatctcggtctattcttttgatttataagggattttgccgatttcggcctattggttaaaaaatgagctgatttaacaaaaa tttaacgcgaattaattctgtggaatgtgtgtcagttagggtgtggaaagtccccaggctccccagcaggcagaagta |

TABLE 13-continued

| SEQ ID | Construct | Sequence 5'-3' |
|---|---|---|
| | | tgcaaagcatgcatctcaattagtcagcaaccaggtgtgaaagtccccaggctcccagcaggcagaagtatgca<br>aagcatgcatctcaattagtcagcaaccatagtcccgcccctaactccgcccatcccgcccctaactccgcccagtt<br>ccgcccattctccgccccatggctgactaattttttttatttatgcagaggccgaggccgcctctgcctctgagctattc<br>cagaagtagtgaggaggcttttttggaggcctaggcttttgcaaaaagctcccggagcttgtatatccattttcggat<br>ctgatcaagagacaggatgaggatcgtttcgcatgattgaacaagatggattgcacgcaggttctccggccgcttgg<br>gtggagaggctattcggctatgactgggcacaacagacaatcggctgctctgatgccgccgtgttccggctgtcag<br>cgcaggggcgcccggttcttatgtcaagaccgacctgtccggtgccctgaatgaactgcaggacgaggcagcgc<br>ggctatcgtggctggccacgacgggcgttcttgcgcagctgtgctcgacgttgtcactgaagcgggaagggact<br>ggctgctattgggcgaagtgccggggcaggatctcctgtcatctcaccttgctcctgccgagaaagtatccatcatg<br>gctgatgcaatgcggcggctgcatacgcttgatccggctacctgcccattcgaccaccaagcgaaacatcgcatcg<br>agcgagcacgtactcggatggaagccggtcttgtcgatcaggatgatctggacgaagagcatcaggggctcgcg<br>ccagccgaactgttcgccaggctcaaggcgcgcatgcccgacggcgaggatctcgtcgtgacccatggcgatgc<br>ctgcttgccgaatatcatggtggaaaatggccgcttttctggattcatcgactgtggccggctgggtgtggcggacc<br>gctatcaggcatagcgttggctacccgtgatattgctgaagagcttggcggcgaatgggctgaccgcttcctcgtg<br>ctttacggtatcgccgctcccgattcgcagcgcatcgccttctatcgccttcttgacgagttcttctgagcgggactctg<br>gggttcgcgaaatgaccgaccaagcgacgcccaacctgccatcacgagatttcgattccaccgccgccttctatga<br>aaggttgggcttcggaatcgttttccgggacgcggctggatgatcctccagcgcggggatctcatgctggagttct<br>tcgcccacccaacttgtttattgcagcttataatggttacaaataaagcaatagcatcacaaatttcacaaataaagca<br>ttttttttcactgcattctgattgtggtttgtccaaactcatcaatgtatcttatcatgtctgtataccgtcgacctctagctag<br>agcttggcgtaatcatggtcatagctgtttcctgtgtgaaattgttatccgctcacaattccacacaacatacgagccgg<br>aagcataaagtgtaaagcctggggtgcctaatgagtgagctaactcacattaattgcgttgcgctcactgcccgctttc<br>cagtcgggaaacctgtcgtgccagctgcattaatgaatcggccaacgcgcggggagaggcggtttgcgtattggg<br>cgctcttccgcttcctcgctcactgactcgctgcgctcggtcgttcggctgcggcgagcggtatcagctcactcaaag<br>gcggtaatacggttatccacagaatcaggggataacgcaggaaagaacatgtgagcaaaaggccagcaaaaggc<br>caggaaccgtaaaaaggccgcgttgctggcgtttttccataggctccgcccccctgacgagcatcacaaaaatcga<br>cgctcaagtcagaggtggcgaaacccgacaggactataaagataccaggcgtttccccctggaagctccctcgtg<br>cgctctcctgttccgaccctgccgcttaccggatacctgtccgcctttctcccttcgggaagcgtggcgctttctcata<br>gctcacgctgtaggtatctcagttcggtgtaggtcgttcgctccaagctgggctgtgtgcacgaaccccccgttcagc<br>ccgaccgctgcgccttatccggtaactatcgtcttgagtccaacccggtaagacacgacttatcgccactggcagca<br>gccactggtaacaggattagcagagcgaggtatgtaggcggtgctacagagttcttgaagtggtggcctaactacg<br>gctacactagaagaacagtatttggtatctgcgctctgctgaagccagttaccttcggaaaaagagttggtagctcttg<br>atccggcaaacaaaccaccgctggtagcggtggtttttttgtttgcaagcagcagattacgcgcagaaaaaaaggat<br>ctcaagaagatcctttgatcttttctacggggtctgacgctcagtggaacgaaaactcacgttaagggattttggtcat<br>gagattatcaaaaaggatcttcacctagatccttttaaattaaaaatgaagttttaaatcaatctaaagtatatatgagtaa<br>acttggtctgacagttaccaatgcttaatcagtgaggcacctatctcagcgatctgtctatttcgttcatccatagttgcct<br>gactccccgtcgtgtagataactacgatacgggagggcttaccatctggccccagtgctgcaatgataccgcgaga<br>cccacgctcaccggctccagatttatcagcaataaaccagccagccggaagggccgagcgcagaagtggtctg<br>caactttatccgcctccatccagtctattaattgttgccgggaagctagagtaagtagttcgccagttaatagtttgcgc<br>aacgttgttgccattgctacaggcatcgtggtgtcacgctcgtcgtttggtatggcttcattcagctccggttcccaacg<br>atcaaggcgagttacatgatcccccatgttgtgcaaaaagcggttagctccttcggtcctccgatcgttgtcagaagt<br>aagttggccgcagtgttatcactcatggttatggcagcactgcataattctcttactgtcatgccatccgtaagatgcttt<br>tctgtgactggtgagtactcaaacaagtcattctgagaatagtgtatgcggcgaccgagttgctcttgcccggcgtca<br>atacgggataataccgcgccacatagcagaactttaaaagtgctcatcattggaaaacgttcttcggggcgaaaact<br>ctcaaggatcttaccgctgttgagatccagttcgatgtaacccactcgtgcacccaactgatcttcagcatcttttactttt<br>caccagcgtttctgggtgagcaaaaacaggaaggcaaaatgccgcaaaaaagggaataagggcgacacggaaa<br>tgttgaatactcatactcttcctttttcaatattattgaagcatttatcagggttattgtctcatgagcggatacatatttgaat<br>gtatttagaaaaataaacaaataggggttccgcgcacatttccccgaaaagtgccacctgacgtc |
| 179 | MMLV<br>pcDNA<br>Dest40 | gacggatcggagatctcccgatcccctatggtgcactctcagtacaatctgactgatgccgcatagttaagccagt<br>atctgctccctgcttgtgtgttggaggtcgctgagtagtgcgcgagcaaaatttaagctacaacaaggcaaggcttga<br>ccgacaattgcatgaagaatctgcttagggttaggcgttttgcgctgcttcgcgatgtacgggccagatatacgcgtt<br>gacattgattattgactagttattaatagtaatcaattacggggtcattagttcatagcccatatatggagttccgcgttac<br>ataacttacggtaaatggcccgcctggctgaccgcccaacgacccccgcccattgacgtcaataatgacgtatgttc<br>ccatagtaacgccaatagggactttccattgacgtcaatgggtggagtatttacggtaaactgcccacttggcagtac<br>atcaagtgtatcatatgccaagtacgccccctattgacgtcaatgacggtaaatggcccgcctggcattatgcccagt<br>acatgaccttatgggactttcctacttggcagtacatctacgtattagtcatcgctattaccatggtgatgcggttttggc<br>agtacatcaatgggcgtggatagcggtttgactcacggggatttccaagtctccaccccattgacgtcaatgggagtt<br>tgttttggcaccaaaatcaacgggactttccaaaatgtcgtaacaactccgccccattgacgcaaatgggcggtagg<br>cgtgtacggtgggaggtctatataagcagagctctctggctaactagagaacccactgcttactggcttatcgaaatt<br>aatacgactcactatagggagacccaagctggctagcgtttaagctatcaacaagtttgtacaaaaaagctgaacgagaa<br>acgtaaaatgatataaatatcaatatattaaattagatttgcataaaaaacagactacataatactgtaaaacacaacat<br>atccagtcactatggctgccaccatggactacaaagacgatgacgacaagagcagggctgaccccaagaagaag<br>aggaaggtgggtagtcacatgacatggctgtctgacttcctcaggcatgggcggaaactggaggtatgggttgg<br>cagtacggcctccacttattatccctcttaaagcaacgtcaacgcccggtttctatcaagcaaatatccaatgagtca<br>agaagctcgcctgggaattaagcctcacatacaacggttgttggatcaaggtattcttgtgccgtgccaatctccttgg<br>aatacaccactccttcctgtcaaaaaacccggaacaaatgactaccgcccgtgcaagaccttcgggaagtcaata<br>agagggtagaagatattcacccgaccgttccaaatccgtataatctgttgtcaggactgccaccgtcccatcagtggt<br>atactgtcctgaacttgaaggatgcgttatttgcctgcgcctcaccctacgtcacagcccctgttcgcgttcgaatg<br>gagagaccctgaaatgggtatatcagggcagttgacttggaccagacttccacaagggttcaaaaatagccctactc<br>ttttttgatgaagcccctccacagggacctcgcagatttcaggatccagcacccggacccttatcttgctgcagtacgtag<br>acgatctcttgctggcggcgacaagcgaactggattgccagcagggcacgcgagactcctccagacactgggta<br>acctggggtacagggcgtcagctaagaaggcacaaatatgcaaaaacaagtgaagtacctggggtatctcctga<br>aagaggggcaacggttggctcacagaagcccgaaaggagacggtgatgggacaaccgacgcctaaaacgccac<br>gacaactgcgagaattttgggcaccgccgggttttgccgcctttggatccctggcttttgcggagatggctgctccatt<br>gtatcccttgactaaaacaggtacgttgtttaattggggcccagatcagcaaaaggcttaccaagaaatttaaacaagc<br>gcttcttactgctccggcactcggccttccggatttgactaagcccttttgagttgtttgtagacgagaagcagggatac<br>gcgaagggtgtttttgacgcaaaaagctcggcccttggcgacgacccgtagcgtatttgtctaaaaagctcgacccagt |

TABLE 13-continued

| SEQ ID | Construct | Sequence 5'-3' |
|---|---|---|
| | | agcggccggttggccaccatgtcttcggatggtcgctgccatagcggttcttaccaaggacgcggggaaactgac |
| | | aatgggacagcctcttgtaataaaggcgccgcatgctgttgaagcactggtgaagcagccaccagatcgatggctg |
| | | agcaacgcaaggatgacacactatcaggccctgatctcgatacagatagagtccaattcggccctgttgttgccttg |
| | | aacccagctacgcttttgcctctcccagaagagggtttgcaacacaattgcttggatatcttggcagaagcccacggc |
| | | acgcggccggatttgacggaccagccgttgcccgatgccgaccatacctggtatactgacgggtcctcattgctgc |
| | | aggagggcagcgcaaagctggggcggcagtaactacggagaccgaagtcatttgggcaaaagcactgccagc |
| | | agggacctctgcccagcgggcggagcttattgcgcttacacaggcattgaagatggcagaaggaaagaagctcaa |
| | | tgtctatacggattcccggtatgcatttgccacggcgcacattcacggcgagatctataggcgaagaggactgcttac |
| | | ttccgagggtaaggagataaagaataaggatgaaatcctcgcccttctcaaagccctttttttgccgaaacgcctgag |
| | | cataatccattgccctggtcaccaaaaggggcattctgcagaggcgcgaggcaacaggatggcagatcaggctgc |
| | | taggaaggccgccattacggagacgcctgatacgagtacgttgctttaatgaacccatagtgactggatatgttgtgt |
| | | tttacagtattatgtagtctgttttttatgcaaaatctaatttaatatattgatatttatatcattttacgtttctcgttcagctttt |
| | | cttgtacaaagtggttgatctagagggcccgcggttcgaaggtaagcctatccctaaccctctcctcggtctcgattctac |
| | | gcgtaccggtcatcatcaccatcaccattgagtttaaacccgctgatcagcctcgactgtgccttctagttgccagcca |
| | | tctgttgtagcccctcccccgtgccttccttgaccctggaaggtgccactcccactgtccttcctaataaaatgagga |
| | | aattgcatcgcattgtctgagtaggtgtcattctattctggggggtggggtggggcaggacagcaaggggggaggat |
| | | tgggaagacaatagcaggcatgctgggatgcggtgggctctatgcttctgaggcggaaagaaccagctgggg |
| | | ctctaggggggtatccccacgcgccctgtagcggcgcattaagcgcggcgggtgtggtggttacgcgcagcgtgac |
| | | cgctacacttgccagcgccctagcgcccgctcctttcgctttcttcccttcctttctcgccacgttcgccggctttcccc |
| | | gtcaagctctaaatcgggggctccctttagggttccgatttagtgctttacggcacctcgaccccaaaaaacttgatta |
| | | gggtgatggttcacgtagtgggccatcgccctgatagacggtttttcgccctttgacgttggagtccacgttctttaata |
| | | gtggactcttgttccaaactggaacaacactcaaccctatctcggtctattcttttgatttataagggattttgccgatttc |
| | | ggcctattggttaaaaaatgagctgatttaacaaaaatttaacgcgaattaattctgtggaatgtgtgtcagttagggtgt |
| | | ggaaagtccccaggctccccagcaggcagaagtatgcaaagcatgcatctcaattagtcagcaaccaggtgtgga |
| | | aagtccccaggctccccagcaggcagaagtatgcaaagcatgcatctcaattagtcagcaaccatagtcccgcccc |
| | | taactccgcccatcccgcccctaactccgcccagttccgcccattctccgccccatggctgactaatttttttttatttatg |
| | | cagaggccgaggccgcctctgcctctgagctattccagaagtagtgaggaggcttttttggaggcctaggcttttgc |
| | | aaaaagctcccgggagcttgtatatccattttcggatctgatcaagagacaggatgaggatcgtttcgcatgattgaa |
| | | caagatggattgcacgcaggttctccggccgcttgggtggagaggctattcggctatgactgggcacaacagaca |
| | | atcggctgctctgatgccgccgtgttccggctgtcagcgcaggggcgcccggttcttttttgtcaagaccgacctgtc |
| | | cggtgccctgaatgaactgcaggacgaggcagcgcggctatcgtggctggccacgacgggcgttccttgcgcag |
| | | ctgtgctcgacgttgtcactgaagcgggaagggactggctgctattgggcgaagtgccggggcaggatctcctgtc |
| | | atctcaccttgctcctgccgagaaagtatccatcatggctgatgcaatgcggcggctgcatacgcttgatccggctac |
| | | ctgcccattcgaccaccaagcgaaacatcgcatcgagcgagcacgtactcggatggaagccggtcttgtcgatca |
| | | ggatgatctggacgaagagcatcaggggctcgcgccagccgaactgttcgccaggctcaaggcgcgcatgcccg |
| | | acggcgaggatctcgtcgtgacccatggcgatgcctgcttgccgaatatcatggtggaaaatggccgcttttctgga |
| | | ttcatcgactgtggccggctgggtgtggcggaccgctatcaggacatagcgttggctacccgtgatattgctgaaga |
| | | gcttggcggcgaatgggctgaccgcttcctcgtgctttacggtatcgccgctcccgattcgcagcgcatcgccttcta |
| | | tcgccttcttgacgagttcttctgagcgggactctggggttcgcgaaatgaccgaccaagcgacgcccaacctgcc |
| | | atcacgagatttcgattccaccgccgccttctatgaaaggttgggcttcggaatcgttttccgggacgccggctggat |
| | | gatcctccagcgcggggatctcatgctggagttcttcgcccaccccaacttgtttattgcagcttataatggttacaaat |
| | | aaagcaatagcatcacaaatttcacaaataaagcatttttttcactgcattctagttgtggtttgtccaaactcatcaatgt |
| | | atcttatcatgtctgtataccgtcgacctctagctagagcttggcgtaatcatggtcatagctgtttcctgtgtgaaattgt |
| | | tatccgctcacaattccacacaacatacgagccggaagcataaagtgtaaagcctggggtgcctaatgagtgagct |
| | | aactcacattaattgcgttgcgctcactgcccgctttccagtcgggaaacctgtcgtgccagctgcattaatgaatcgg |
| | | ccaacgcgcggggagaggcggtttgcgtattgggcgctcttccgcttcctcgctcactgactcgctgcgctcggtc |
| | | gttcggctgcggcgagcggtatcagctcactcaaaggcggtaatacggttatccacagaatcaggggataacgca |
| | | ggaaagaacatgtgagcaaaaggccagcaaaaggccaggaaccgtaaaaaggccgcgttgctggcgtttttccat |
| | | aggctccgcccccctgacgagcatcacaaaaatcgacgctcaagtcagaggtggcgaaacccgacaggactata |
| | | aagataccaggcgtttccccctggaagctccctcgtgcgctctcctgttccgaccctgccgcttaccggatacctgtc |
| | | cgcctttctcccttcgggaagcgtggcgctttctcatagctcacgctgtaggtatctcagttcggtgtaggtcgttcgct |
| | | ccaagctgggctgtgtgcacgaaccccccgttcagcccgaccgctgcgccttatccggtaactatcgtcttgagtcc |
| | | aacccggtaagacacgacttatcgccactggcagcagccactggtaacaggattagcagagcgaggtatgtaggc |
| | | ggtgctacagagttcttgaagtggtggcctaactacggctacactagaagaacagtatttggtatctgcgctctgctg |
| | | aagccagttaccttcggaaaaagagttggtagctcttgatccggcaaacaaaccaccgctggtagcggtggtttttt |
| | | gtttgcaagcagcagattacgcgcagaaaaaaaggatctcaagaagatcctttgatcttttctacggggtctgacgct |
| | | cagtggaacgaaaactcacgttaagggattttggtcatgagattatcaaaaaggatcttcacctagatccttttaaatta |
| | | aaaatgaagttttaaatcaatctaaagtatatatgagtaaacttggtctgacagttaccaatgcttaatcagtgaggcac |
| | | ctatctcagcgatctgtctatttcgttcatccatagttgcctgactccccgtcgtgtagataactacgatacgggagggc |
| | | ttaccatctggccccagtgctgcaatgataccgcgagacccacgctcaccggctccagatttatcagcaataaacca |
| | | gccagccggaagggccgagcgcagaagtggtcctgcaactttatccgcctccatccagtctattaattgttgccggg |
| | | aagctagagtaagtagttcgccagttaatagtttgcgcaacgttgttgccattgctacaggcatcgtggtgtcacgctc |
| | | gtcgtttggtatggcttcattcagctccggttcccaacgatcaaggcgagttacatgatcccccatgttgtgcaaaaaa |
| | | gcggttagctccttcggtcctccgatcgttgtcagaagtaagttggccgcagtgttatcactcatggttatggcagcac |
| | | tgcataattctcttactgtcatgccatccgtaagatgcttttctgtgactggtgagtactcaaccaagtcattctgagaata |
| | | gtgtatgcggcgaccgagttgctcttgcccggcgtcaatacgggataataccgcgccacatagcagaactttaaaa |
| | | gtgctcatcattggaaaacgttcttcggggcgaaaactctcaaggatcttaccgctgttgagatccagttcgatgtaac |
| | | ccactcgtgcacccaactgatcttcagcatcttttactttcaccagcgtttctgggtgagcaaaaacaggaaggcaaa |
| | | atgccgcaaaaaagggaataagggcgacacggaaatgttgaatactcatactcttcctttttcaatattattgaagcatt |
| | | tatcagggttattgtctcatgagcggatacatatttgaatgtatttagaaaaataaacaaataggggttccgcgcacattt |
| | | ccccgaaaagtgccacctgacgtc |

SEQUENCE LISTING (182 sequences)

SEQ ID NO: 1 - DNA, 22 bp, Artificial Sequence
  Description of Artificial Sequence: Synthetic oligonucleotide
tagtcggtacgcgactaagccg

SEQ ID NO: 2 - DNA, 22 bp, Artificial Sequence
  Description of Artificial Sequence: Synthetic oligonucleotide
tagtcgtcgtaacgtacgtcgg

SEQ ID NO: 3 - DNA, 21 bp, Artificial Sequence
  Description of Artificial Sequence: Synthetic oligonucleotide
cggctataacgcgtcgcgtag

SEQ ID NO: 4 - DNA, 22 bp, Artificial Sequence
  Description of Artificial Sequence: Synthetic oligonucleotide
tagagcgtacgcgactaacgac

SEQ ID NO: 5 - DNA, 25 bp, Artificial Sequence
  Description of Artificial Sequence: Synthetic primer
caccgcacgtgtgaaccaacccgcc

SEQ ID NO: 6 - DNA, 25 bp, Artificial Sequence
  Description of Artificial Sequence: Synthetic primer
aaacggcgggttggttcacacgtgc

SEQ ID NO: 7 - DNA, 25 bp, Artificial Sequence
  Description of Artificial Sequence: Synthetic primer
caccgaaacaacaggccgggcgggt

SEQ ID NO: 8 - DNA, 25 bp, Artificial Sequence
  Description of Artificial Sequence: Synthetic primer
aaacacccgcccggcctgttgtttc

SEQ ID NO: 9 - DNA, 25 bp, Artificial Sequence
  Description of Artificial Sequence: Synthetic primer
caccgacaaaaaaattagccgggtg

SEQ ID NO: 10 - DNA, 24 bp, Artificial Sequence
  Description of Artificial Sequence: Synthetic primer
aaaccacccggctaatttttttgt

SEQ ID NO: 11 - DNA, 25 bp, Artificial Sequence
  Description of Artificial Sequence: Synthetic primer
caccgtaaatttctctgatagacta

SEQ ID NO: 12 - DNA, 25 bp, Artificial Sequence
  Description of Artificial Sequence: Synthetic primer
aaactagtctatcagagaaatttac

SEQ ID NO: 13 - DNA, 25 bp, Artificial Sequence
  Description of Artificial Sequence: Synthetic primer
caccgtgtttcaatgagagcattac

SEQ ID NO: 14 - DNA, 25 bp, Artificial Sequence
  Description of Artificial Sequence: Synthetic primer
aaacgtaatgctctcattgaaacac

SEQ ID NO: 15 - DNA, 24 bp, Artificial Sequence
  Description of Artificial Sequence: Synthetic primer
caccggtctcgaactcctgagctc

SEQ ID NO: 16 - DNA, 24 bp, Artificial Sequence
  Description of Artificial Sequence: Synthetic primer
aaacgagctcaggagttcgagacc

SEQ ID NO: 17 - DNA, 20 bp, Artificial Sequence
  Description of Artificial Sequence: Synthetic primer
agtgaagtggcgcattcttg

SEQ ID NO: 18 - DNA, 21 bp, Artificial Sequence
  Description of Artificial Sequence: Synthetic primer
caccctttccaaatcctcagc

SEQ ID NO: 19 - DNA, 25 bp, Artificial Sequence
  Description of Artificial Sequence: Synthetic primer
caccgtgggggttagacccaatatc

SEQ ID NO: 20 - DNA, 25 bp, Artificial Sequence
  Description of Artificial Sequence: Synthetic primer
aaacgatattgggtctaacccccac

SEQ ID NO: 21 - DNA, 25 bp, Artificial Sequence
  Description of Artificial Sequence: Synthetic primer
caccgaccccacagtggggccacta

SEQ ID NO: 22 - DNA, 25 bp, Artificial Sequence
  Description of Artificial Sequence: Synthetic primer
aaactagtggccccactgtggggtc

SEQ ID NO: 23 - DNA, 25 bp, Artificial Sequence
  Description of Artificial Sequence: Synthetic primer
caccgagggccggttaatgtggctc

SEQ ID NO: 24 - DNA, 25 bp, Artificial Sequence
  Description of Artificial Sequence: Synthetic primer
aaacgagccacattaaccggccctc

SEQ ID NO: 25 - DNA, 24 bp, Artificial Sequence
  Description of Artificial Sequence: Synthetic primer
caccgtcaccaatcctgtccctag

SEQ ID NO: 26 - DNA, 24 bp, Artificial Sequence
  Description of Artificial Sequence: Synthetic primer
aaacctagggacaggattggtgac

SEQ ID NO: 27 - DNA, 25 bp, Artificial Sequence
  Description of Artificial Sequence: Synthetic primer
caccgccggccctgggaatataagg

SEQ ID NO: 28 - DNA, 25 bp, Artificial Sequence
  Description of Artificial Sequence: Synthetic primer
aaacccttatattcccagggccggc

SEQ ID NO: 29 - DNA, 25 bp, Artificial Sequence
  Description of Artificial Sequence: Synthetic primer
caccgcgggcccctatgtccacttc

SEQ ID NO: 30 - DNA, 25 bp, Artificial Sequence
  Description of Artificial Sequence: Synthetic primer
aaacgaagtggacataggggcccgc

SEQ ID NO: 31 - DNA, 20 bp, Artificial Sequence
  Description of Artificial Sequence: Synthetic primer
actcctttcatttgggcagc

SEQ ID NO: 32 - DNA, 20 bp, Artificial Sequence
  Description of Artificial Sequence: Synthetic primer
ggttctggcaaggagagaga

SEQ ID NO: 33 - DNA, 25 bp, Artificial Sequence
  Description of Artificial Sequence: Synthetic primer
caccgcggagagcttcgtgctaaac

SEQ ID NO: 34 - DNA, 25 bp, Artificial Sequence
  Description of Artificial Sequence: Synthetic primer
aaacgtttagcacgaagctctccgc

SEQ ID NO: 35 - DNA, 25 bp, Artificial Sequence
  Description of Artificial Sequence: Synthetic primer
caccgcctgctcgtggtgaccgaag

SEQ ID NO: 36 - DNA, 25 bp, Artificial Sequence
  Description of Artificial Sequence: Synthetic primer
aaaccttcggtcaccacgagcaggc

SEQ ID NO: 37 - DNA, 25 bp, Artificial Sequence
  Description of Artificial Sequence: Synthetic primer
caccgcagcaaccagacggacaagc

SEQ ID NO: 38 - DNA, 25 bp, Artificial Sequence
  Description of Artificial Sequence: Synthetic primer
aaacgcttgtccgtctggttgctgc

SEQ ID NO: 39 - DNA, 25 bp, Artificial Sequence
  Description of Artificial Sequence: Synthetic primer
caccgaggcggccagcttgtccgtc

SEQ ID NO: 40 - DNA, 25 bp, Artificial Sequence
  Description of Artificial Sequence: Synthetic primer
aaacgacggacaagctggccgcctc

SEQ ID NO: 41 - DNA, 25 bp, Artificial Sequence
  Description of Artificial Sequence: Synthetic primer
caccgcgttgggcagttgtgtgaca

SEQ ID NO: 42 - DNA, 25 bp, Artificial Sequence
  Description of Artificial Sequence: Synthetic primer
aaactgtcacacaactgcccaacgc

SEQ ID NO: 43 - DNA, 25 bp, Artificial Sequence
  Description of Artificial Sequence: Synthetic primer
caccgacggaagcggcagtcctggc

SEQ ID NO: 44 - DNA, 25 bp, Artificial Sequence
  Description of Artificial Sequence: Synthetic primer
aaacgccaggactgccgcttccgtc

SEQ ID NO: 45 - DNA, 20 bp, Artificial Sequence
  Description of Artificial Sequence: Synthetic primer
agaaggaagaggctctgcag

SEQ ID NO: 46 - DNA, 20 bp, Artificial Sequence
  Description of Artificial Sequence: Synthetic primer
ctctttgatctgcgccttgg

SEQ ID NO: 47 - DNA, 25 bp, Artificial Sequence
  Description of Artificial Sequence: Synthetic primer
caccgccgggtgacagtgcttcggc

SEQ ID NO: 48 - DNA, 25 bp, Artificial Sequence
  Description of Artificial Sequence: Synthetic primer
aaacgccgaagcactgtcacccggc

SEQ ID NO: 49 - DNA, 24 bp, Artificial Sequence
  Description of Artificial Sequence: Synthetic primer
caccgtgcggcaacctacatgatg

SEQ ID NO: 50 - DNA, 24 bp, Artificial Sequence
  Description of Artificial Sequence: Synthetic primer
aaaccatcatgtaggttgccgcac

SEQ ID NO: 51 - DNA, 25 bp, Artificial Sequence
  Description of Artificial Sequence: Synthetic primer
caccgctagatgattccatctgcac

SEQ ID NO: 52 - DNA, 25 bp, Artificial Sequence
  Description of Artificial Sequence: Synthetic primer
aaacgtgcagatggaatcatctagc

SEQ ID NO: 53 - DNA, 24 bp, Artificial Sequence
  Description of Artificial Sequence: Synthetic primer
caccgaggttcacttgatttccac

SEQ ID NO: 54 - DNA, 24 bp, Artificial Sequence
  Description of Artificial Sequence: Synthetic primer
aaacgtggaaatcaagtgaacctc

SEQ ID NO: 55 - DNA, 25 bp, Artificial Sequence
  Description of Artificial Sequence: Synthetic primer
caccgccgcacagacttcagtcacc

SEQ ID NO: 56 - DNA, 25 bp, Artificial Sequence
  Description of Artificial Sequence: Synthetic primer
aaacggtgactgaagtctgtgcggc

SEQ ID NO: 57 - DNA, 24 bp, Artificial Sequence
  Description of Artificial Sequence: Synthetic primer
caccgctggcgatgcctcggctgc

SEQ ID NO: 58 - DNA, 24 bp, Artificial Sequence
  Description of Artificial Sequence: Synthetic primer
aaacgcagccgaggcatcgccagc

SEQ ID NO: 59 - DNA, 20 bp, Artificial Sequence
  Description of Artificial Sequence: Synthetic primer
tggggatgaagctagaaggc

SEQ ID NO: 60 - DNA, 20 bp, Artificial Sequence
  Description of Artificial Sequence: Synthetic primer
aatctgggttccgttgccta

SEQ ID NO: 61 - DNA, 25 bp, Artificial Sequence
  Description of Artificial Sequence: Synthetic primer
caccgacaatgtgtcaactcttgac

SEQ ID NO: 62 - DNA, 25 bp, Artificial Sequence
  Description of Artificial Sequence: Synthetic primer
aaacgtcaagagttgacacattgtc

SEQ ID NO: 63 - DNA, 25 bp, Artificial Sequence
  Description of Artificial Sequence: Synthetic primer
caccgtcatcctcctgacaatcgat

SEQ ID NO: 64 - DNA, 25 bp, Artificial Sequence
  Description of Artificial Sequence: Synthetic primer
aaacatcgattgtcaggaggatgac

SEQ ID NO: 65 - DNA, 24 bp, Artificial Sequence
  Description of Artificial Sequence: Synthetic primer
caccggtgacaagtgtgatcactt

SEQ ID NO: 66 - DNA, 24 bp, Artificial Sequence
  Description of Artificial Sequence: Synthetic primer
aaacaagtgatcacacttgtcacc

SEQ ID NO: 67 - DNA, 25 bp, Artificial Sequence
  Description of Artificial Sequence: Synthetic primer
caccgacacagcatggacgacagcc

SEQ ID NO: 68 - DNA, 25 bp, Artificial Sequence
  Description of Artificial Sequence: Synthetic primer
aaacggctgtcgtccatgctgtgtc

SEQ ID NO: 69 - DNA, 24 bp, Artificial Sequence
  Description of Artificial Sequence: Synthetic primer
caccgatctggtaaagatgattcc

SEQ ID NO: 70 - DNA, 24 bp, Artificial Sequence
  Description of Artificial Sequence: Synthetic primer
aaacggaatcatctttaccagatc

SEQ ID NO: 71 - DNA, 25 bp, Artificial Sequence
  Description of Artificial Sequence: Synthetic primer
caccgttgtatttccaaagtcccac

SEQ ID NO: 72 - DNA, 25 bp, Artificial Sequence
  Description of Artificial Sequence: Synthetic primer
aaacgtgggactttggaaatacaac

SEQ ID NO: 73 - DNA, 20 bp, Artificial Sequence
  Description of Artificial Sequence: Synthetic primer
ctcaacctggccatctctga

SEQ ID NO: 74 - DNA, 20 bp, Artificial Sequence
  Description of Artificial Sequence: Synthetic primer
cccgagtagcagatgaccat

SEQ ID NO: 75 - DNA, 20 bp, Artificial Sequence
  Description of Artificial Sequence: Synthetic oligonucleotide
ttgctggctgtggagcggac

SEQ ID NO: 76 - DNA, 20 bp, Artificial Sequence
  Description of Artificial Sequence: Synthetic oligonucleotide
gactggcttgggcagttcca

SEQ ID NO: 77 - DNA, 20 bp, Artificial Sequence
  Description of Artificial Sequence: Synthetic oligonucleotide
tgctggggccttcctcgagg

SEQ ID NO: 78 - DNA, 20 bp, Artificial Sequence
  Description of Artificial Sequence: Synthetic oligonucleotide
ccgaaggtaggagaaggtct

SEQ ID NO: 79 - DNA, 20 bp, Artificial Sequence
  Description of Artificial Sequence: Synthetic oligonucleotide
atgcacagcagatcctcctc

SEQ ID NO: 80 - DNA, 20 bp, Artificial Sequence
  Description of Artificial Sequence: Synthetic oligonucleotide
agagagtgagccaaaggtgc

SEQ ID NO: 81 - DNA, 20 bp, Artificial Sequence
  Description of Artificial Sequence: Synthetic oligonucleotide
ggcatactcaatgcgtacat

SEQ ID NO: 82 - DNA, 20 bp, Artificial Sequence
  Description of Artificial Sequence: Synthetic oligonucleotide
gggttccattacggccagcg

SEQ ID NO: 83 - DNA, 20 bp, Artificial Sequence
  Description of Artificial Sequence: Synthetic oligonucleotide
aaggctgaccacatccggaa

SEQ ID NO: 84 - DNA, 20 bp, Artificial Sequence
  Description of Artificial Sequence: Synthetic oligonucleotide
tgccgactccagcttccgtc

SEQ ID NO: 85 - DNA, 20 bp, Artificial Sequence
  Description of Artificial Sequence: Synthetic oligonucleotide
ctgtcagtgaaaaccactcg

SEQ ID NO: 86 - DNA, 20 bp, Artificial Sequence
  Description of Artificial Sequence: Synthetic oligonucleotide
cgtactaagaacgtgccttc

SEQ ID NO: 87 - DNA, 20 bp, Artificial Sequence
  Description of Artificial Sequence: Synthetic oligonucleotide
gtcaccaatcctgtccctag

SEQ ID NO: 88 - DNA, 885 bp, Artificial Sequence
  Description of Artificial Sequence: Synthetic polynucleotide
atgacaacaagtggcgtgccattcggcatgactttgcgccccacgagatcacgactgtctcgccgaactccctacagccgggatcgactccctccctttgagactgaaacacgggccacgatactcgaggaccacccacttctgccggagtgtaacaccttgacgatgcataacgttagctatgtgagaggtctcccttgttctgtcggctttacccttattcaagagtgggtcgtgccgtgggacatggttctcacgagagaggagctcgttatcctgagaaaatgtatgcacgtttgtctttgctgtgcaaatatagatataatgacttctatgatgattcatgggtacgaatcttgggccttgcactgccattgtagcagtcctggctccctccaatgcatcgcgggaggccaagttctcgcttcctggtttagaatggtcgtggacggagcaatgttcaaccagcgctttatctggtatcgcgaggtagtcaactataatatgccgaaggaggttatgtttatgtctagtgtgttcatgcgagggagacatttgatttatcttagactgtggtatgatggccatgtgggaagcgtagttccggcgatgtccttcggttactccgcattgcattgtgggattttgaataacatcgttgtactttgttgttcatactgcgccgatctgtcagaaataagggtacgatgctgcgcacggcgaacccggaggctcatgctgagagccgttcgaataatcgctgaagaaacgacagcaatgttgtattcatgccgaactgaaaggcgacggcaacagtttatacgcgcactcttgcagcaccacaggccgatcctgatgcatgactacgatagcactccgatgtag

SEQ ID NO: 89 - DNA, 1491 bp, Artificial Sequence
  Description of Artificial Sequence: Synthetic polynucleotide
atggagagaaggaatcctagtgagaggggagtgcccgccgggttttctggtcacgcctccgtggaatccggatgtgagactcaggagtcccccgccaccgtggtgttccgcccaccaggagacaacactgacggtggcgcggcggctgctgcaggtggaagccaagccgccgctgctggggccgagccgatggaacccgaatccagacccggtccctctggcatgaacgttgtgcaggtcgcagaactctaccccgaactccgcaggatcttgacaatcacggaggacggccagggcctcaagggagtgaagagagagagaggggcttgtgaggccactgaggaagctcgcaatctggcgttttcattgatgacaaggcacaggccggaatgcattacattccaacagattaaggacaactgcgcaaacgagctcgatctcctggcccagaagtatagcatcgagcagctgacaacctattggctgcagcccggcgacgattttgaagaggccatccgcgtgtacgcaaaggtggccctgcgacctgactgcaaatataagatttccaaactggttaacatccggaattgttgttatattagtggaaatggcgcagaagtggagattgacacagaggatcgagtcgctttccggtgctctatgatcaacatgtggcccggtgtgctcggcatggatggcgtagtcattatgaatgtgaggttcaccggacctaattttagcggaaccgtcttcctggcaaacactaatctgatcctgcatggagtttctttctatggatttaataacacctgtgttgaagcttggaccgacgtgcgggttagagggtgtgctttttattgctgctggaaaggcgtcgtgtgtagacccaaaagtagagcttctatcaagaaatgcctgttcgagaggtgtactctgggcattctcagtgaaggtaatagcagggtcaggcataacgtggcctcagattgcggatgttttatgttggttaaatccgtggctgtgatcaagcacaacatggtgtgtggcaattgtgaggaccgggcatctcaaatgctgacatgttccgatggcaactgtcacctgctcaaaacaattgccgttgcgagccattctcggaaggcctggccagttttcgagcataacatcctgacgcgctgtagtctccacctgggtaacagacggggcgttttcctgccatatcagtgtaacctgtcacataccaagatactcctggaaccagaatctatgagtaaagtgaacctgaatggtgtattcgatatgaccatgaagatatggaaagtcctccgctatgacgaaactaggactaggtgtaggccctgcgagtgtggcggcaagcatatccgcaaccaacccgtgatgctggacgtgaccgaggagctgcgccccgatcacctggtgctggcctgcaccagagcagaattcgggagctcagacgaagacactgattaa

SEQ ID NO: 90 - DNA, 1503 bp, Artificial Sequence
  Description of Artificial Sequence: Synthetic polynucleotide
atggagagaaggaatcctagtgagaggggagtgcccgccgggttttctggtcacgcctccgtggaatccggatgtgagactcaggagtcccccgccaccgtggtgttccgcccaccaggagacaacactgacggtggcgcggcggctgctgcaggtggaagccaagccgccgctgctggggccgagccgatggaacccgaatccagacccggtccctctggcatgaacgttgtgcaggtcgcagaactctaccccgaactccgcaggatcttgacaatcacggaggacggccagggcctcaagggagtgaagagagagagaggggcttgtgaggccactgaggaagctcgcaatctggcgttttcattgatgacaaggcacaggccggaatgcattacattccaacagattaaggacaactgcgcaaacgagctcgatctcctggcccagaagtatagcatcgagcagctgacaacctattggctgcagcccggcgacgattttgaagaggccatccgcgtgtacgcaaaggtggccctgcgacctgactgcaaatataagatttccaaactggttaacatccggaattgttgttatattagtggaaatggcgcagaagtggagattgacacagaggatcgagtcgctttccggtgctctatgatcaacatgtggcccggtgtgctcggcatggatggcgtagtcattatgaatgtgaggttcaccggacctaattttagcggaaccgtcttcctggcaaacactaatctgatcctgcatggagtttctttctatggatttaataacacctgtgttgaagcttggaccgacgtgcgggttagagggtgtgctttttattgctgctggaaaggcgtcgtgtgtagacccaaaagtagagcttctatcaagaaatgcctgttcgagaggtgtactctgggcattctcagtgaaggtaatagcagggtcaggcataacgtggcctcagattgcggatgttttatgttggttaaatccgtggctgtgatcaagcacaacatggtgtgtggcaattgtgaggaccgggctggaattccagcatctcaaatgctgacatgttccgatggcaactgtcacctgctcaaaacaattcacgttgcgagccattctcggaaggcctggccagttttcgagcataacatcctgacgcgctgtagtctccacctgggtaacagacggggcgttttcctgccatatcagtgtaacctgtcacataccaagatactcctggaaccagaatctatgagtaaagtgaacctgaatggtgtattcgatatgaccatgaagatatggaaagtcctccgctatgacgaaactaggactaggtgtaggccctgcgagtgtggcggcaagcatatccgcaaccaacccgtgatgctggacgtgaccgaggagctgcgccccgatcacctggtgctggcctgcaccagagcagaattcgggagctcagacgaagacactgattaa

SEQ ID NO: 91 - DNA, 18764 bp, Homo sapiens
gactcccaggcccgaggactcctggaagggaggtgagtgtggcgctgaggaagcggcgggacggatgcgagcccgggaggagcgcgctggggggccgcaggcgggggatgtggcgcggtccaggcccgtcgcggcctcgtcctgacagggacacctgcgggatcgtccttccaggatcgcctgcgggcctcgcgggccgatgcctcgggtccccctccggcctcggtttctccgcgcagcggggcggggcgggggcagcgcgggtctcaaagctgcctgcagggggcgcccgtgagcggcgcggccggagccggagacccagcggccgccgagacagcgggagccggcgtgcgagcggcaggtcagccggggtgctaggtctggcgtgcggggtcctgggtgccgggtccggggtgcggggtgccgggggtccggggctggtggccgggcggcgtggggccgtcgggggtgcggggccgggaggactgggaggctggggttctgctcccctcagggttcctttcccgccgccccgagaccagttccccggcgcggggtccgagtcctgccccgcggcggctgccggcactgcctgtgaagggcccaggcacagtcacgtcccaggcgcagttgcggcgccgcgtgcgggaccctccgagctgtcccaaactgcaccggaaggcgcgcaggggtaggcggggagggaaggcaagtgcggcggccggcgcggcgcggggtgcggagccgcaggtagcgggcggggagcgtccgtccgtcagtccgtccgtccgtccatgcgccgcagaccggccccgcgcgctcgcatgaaccttcgcgagctcctccagcagggatggaccgggggcgcagaggcgcttcctgaggggtggcgggccgggccccggggcgagggagattccccaggtggaggagccgggcggagaccggttccccgggaaggtgaggcgcgggcagagatacccgagcgcccgggacgcgccgagaaagggggaatcaggaacgctgggccgagcgctggcgtcttccgtggacagtggtggcgggaactgggtttgggggacccaggagacgacgggggacggatgggggtgggtgcgcgcctcggactggccccggccgtctgtctggctgcccggagcggaggtaggaatggcgggaatggtggcggctctcgagggatttggcgcaaggcggcccaagggcttgaggaggaggccgcgggccggcagagctgaggtccctgtgtcccgcactcagactttagttgccccgactgtaccatgggaggaagagggagacccagggctgggtcctaggctgggggagtcggggccctgcaaagacgcgcaggtgtttgtggcccttgttggagggtgagccgcaggtcaagccagccctccgtcgccatcctgaagcacctcctctcttgggctctgccacacacagggccttctcccctattgccaggtgctcaggccgcctccaccctgcctctgctgccggctccccctgggttccccggcggggcaccctgccgatactccatgacgcgccagggctgccccagggtgccccagccctggggaccatggtggagggttctgtggagcaccgcgggcctgggaagctgttgcggggtcggggcttcctcactggccctgctttggccgttcctggaggccttgggtggggctgggaaggccgggccctgtgggcagcaccccccccccccccgcccaacatcccggcagatccatggcaggggcgcctcacaggctggtccacggccacggtgtcagtccctccttgttctgcgcttgctttttggggtctcccagcctctccctagtcctagagtttctcaggcaaatcccagccactacccctccatccgtgtcccctgtttccccagtgctgagctggctgagctgtgagctttcctgctccttgcctcaggaagccaggggcagcccagtcacctctggccagaggcgggccttaggccaaggctgacctggctggtctgagagctgtgctgggcttcttcccatatcagtctgtgaattacagatccccaaatatgccctgcgtcgcgatggaggagggcaatcaatggcaatgactgcctcatgggcaacgcgatgtgctggagatttcagtgctctcgtctgggttctggtcttgcctcctcgacccactcgctgagcaggttgctgtcccggggaatctgatatctcatctgtagaacaaggatgatgatcttagcaatgcctaatgtggaaaggccttggcttgggagcaagtgggggaaggtttagggcagaccagagggccggtgaggggtgtgtgctggagcggggaacccgggagggagggtgttaggcttgagggtcaggggacaccacagggattgctgttggcagagggacatatgaatggtagttggcctgggagccagcatgtgacttgagagcatcacgtcctgcaaagtccaggtgaggcctgggcagtgcctgctgtgtgggaccacagcccctggtggctctcagctgtgtcctgacactccaaagaaggtcttagtaccctctcacagacctaatacccgagccacctaaccccaaatgagctagaactgccttcccaaccgtgtttgcggggtctgtcttgtctattgcagcgcaaacagagccctgagcacgcaggagagcagaggaaggacagacagaagatggatggatggatgaaggcgggaagcacaggctgaggggatttagggcatgtgtggtgggggtgctgtggagaggagactgcacaggcaggagctgagctggtgaatgggagggttctagctcccagaagggtctgggccattgacaggaggggcttggtcctaggaggtgggtggtccagaggttgcaaggagcagaggagcccagatggggaagggaatggagctggggtgcagagaggagcccccacacaactgcccacatcctgtgcagaacctggggctctgggtggtgggaagaggcagtttcatggcggaggaggcctgggcccctgcagcctggactccatggatctggccagggactggggaggatcaggtggagagaggagcagcagagcagctgcccctcgtcccagcacaggggatgatgggagcccagggaaggcaggaccctggcttcgggcattttctctgctagaatctctcgatacctctctcccttcaccttctcctccaagtctcacccagatgatgtttctgtgagttgccatggggattctctcaccaccccccgccaacaccccgcaggggaagcttgttccaggagtcactgggcaggggctgctgctgctcttctgtgcccactcctcggatgtgccgctgcagccctggtctctggcatcggccgtcacctggtggagaggctgccggagctggccaagcagagggaggccgatggtgccacttggtgtctcctctggcatctgggcaggagacttctccccagaggccccgggctggtctgcccgtgtcacaggaggactcgcctctggtccctcagtggcctctgcaaaccctgagccagcctgggggaggctgctcagtggggaagaagcagtggccaggctctgcttggtcaccctgccctcctgtcagcctccggggctgcctcgtcgcacctgcccagggacccaacagccggtcctcacccctcccatcctcattgcagccaccctggggcattgtgaggccctgcacccagcactgccccttcaagcctcccacagggtcccgcccaggactcctgggctctgtgtccgcggggccatctagaaacactcccttgtccccccttcagcggcatagtacctgttgcccgccatctgagggaggtgcaggtgccaatccttcacgtgacgtgacgtggctcaccacagcctgtgtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgaagcctcgtgtgagggggtgagtggcccccaggcggggaggagggggtgctgtggccttcctggcccctagcctggacacatgggggtgtggggagcaggagctggggcccccagcactggccccggggctgcgatgtgggggctgctctgtgaggcaggctcagagccttagcctccagctgcagggagctgggtcttggccccatcttgcccacatcctgccaccaggagcagagagctgcagctgcacccgggctgtgggggagggatgccaggtgtatctctgggtcccgggcccagcctgcacccagcgcctgaagtaagggccaccgggcagccccggaggtcaggagggaagtggagcccgtgctgggtggctgcttaccactgggcagtgaggaaggcacctgcgctgatgagtttggaaggggtatggggatcctggggccctgggttctgggaggttcatgcccaggcccccctgggccatcccaaaagccagtcatagtggggcccacaacctgccgtgccctgccgagctcccgcaagccacttgttgatgcttctcagtccaccccatgcctctcaaccgtttcctcctagactaggtctcttcatggcgtttctgggagaattcctcagtactagcttcagatccccagtcgtctcttccactgtacgtgtgcctgaagctcaccacatcccttacttcagtccttctatttttcagtccctggattttgtattatttcttgttcatatccacctgtccttgtttcatttccgccagtcggttcagaagttctcattcttgtctacggatgccattcctttctttgcctctttggagattctaaaggtctctgaaatcattattagattactgtattaccttccttcctactggaatgaattcacctccatgttttttattctgttgcttacctttcttagccttcatatacctcttgcgctttgaaattgatttgcgactcctcttagctgagccaatgttgtggagacagggagtggcctgcagtgcctgaaactgcagggcagcagccgcctcccaggaatgtcctgggtcctttcctcctttgaggtcccctgccatatgctcagatggggccaggcacagcaacgggggcacacctccctttggcccagcagttggggtgctgccaggcctggtggaggtacttggtaaacatttgttatggaaaagcagcaggagggttctaaggctgggattctggagcccaggaacaggccaggcatggctggagcgggtccgagtccgtgcactgtgtcctgtatgttgctcttagccgcactcaggagcagatgtgcaggtcactgcctagaagctggtgggcacctccgtgcagcaggctctggggggtatagccaccatctgggcatgtgtacagagggccttgctagtgcgacatatgaggaaccagaagatgtgtgggttttgattaaatggagttttaattaaagtggccaggttgggggaggtgaggaggaaggcaggaagcagcagcagttttgagtctgaccgcgtggaatcctataaggtggttctttcaagaggcattatgcacattccgcagcatgtgtcccctgtctgtatggggcagcatctgccctctgatctgtccccaacaaggggtaatcacagagaagtattacattattaatatttaatttcccctcctggttagcaacagatgactcaaggagtaattagatgcacagagccaacagagagggataggaaattgccagatcctggccccgccccctccccggggcctctgaccttcctgtcactctgggaggcttctgagggaggggagctggaggcccaggagccttcctgctgctgtgctctctgtgcgcacggccgcagccctacaccaccttccagtgctcttggtgaggctgagagaggtcgcttcgtgcctttgggcctcagtttcctcatctgtaaaatgggcttcctgggaccagcaagatcacagatgacagtcatttcccaagctcctaagcaggctgcacaagctgtgtctgagggtccagtgcagtgcctggcctctaggcaggtgccccctgggacgcgtaaggtttggcagctcagcagtgactggcatcgtggccagctgactctgtgttgctccccagttacggtccacgacacattagtagcttgaaactgggcacaaggggagaatttacaccacagaaatcaggcaaagcctgtaagtcagggtgcccccggccaggagctgatttgccagcctacggctgggtagctcccaacctttccccaatgaatgcactcctcttcccctgtctgccccaaaggtgcctctgactccactgatctgctttgctcagggccgagaaaggcacagctgagagtggattctggcttggcaggggcccaggttgcctgtgggtccgggcaagcctcacccgggatgtgctggcagcagctgggagagcctgcaggagtgcttaaggaggggctgagggagaggacgggcagcgaggtggcctgtgtggaccctgctggcaggagccgtgggtgtctttagccccgtgtgaggccggcctgggcagaggggtctgttgctgtcactgaggctggtgggcagcaggaaggtggcttcagtatagtcaagaaggttatcggtatctagtgctgtttagcatggggacccacagcacagaaggtggggagaccctgagaacgggggtacacaggcaggtacccagggctgccagggaagccttgccaaacagaggccctggtcaggcttctcccaaactgggcatcccagctggcatggcaccagtccagcccgtgaggcaggcgccgatgatttgaccccaccagcagggctctgggtgatgggactggggagtcctccttcactttggcagacgtgttatgttccaccttgtttgcccccagcaaggcccttgaatctggagcgtggtctggggctgcatcagccttctagcctgggatggtcagattggcagaaggctgtggcatccttcaatgcagatgccctagagagggccgtggtgggaggcaggatccctgggtagaggcggctcctcagtggcccactgggcctcactggacagtcgcctgttgctgctgctggtggtgctgggcctgggagtccaccttggagccacaggccaggcacctgggtgggaggcagcccggggccagcaccagctccacttgtacctgttgggcaggggctatcgtgagtcaggtgggccctggtgagtactgctcagggagagaggccaagagcatcagggataactgtgttccttgagtgtggccagggatggtgccaggagagctggtctggtgcatccctgccaacgacacactttgtgaatggctgcctggcaagtgctccatggaaagcaggggcttgggaggactcggccctctccagctgctgcaggccctccgttgctgcagggtttctggctctgctctctccttcctcctcctgcttctgtgtcaatgctccattcccaggctcctagtaggggcaaaagggcctgctgggtgcaggagaacctccagtcccaggtatggctgcagcccgtgccaatcctgttccagccacttgaggtgccgacagcattggagttggagggaaagttggggtctgtgtgtttgagctctgtcacatggacaatggggtagaggggagcctggccctttgaacagggctcaggaccaggagtgacttcctctccaggttgccagtcctgctccatccctcatgtcctggaagagagagagagacgaggtggctgcccgagtccacgtgaaaggcagcctctgacctcttgtccccaggcaggtggtggcggctggcaacacactcatagggccccatgagggttcaggattggagggggtagatttgggggcctcttagctctcaaagaggggcaatttaacgggcagaggtccatttggatccagaccattcacaggctcgaaggggacactgggagttggggctgggctcaggcctgctggggaaccaaaacttctgcttctgaggggtgtcagtaattccattttgactctgggggagccattttaaatctgtttatttccttctcatagaatcatgggtgagagctggcatggcccctagaggtcatttggggtccagctgcctcaccgtatcaatgaggaaactgaggcccagaaaagaaaagcatttttgcccagagtccctcagtgagtcctggttccgtacctgctttctgccagggaccaaactcccgttagtcattcctggtgtcagccaggcagaggagcaggtgggggagagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggtgggtgctggtagttcctgggagagttgacgggatggagcaggccaggggggctgagaagttggcctggcgagagaaggtgggtgggactgggagagcctgggcagggaggggcctttctgggagggagtgtcatggggctggccgagatccaggacccaggagactggccaagctgccacaggaggcctgagaggctgagcatgggggggccaacactgacagactttaacaagtttctggctcccccaggaaaaaaacagaccacatctgatccttggccctgagtccagagtgggaggcaccgtgacaacaatgcgcagagcagggaatgcagggagccatggatagtgctggggtgagctggagtcctggcaggggcccagctagggcagtactcattctgcagagcctgggagaaggggctgcctccttgggaggggtttgtgtgggagtctcagcgggaattctattggaccaggggaaccagccttgctcagtgacttctctgggtgtcctcctctaaagtgagggtcaaattcccacctctctcgcctcctggctatgaccacagcagaccaggcagggcatggggctaggcggggtcaggggccatcctcaggctgacacctggcctgtgggtagggtgggatctgaaactatagggtcttcagggggccaagtgtggggtaaggggtggcactttccgcagggctcgccctctgcagatggttcagcttctcatcggctgtccctttgcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtgagcagggccggggttacatctgtgcaaaggctgttggtgcccaggctttggtctgtgcccggagccagggtgagcctgggatcagggcctggtctgcagtgtcagcatggtgagctggcgacggggccccaggctcagcaggggctccccagggccagcacgtggccagcagtcatgccgaactgactgacccctatgggcgcagggcagcctggccctcccaggcggcctgggttcccctaggctgcctgaggccaactgtgctctgctttttggcagatgagtgtggccagggtctggcattgggcttagcagggagctgtggtcccagtgacccacgtgctgccagcgggtgtgtctgggccattcctcacacacaagcaaaacttcccggatgatgctggggtggagtggggagccaggggaaaccataggacctcagagttaggagccgcccgccacctgccttcccccagatcctctgggccagccttgcagtgtgcacattaggaaaatgacccagagaggggaagtgacttggttgaatgccacagtgagtcacttggacctatatgcaaattctgttgctcctcaagtcaccaaggactcatcgtcttagaggcagccagtgtgctcaggggctggctgttggaggggatttttatggtgaatcttttgtgaagtgacttcagccaagtaattgtgcaaatgaagattttcccagaggctgaattactcggcatggattccacctacccaggccatagatgaggctagaaagtgcatccctcccttggggacgtcagaggccttctgccccacctcctggcccctctgccacagagctgggttccacagcctgggtggttgtgggccctgaggccatgtatgaggcttgaggtggtgcctcttgagagtcagggagcagggtgcaccatctctgcggtgaattatctgaaactggtgggtgcctatctaaagaggaagccacagcaggttgagggtgccccagcaggaaggaggacccagctagatgagcaaatggaaatttagagcgtcaaagccaaggggcccttagaggtcatttcctctcatcttcgggatggaaaatgagcctcagagaagacagccagctgtttccgggccacacaacgagttggtagtggagctggggcgagtcctggaaagaaatgtggcctgatccccactgtgacttcagtcactggggagcggtcatgagcagcctgtctcgcagagcctgcaccaggtggctgtccctgtcacctgggctctaagtgggagcaggagctgcactgggctgctccagggaaggggaggaatctggacctcacactgccctgtcagatgctctctatcccaggagagtctagaaccctcggcaaaggagaaggggaccctggccagccctgagaggggtggaattagggattgtcggactccaagtgcagtctctggtgagcctccatccattgctctgcgacgggcagagcagagtttaggttcgtccagtggcagctcagaacacggaggcccaggaggggccctgtctgcaggtgcccaggtgggccagagaacaaagcactggaggggacttcagggaaccaagctgagtctgcacactgatgggatgctctatggggaagcagaggccaagctctcacttttttctctgattcaaagggtatgatcagggctgccgttctcaatttaaaggagctcgactttttttctcttttgtctctccctttccttctctgttttctgagagttgagagaatgactccctatgtagtaggacaggatgtgctgtgtggctatggaaagttagctgcctctctctgggcccatttcctcatccataaaataggacaagtctctctgcccctctgagctcacaaaggtgttctgaaggtccagtgagtggatggggtgacagggaccctgaggagggttggaggcgtggggagggtggggattcagatctttgggttcagagccatggacctgccccctatcctctacccatctcatcccaacttccttggagctggaccttagttccacccagaccttgagccatttgactctgctccatgaggctctgcaaggcttaggctggtctcttctgcagggggccctggagaggatgacgacgatgatgttcatcctcccttgagggcagagagctttgcagttgccaaaggatgtcagctcagcatctcctgtcatcctcttggcctgcattgtggccaggcggatgttctgaccctcctgttactcacaaactcatggggaggccagagcagggaaggacatacgagtgtctcctgatgtggatggactccagggcccttcaggctgttcctggcccgcaggtcccttcgctttcctgttcctcagggcccctgggcctctgggcatgtggaggtgtccatgtgggctcccgagagcaagcggggtatgaaaggaacttggtgacactcctggccggcgctggagtcacagcctgcctcaggatcctccctcctcctttctcagctgggaatccagcctcctctacgtgccgtttcctgctccactcagaaaggtccattcggctagccctgggtctagcctcaggcctgccccactctccattaactttttttttaaaaaaaagaactcagttttggaaaaatctgttattttccaagttcagggaacctgttgggctagcacagggcctagtcgaggaactctgtgagaaagacttcaggccagaggcagagatgtagctctctgtgttcccagaggatagggaattcagggtgagagacacaggcttctttttccagttcccaggggatttttgcctcactgtcccctccctggctctcacagcagcccttggtggatgttctcgctggtttgaggaacaggccaaggtgcaggtggcagctggtggtgaggcccgaagtcctaacacttctaagagggcaggattgggagagagggctccctggaggaggtgtcacccagtgggtcttgcaggacgggcaggcagggtctcactggcatgagtgtgggggcaggtgtgtcaggaggggggcaaagcctgggacaagaccctgaggaaggaatgagcatgtgagcactgggtagggaagggtggcctggctgcctagtgacagagagagatgaacagagtgggcaggaaaggtggaggccaagtcaggcctgttcgtaccaggggaaggaatggaggtttccctgtgggtccatggctcttcaattcttggatcaatgactcctttggacaacttaggaaggctccacctactcctcaggttgggacatgtgcacataaagccccagctggaatcatggggcatattcttggaccatagggtgagcccccagtgtgggtaatggagatccccagaaaggggcagcctgcaagccgggggacacagagctgcagagggcacctccacaaagggtgggcagcagctctgggacccacattctctgacatgcctgggcaccccagagtggtggtgtgtcacgctagacagccttggcatcccttccagctggatggtcaatgtttggggtctaagacggcaagatgtgagtgtgttggtcacagatgcagcccaggatatgctgctgggcctggctgaggctcagctgtgattccatttgggccctgatgctgtccccaccccgtgggcaccagggtccagggctctcagcctatggagatttcttttgaataaacttagtctatttgcaatttaagaaaaaaaaaagtcatgttttgcccactctaaaacattaaaaaggaacaaaagagtatagtatagtagaaagttgtcctccataccccctgtcccccaccctcagttccctgcctgcaaggccatgttaagaatccttccagagatattctttgcatatataagcaagtgctattaatgtatgttttgtttctgtccccacacgggactttctttgcagagtacggtggaagactccccttgtgggttcccttttctgtacaagtcaacaattggacagaccagggatttccatactgtgttcccagaagccttcgggttggctctggtgtccccaccaattcactgattcaataaacatttaataagccccttcccttccccagcagcttcacctctgtgactgcctgggaatgtgggcgacaaggtttgctgctgagaacagtttgaaaaccagcaaagcaggtggcccagggcccaggcagctctgcaacacccctgtggctgcttggctctgctctgttgcctcaaatgacaggaaactcactattgcctgaggcaggccatctctcctgtgaacagctcagctgaaaaactcttaacctaccctgagttacaatctgcctccctataatttccacccactgattctccattctgcccttagagggcagagtgctgacaggtccacgacttggtcccattttacaaatgaagaaactgaggctcagagagacaaagttttaaaacattcctgttaacagggccagaacccaggaagggatatgcttttctcaggaataatgtcaaaattaatatagcttcccagtcaatgaggactatataaattactatttgcaaagcactaagaacagtgtccggcacagagtcagtgctatgtaatgtagatgtgagaatgagagagcctgagattttatgtttgcgagtcccacaggaggcagggcaatgccaactccctgttgcttggaagcaatgggcaagtctatgaccctcctgttgaggccctgttacaggtaaccaagcccccacggaatggagctgaggagctcctgagaatgggcttgtccggttactgtttggattcagaactgacctaagagattcagaacagacagactcgccttggcctgagttgcctctgggctcttggaatgtccacagcaagtccattcctctccttgggcctcaatttacccacctgtaaaacaagaggattggaccacataagagatcggaagccaccagggtttctctttttctcttttatttgaattagttgacaaaacttaaatcttgggagattttacccagaaaatcatctccccagccccacctgagatctggtaatagcaggcgtacgttttgcatggcgctgaagaccaggtaaacgccccaccagctgcctcctgtgtgtgctacctataggcgcctgtttgctacccgtgaatgagatggtttctgtggatgttcccagctccgcagttaagtagagcacatccttccccttgcacctttttttttttttttttttttttttttttggagactgagtcttgctctgtctcccaggctggagtgcagtggcgcgatcttggctcactgcaagctctgcctcctgggttcacaccattctcctgcctgtctcccaagtagctgggattacaggcccccgccaccacggccggctagttttttttatttttagtagagacaaggtttctccatctcctgacctcgtgatccgcctgcctcggcctcccaaagtgctgggattacaggtgtgagccactgcgcccggcctccttgcaccttctgagtgtccctgtctcggagctggcaatgcagagatggatgtaggaaagccctgcccccgaggggcccagatgtggtggggatctgctgcacttcggtaggaaacttctttgagatctctatcctggacttgaaggatgggtagggtttctgccaggtagaggggagtgtagtctggtcttgccagaatcaaaactgttaaacagaagtcatccctcagtgatcatcaaggttgccttcctaaattagggagactttttttttttattgtccattctttcatgaaatctaggccacctttcctacagggctgaggtctgcttactggctggcagatccagccatttcccgagtatgagactgggagtcggtaggcttggatttctgtctggctctcactcaggaagactgagtgatttcgggcagattactgtccccctggacctcagtatttccttgcaaatgttaagatggccatgtaaatgttaacaagtaattctctcatttctctccagagggctgtgggtgggtttggaggggagaaatggcatctcctttggcctgggacctcctcccctcttttaccctccatgctgcctctcctcaagggcttctggagtccccaagtcaaatggcaaatggggaagagaagacagggtatggagtacaagaggcctagatcctctataggtctgatctggctggtgctgcccctagccagtaaagccaccctccagaccccttcaagcctgttgtagccttaaccaagatcaaccaacatggaggtgactgatcttggttaaggctgcgaccaacatggaggtaattgatcttggttaaggctacgacacgtttccctttagagaaaaatcatgttttccccctcaaaaaatcatgcgttaatttcctccaaccaaactaagtcccaggactactccgaaaactactcaatgaccatctgggcatttgtacatgggtttccatttcttggatgcctgctctcctgttacctcccagaagcctgtgaaaaaggcaaggcatattacttccacttaacggaagaggatgctggggcgaggtggcaggaaatgactggtccaagaccttacagtcaggaaatgtggaaacgggtgctgctctggggttctgaactcttggccctgcttaaccctggcttctcagatctctgatgctggtctcttctccccaggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaa

SEQ ID NO: 92 - DNA, 30238 bp, Homo sapiens
ccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagttagtttctatattagaaagtaatgaagctgctttgtctttaagagagttctttatttagtgcggcctcctctagttccctctggcctcccagaagtccctaggaaatctgatgctgtgcagccttccttgtagtgtgggggactgcaaataggtgggacagtttgaggctgaggggaactgaagtctaaacttgaagtctaaacctgtccgatgggttgagctgatctgagtgcagggcaggatggagggctatggggctgtagggtatgaagtggctcatttcaagggagtattttgggtgagtacattttcctgatatctggagttcttgagattaagcactaacacttagggtaactgttgaccgtggaaatttacatacgtcaccgtcagcttactggagtatcctgatgtgaatgaaattttccttcatgactttgggtcagccctgtggacctcagtttttgttctgaggggttgtatggcaaggggacgctggcgggagagagcttcgttcctgcattaagtggcctcagtgatgcagtcagggtcccatgactgacctttggagttcttccatgtccttatggcattactggtggtttctcctgcctgcagtaagctttccagcttactctagactcctgtgctgtgagacatgagcttgtcagaggtaaggagcctgtgttaatgcaagtctcaggtgagaaggggtgttggaatctgaggaccctgttttccttcctgtcccctcttcagctctgtccaggcaccacccgatggagggttggctgaatgtctcatgttcatatacctgacagctggcttcggtgctttaatatttatggaaaggacagttatagaagtgtggtcccttcaaagtagtcctctggggtgtctgtgtccttattaggttgacttctgaaacttcctgtgagaattccatcattaaactttggctttctctggaggggtaaatctttgttctttggagtaggatttgagtttgacaaggagctggacaatgctgtttggagtcagagatgcagtgtgataagagagctgtgagttggaattccacagcacctaaagagactcctagaaaatgttgtagaacaagtggctggatggtacttggttgcacatacggggtttggggtctgtgcagaaaaatgaccaaatccaagcagcctctgagattatgaccacatgggggctgttaagctgtggatctgagtcatagggtcagggaaagaggaaaaatggcaaggaggatgacgttactgcccatgagcttatcctctgagtgggtggcgacttctcattgtccttttcccacatccccagggcaggagtgttagggaagtccaccagcaaaagggggagggcacacccagggcctaggggagggggagaggggtgaggactggtccacatgatttttgagaaattgcctttggtcttgttggctcagaatggaccccacacctggaagggggccacgtgtacagttatgcaacccttgcctgccacccccagttctaccgcccttgcagtgtgccagataggagcattgggttttcaggtttgggagtgggtagggttgtgctggaggctaaatagacattatctcatgtaatcctcatagtaatcctatgaggtagggtatcattaacaccattgtacagttggggaaactgaggcccagaaagggtaagtcacatgcccaaagacacacagccggcaaatggtggagctgggctgttgtctgcttccagaactggctttttctgctgctctggaggtaggcacaggttttacccctctttctggagcccggtaagatgtgccaagggtctccttagtaagtcagggaagactcatctggggaaccagagaaggggcaggcctgacctgggtgacccagtgactagtggccttcacagcatagtcagggcctttgctgagagttcttctcttccagagccctggactttatcatgctggggcttccaggagttccccctccaccctccagttctgaccagtgctcccagccagctgccccctttctccctttctttctctttgtggtccagagaatgaatgcctgctccacacaccttatgccattgggaatctgaccttctctaggcatagggagcttaatctgcgggaagtggagtgagaagcatttcttgctgggagccttggagcagggagagatactgtctctgggaggcaggggtcccaagttaccctagaggcaatgcaggctcctaggaactggggctgccttgtgggagacattggaatgtgtccctgtgggaatgctctgtgctaggggctatggcagcaggacggtaggagctcatggtacttggaactgtgaccaagcatctgcgaagaggaaggggcccaggaccactagaatgagtcagagccagagatggagtcgagttgtgcatttgctactttggagctggggcactgatagggctctaggtgaaaagtagggatacagaaggagtaatggtcccagaggcccagatgtgtggcctgacagaggaggtcttggccagggagagtggggtaggggcaaagtgttcgctcagtgcagaggccccatctaggaggccttgtccccatgcttgcggcaataataacagcaataataataattattactgcagttttggtactgggcactttcctaagtcctctctctctattgtcttattttattctcacagcagccctgtggggtagggattgttacccccattttagagatttggaattgggtctcaaataggttaagtcatttaaacttggtcatgtgttcagcaaggcatcggtgtcaggattgaaacccaaggctgctggcttctgagctcatgctgtaccctgggcaggcaaggcagcctggtgattccattcaataagtgaggaagagagataggagcatcagctggctcttagtcacttctgctggtggctgataattgagtgtgggcccttggccagccggccaccactctgggtccagatttccatctgtacaatgggcctggagctaggcgctggaccaggtgtaccgtaagaggccttctagctctgaggactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccagtgtctgacccgaaatctgcgctctgatgtggtctcatgtgctctcatccctttccttcctctccctattctccttgttgccatcccttcttttggctggacctcctctgggcccaatgtagctttcacttttttcagggctctgtgcctcctgtgtgtgtgtgtgtgtgtgtgtgtgtgtgtgtgtgtgtgtacacatttccacatgcatgtataggtcagttttgcagcccctgcacatgcctctagttccagggagaccttagccctgctttgctggccagccctgatgacatactactgtcctgactcacacagaaatcgcttggagaggaagaactgattcctgctcttgggtgggatcacgggactggggagtggtgcccagtggacagccttgaacataaaaggcccaaactgactcagattatcaggaaaaaggaaggcaaacagggaggctgttcccagggaactctagggaccctcccatctcttttctgaggctgctgcccatttatagagcacctagtattaactaggtcagttttgataattttgctcattgagtcctataatcatcctatgagggtaaggtttataatccccattttacaaatgagcaaactgaggctcagagaggatattttcataaagtttcattactaggaagtgacagagtctggatttgaacctgtctctccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctatccatctctctatctaaacacacatgcattcattcgttcactcattgaatcgtgcattgagaacccattatgtgccaagccattgctagaattaaggatgcaatagttaaataaagcagatgtggttccttctcagggaggttctcatatatcatgaagaaaacagactgggtgcaatgaatgacagggtccttcttagagtggcagatctcttacctggcttttctgtcaaggtgaccctcagaatatggaggtgttaccttttatcttagtccatgttttactgctataacagaataccacagcctgggtaatatataaagaaaaaaaggttatttggcttgtagttctggagactgggaagtccaagggcatggtgctggcatctggcgagggccttcttgctgcattatcctattgtggaagggcatgtgagcgtgcagtacagacagtatgggggcagcacttacgcttttatcaggagcccacttttcctgtgataacagcattaatctcttcacttcttacaggccccacctcttaatactgttacagtggcaattaaatttcaacatgagtcttaaagcacccatgtcatctaggaagaagaaactgtatttgcagcaacactgtgaggtaggaaagggagtcctatgttgtaggaactggaagcagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacatttaagaaaaaaaaaaaagacttgtttaagtacctaggcagtctatgtgtgcagcttgcttcaggaataggggcttaaatgatggttttagggctctatatccttctagcttccatctctgcctctgttcatttgtttggatcaattctttagattgttggtagcagacacatttattgctaacagtcccagaccgtatccttcttagtaatctcaacaagaaagagtcttttttgatggctgcagcagcaaggctctggggaagtctctgattgggtgtggcttggcttacagctcattctcgaactaatcactgagtgggggcagggcaggtttctccatgagccaggtcttgtaacatgcccaggccctaggctgggaggacagctccaccagtacagcatggactgggctccctgcaggagtgcggagccttgctaccagaaggggccagcatagaccaagagaagggcactgtagaataaaggacatggagcaaaataactgtgttaagactagctaccaaagacggagacgatctgctcggcattgaatttgcctctttgtcaaggaaagaaggagcagaagatgttaagaaggaattgaagtttaggccatacggggaggtgctcatctgttttaactgtatttgtcttctggcccctgggattgcctgtcctggtgtggggtgaacttggagacagaatctctgagaagctgtcagggatatttcaggccagtctagggtagaagagggttggacacgtgggtcacagtattccacagtttcctgctgtgcacagattcaatccgagtccccatctacgtccctcactacctcccttgcctcctctcctgagtctcagcctctcctggagtcccatcttcccagaatatgctgtggacatctcctcttctgtgacttttcatgctgtcccctccgccagatagccgagatgtctcctcctctgtgcagtccttactgagcctccccagcccccagtgaatggcttgaccctttcatccaggtttaagcctactgcctcgtccattcccacaataccttgtataaatgtgtaccaaaaaactggtcatattctattttaatgatatatttgtttcctaaaccttttttctatttttaatatgaaaatgtgggattttaaatatgccatttagcagctctgtaatcttgagcaagttattaaatctctccatccctgaatttactcctcggtgaaataggataataatagtacctacttcacagaattgttgggaagcttaaatgagttaatatgtgtaaaagcatttagaacagagcctggtgcatggctttcaacaaaactggcctatgttattattatttgataaaagcaaaataatatatataacatgggtaacttttgaagcataataataaacatacctcccaacttgagaatgagaacccctgtagttgaatatttatatgtacgattcttcatctccattcatattgcatgcatggccaatgcctggcatgtggatcatgaataagcatttgttgaatgaataaatgaacaaatgccagaagacttgagacagggaaataaccagttttatggggaagatggtagattatgggaacaacagatcgataatcttgttcttaatccttgacaaagtcctggaaccaatgagcacttgaagaagagcccactagtaggcacttgcatggcttcactggggttttgaaaatgcacttcttttcttgttcttctccagttgattggtccccagccagaagcagtgaagcttctcatgacagccctggggatgagatgggtagatgggagctgggtagcagcacaggtaggaacactcctaaccccggtgtactgaatggtggatggacattgatcatccagggacagatggtgctgtgggctttcctattcctgtcctctccctgaggaccttgatgacacccagacaccagcagagagaggagagtaaccttttcagatgatattcattcattctttttttaatccaccaacaaattattgagcattgtctatgcaccagaacagtcaaaagagtacttcaaaagatcacgacagggttacacagcattgtaaatatagttaatgctgccgacttatacacttaaacctggataaaatggccaacttcatgttatatatattttacaacaatgaaaaaaatgttgtggcagttggaggaatggactcagtttaactgggtgaaatggaatagtaacaaatgaaatatcctgtaaaactcctccccattctgaactccatcagaagaggatggcagaggtgtggattagcagcaatgagtgtgagtgacttctgatggttggctacagatttgatagtctgttattttgggttattttggtgaatggtgtgacatggctgctcaatggtgacttcgtcaaggaagatcaaatacttgcagggctttgataaggaagggggcagactcattctgtgtggtccaaggggtcacatgaggactgttgtgggctgtattgggagacaaatttgggctaagtataaggtagagcttctcaccgatgaacgctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtccctctgttctgagctgcagctcagtgtgtctgggagtccataggacattttggtgtggatgatccatagtcgagctcagtaggaactgatcttccccctccacgtgcttcatctccaggtctccttgttatgtgtgtccatgtttgcccattgctcaagccttcagtgccctcttgacaccttcagcccctccctcaatacaaacagtccccaagcctggtcacttctacccttgacatttgtccaaagctgggctcaggcatcactcggtgactctgatgagatagtctcctgttcgtattttgagatacctattttagatgtggtttccttttgtggctctgagcagtggcaatgctcatcgggtacggagacggggaagagaaggagggaaagtaagggtgggatggctccttagttagttcagatgctgtaagaaaggcccaaaatagcaatgacttatgctggaagagatgtttatttctcacccatgtgaccatctgggtatatccagggctgatactacagtccctcagggttcttctgtctgctgctctgccgtcctcagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagtaaggctgggatctgcagtcgttagctgagtggccgtgtgcctaactaaaaatgctatggaagaaggggagagctgggtgtgctggcagcacctgtagtccctgttactcgggaggctgaggcaggaggatcacttgagcccaggagttacaagggtgcagtgggttctgattgcaccactgaactatgatggtaccactccagcctgggtgacagagcgggaccctgtctcttaaaaagggagaaaatgggtgtaagtggacaacaactagcagtttctgccacagtcactttgtgcatttcagtgggaactgtgtggctgtgaactggttaagccttaaggatatagtccctgaaagcttcaagtactgataaagttccactagcatccacaaagcttttcttttataggtaggaacactgagctcagagaagttgcctagttaagattgcataacaaagtgtcagagctgggaccagaaccccacactttgggctcattttctagaattccagggtgatctggctgaggggcagacaggcagtgtcaggaggacgggtctctggagttcaggaaagggttacctttcccagcgcggctacctggggagctgctcatgacttttcagggatcatctctggggttatcatgcctctgaggtgcctccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgggtgccgtggactcttctggtctctttgcttctgggctgtcaaactgcttctctccagggcaggtttccaggatccagagtctaggaaaggaatgaaagggagcaagtccagggcgcagccctggaagtccctcatcttccctctggagggaagcgcagctcggccctgggagagcctgggtaggtctgatcaggggaggtgccctctgctccctgtacctgcccagagtggcaggaattagcctgatatatgaaggagacaattatatgaagagtcttgagtaccaggcagaggaatggggtctgacttctatagtgaatggggagccatgggaagttcttgagcaggggagggacatgagcagattcctgtcttaggtcctaagagaaggcaccttagagaatggggctggcagggaaagagaggagcaagcagggccagtgaggggggtgatgggtcagggtgggagatggaagcttgagaagcagtgtggagagtgagggaggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggccaggatgcacatggtttggctgagggactcccttggcccagctgctgggggtgtgtgtgtgtaggagtggagggtggcggggggcgggtgtgcctggctgggattggaaggattgaggctgggcgcctggaatggaattgaggctagcagctgttgatgaggtttgctccgtggaagggtggaaaggtgtagcagaattggactctttttggctgtgctgactggcaaattacttgacattaacaaagtcacttatctgggctttaatttttttttttttttttttgagacagagtcttgcagtatcgcccagactggagtacagtggcgcgatttccactcactacaacctccgcctcctgggttcaagcaattctcctgcctcagcctcctgagtagctggtattacaggcctgagccaccacgcccagctaatgtttatatttttagtagacacagggtttcaccatgttggtcaggctggtctcaaactcctgacctcgtgatccacccacctcggcctcccaaagtgctgggattacaggcatgagccaccacacccagccatgggctttaattttttaaagtcctgcaaaaataggaccaagtgttacagcctatctcccagggtattaggaggacgtgaaatcatttctattcttgttgatcagtgttggttggcatagatgtggcttgatcaggacatggcacaaatgtttaggcagcagctgtgggactcagggacaaggtgtgtgcagcctggagggtggctgggattgggagcagggctggatttagggatgtctgcccttctcatccccagctcaggcctgacctgcagccacagacttgcctcttactcagtcctgactccagccttgaggtcatccccaagtccttgcctcttccacttctgatctgtcttggtcactcaatacagatgtgttaagctagcaaatgttctctctctgcattcccacactcatacacctagtcgcctcctaaaactctgtcctagaagcttctttgcaaatactgctgatttcacacaagctatactgaacccttccattttctctgcctcagtgaatgctccaccctgtcactgaggctcaaaaccacggccaacctgactgctctttctctctacccaagtcctcagatactgtcacttttacccagacatgctttgtctcctgtctggcccttcatttattccaccactataccttcctacagggatggctatattagcctctttttttatttttattttttgagatcgagtctggctctgtcacccagtctggagtgcagtggtgcaatcttggcttactgcaacctctgcctcctgggttctagcaattctcctgcctcaccctcccaagtagctgggattacaggtgcccaccaccatgcccagctaattatttgtatttttagtagagatggggtttcaccatgttgttcaaaccggtcacaaactcctgacttcaagtgattcgcctgcctcagcctcccaaagtgctgggattacaggcatgagccactgcactcagcctgaaatagcctcttaactggcctctcccttgccctgatacaatccagtctatgctgaggagctagagtgggttttaaacattgttacctagattatgtgtgattaaaatgctccccagtgattcccattactcatagaaaaacccaaattcctcactggtctctcaaagccctgcttgatctggctgaaacataccctcccatcagatagcgggtggaggtgctgtcagattaatcttcatgaagctcagctctgaccgtgtatttcccttattcaggaagcttcagtggctctcaactgcctttaggatacatttcacacctgtcagcccatctctaagtctggcccccacaggagctcctgctctgccctaccagctactgtctgccaaattgatctgcacacatcctagccccagagcaagccaaccttgccttcacttgccgccttgcctcctcttccttatatttggatactaacatcttagctgaaagggtggatcccagctgccccctaccccatcttccctgtcaggcctccccagggactccctgccaagcatctgtcaccaagattcctcagcagggggcccggtgggatatgggaatgaggacctcccagtgggcagttgcagccttccccactctggtccaggagagatgaggcaagagatggtctggggagaacctttggagacaaaggccttgcgtcctctttctcccaggcaggggcagccttccaccacggggagcccagctgtcagccgcctcacaggaagatgctgcgtcggcggggcagccctggcatgggtgtgcatgtgggtgcagccctgggagcactgtggttctgcctcacaggtgagggtagcagcatggggacgggaggggagggacagtgattgtggcagttggggagggggtgcccacgcctgttaggggtcctgccaagccagctctggctagcagggccataccttacttccacctgtgggatccagtaggcaactcacgttactgttcttagcctccatttccttgtctgtaaaatgggaacatgagtgctaaatgagatcgtgctatttcttgaatacactgtgtgcgccccctcccaggacctttccacttgctctttcctctgcctggaactttctgcccctaaacgtctgcatgactggatcccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagcaagtcctgttgattccctcctaaataaaccttgaatctgatccctctcttcttctctactaccaccctttgaagccacaccaccctcacctcttacagggacagctgaaaccgcccctaactggcctcccccttgccctgccacagtccagtctccacagaggagctagagtgagttttaagcattgctactcagattatgcgtgattaaaacactccccagtgattcccattactcatagaaaaagttagattcctcactggtctcttcaagtcatctttggtctgggtgggacatgccctcccatcagatgtgtctgccacactggacgctccccgatattttcacacagcaaggccagtcttgcctcagggccttccacctgctgtttcctctacggggttctctgtatgtcagctctttttcattccctataaatttcagcttaattgctttaaagagcatgtgcctcaccaccatatttaaaggtacgggtattctttcttgtataaaaacaaatcgtgtttcgttaggaaaagaaaaaaaaagaaaaaaagaaaaagcacttgtgattctctctcctccagagaaaccactattgacatttttggtggatacttttttggactccccaatttataacattacttacgctcatggggaaatgcacatggtgcaggcaggtgtaaagtacctgccagatttttgaaaagctgttgctttacttactaacctgctggctccttttcctcacataccttagtcacatgctgacgagaatctgtgtgcccatttgtctctctctcccattaaaatgtaagttctgtggggatgtgaccgtagtattgctctctgttgcatttctgacttttatgcttggcacctgtaggtgctgactatattcttgactgaatgaggtcctaagacaataaattactttgggtctcaggcctaaaaggaggggtggacagggcctggggttagcaggggcagggagcgggactagggaggcccacccctcctcagtcccccttatatgttctccactccccctacccccaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggtgagcaccaggagggggacgccttccccttagttcaccctccattccccctgcagcccaccccctgctgcaccactgctcccagaaccccagtgctgattcctgtactcagccccatgcatccttttcgtcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccggtgagcaccaggagggcgacgccttccccttggttcaccctccattccctctgcagcccaccctctgctgcaccactgctcccagaaccccagtgctgattcctgtactcagccccatgcatccttttcctcccctgccattgccctgcccttgacccctgccctctgtcacctccagctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacaggtaagggcagatgaacagctggggaaggacggagcgagtaactccctctttactggaccctaacgtggaatttccataggtttgggtggccagaagactttcaaaatccctttcatagacttcaggtgctcacactcttccccacaagtccttaagggactcgagctgataagaaccatttataatgtttgccttcctaagagtgcttttcgtggcacttatgcttcttatgcagaggacaaggtacctgcccgaaatttggaggcatgggcaggaattctggggcagccacaaggtgtggcccaggggacttggtgtgggtgtgctttccagcaggaactcctctgagtggtaggaaggtattctgggtcagtgggcgccatctgattctgaagcctgagtgacagctggccctccctagttagtccccaacacctgagtcaacgtcagctcttcttcctgcagacttgcgctccacccaggcagccgttggatgggcaggggctgtctctgctgcccccgtgtggtcaaacaccagatagaggccacccctttagtgattgttagtctctggtttccaggttctagcctcgtgggcacctcttgtgcctgagggtgtgaagagggttgaggtcaagagccgcagtctccatctgtgtttggccctgagaggcctctggtcagtcacttcctgggccgacgtgctcagtctggctcttcagtatctctccctggccaactgagctttcccagggacctcgccctggtgcacagtgaggtcaggacagcaggttttgtctgtctggttctcctcttgtcttctgatgacttccatctgcccctcagcccatccaagttctgatctcaccccaagtttccaggtctgcatgcacctcaggactcacttattcctgtcctctccctcttgagacctatgtggtccccacttctgacaagctcggagccagggcccgtcacatcgtctgcttggagttcaggctcactcctccttctctcttacgtgtttccttctggcaaggttgtgctccttctgcccaccccttccccaagatggaaaacactcccttcctgtgctctccaggagagagtagctgccctgagctcttgaatgttctgagacatgtccttgaccttttagagaacagcatatggtttggtggtgaaaatgctgttcacaggcgaaaagaagaaatagaagatagagtgatcttggcagaggatatgaagctttcagaggagggagggtggtagtgaggacacctccaggggcaaatgggagctgagaaggccttgaaggataaggggtctttgtggtcatttgcaccctgggctgagctggatatttgcgatgctgtgcagaaaggacttatgagtataaatgtgattgcaaagagaatgtttatctcacctaagagaaaattctctattttaaacttgagtagctaacatttaaagtgatttcaaaaaaatttagggctgggcatggtggctcacacctgtaatcccagcactttgggaggccaaggcgggtggatcacttgaggtcaggagttcgagaccagcctgatcagcatggtgaaaccctgtctctactgaaaacacaaaaattagctgggcgtggtggcatgcacctgtggtcccagctacttgggaggctggggcaagagaattgcttgaacctgggaggcggaggttgcagtgagccgagacagtgtcactgcactccagcctgggtgacagagcaagacactgtctcaaaaaataaataaaataaaaataaagtgatttcattgaggccattgttgccaagcacatttcacagacgaagaaactgaggtccacagagaagggggaactttcccaaggtcacagactggcacagcggctctcaatctttgggggtcagacccttctttgaaaattggataaatgatcaatgcagcagtttgcacataactctggagggttcgctgcctctctaaactcctccgtgggtctgtagacctgggctccagtgccctgcagtgaggagatgagccatgatcagaatccaactttggcctctcagcctaatttcctctccttcccaccagccagcctcctgtttctgttagagcaggtctggcctactttggagcccttggcctgtattttgcttcgggcagctttgtatcatgtcaaacattctgggattcagactttcagtcctccagctggtctctcccgtacctgatgaagttagtgaagttgtgtgctgtgcagagcctcttggagggggatttatggagcaagccctagagacgtggcctgagcctgtcctttcttgggtgaacagggcaaatgtaatttgtgttccagggacaccaccagttaagggggaacatagagaccctctgcttgagtatttccatggctctgccccctcctctgctgtcagagccccatgatgggatttccagggtggttattgttttttaatgtgtgctctgtggatgggccctcttggccacatcagctgctgccctccttttctgcacacctctcttcatcactggggtgatggatccctgtgcttccaatggccagagcagcagttttgccagcagtgcctattgaaggtgacatctgcagatccatgcacgaggtgcatctatgctggggtctctgccgccaaagggtccatagcaccgcgcactgcactgacagggcctcctgcagaagctgctgaggccctgggtgtgcatcgtctccagacagcaaaggaaagcagcactgtcttttgtcaggcttttcctctcaagacttctccctaggacccagctgggtgcaggggctgggctagaggatggtatgtaagatggagtcacacaggctgtgctcagaacagctcctggccctacccagctttgggtcctcaacttcatccctcttgacgtgacagctctaagaggaggggcctcagtgtttcatgttaatatccccctggcaaggcccctgcagacctacctgactccttggggaaactccaagccctcactccagccccgtcagtgacctcatctgtatgtaggactcagcgaacattttctgtaaatggccagggagtaaatgtttttaggcatcgtgggccacacaccatctctgttgctgctgcttctccttctgttcctcctccgccttcccccatctttttttggtaaccctttacaaatgtaaaaaccatcactagtttgtggactgtacaaaaacaggccacaagccagctttggcccatgggctgtagtttgctgccttctgatccatagaatgggagatgtcaccaggtagggctgaagcagtcaaaagagggcctctggaggaggtgaatattgagctaagcagagaatttgggaaactgatagcattagtgcagaggctggaaggagccagttgcttctggagagaatggttaggacaccagtttggctgaagctgaggctcctacagtagaattagaaaacttaggggagggtaagcagcagccaacttctagaggtccttgaatcacgcttgaagcttgaagcattattctaaagtcactagggagccatagaaggtacttgagcatcaattcaaccacaggctcttcagcccttcctggttgaggcgtgtccacatcagccagggttgtatcagggtttggggagtgtatggcgaagggactgtaggaacttaagtgagctttattcatagtgttagggcccagtgagggtgggagcccctgttcacacttggagccaatggtgctgtcctccgggacatggggccaggcatgacagtctcactgttgctacttttcctctcagggcagcctatgacattccccccagaggccctgtgggtgaccgtggggctgtctgtctgtctcattgcactgctggtggccctggctttcgtgtgctggagaaagatcaaacagagctgtgaggaggagaatgcaggtgagtgtgtgtgtatgtgtgtgcgtgcgcatgcacacttatgtgtcttggggtatgttgctgtctttgatgtcaatagagtgtcactttctagtgacagaacgagtgtgtgtgtgcagatggggctggatttgtctgtgtgtgaccttgagtctacgtcttgtgtgtgtgaacaagcgtgagcctgtctgtccatgtgcagataccacaggatgaatgtggatgagtgtgactggaaggtggtgggagtgtaaggccaagtgctacaaagggatgagtgtgtgccaacaagtgtgcctgtgaaagtgtaagtcagtcacgtgtgtgtgagagagcaggccagagcatggaagctgtgcggcacaaatgtaggcatgccaggggcgtgcatggcactgggggtgatcgtgcctgccttggagtgagtttgaagcagctgccatttgcggggctgagggtcagcccgagctggcattggtgactggtaagtgggtgagaggacattggtgggtggtgagttgaccctggtgggtaaacagatgcatgagagtagatgggtagtcagaggctggggatggctggaggttgggaaggagagggaagaagagtggtcagttggcagataggtgagtacttgtgaggtagacaggtggaaggatgagcaggtagacggctggttggttacatctgttggaggttgatggttggcagggctactgagcgagcggatgggtgaggtgatgggtgggtgggctggtggagggtaggtggatggtctttggctgggtgtgtggcgggggctccaggttgagtggatggtctttggctgggtgagtggtgggctccaggctgggtggatggtccttgactgggtaagtggtgcactccaggctgggtggatggtctttggctgggtgagtggtgggggcgccaggctgggtagtttttggctgggtgagtggtgggctccaggctgggagccccttcatgttgtcacaggctcggctctgctgtgctctgctctcgggctctaacccgtgtctagcatttggtccgcaggtcaggcccactcaggccctgttcaccagcttcctgcactctcaggtgggaaagtgctggcatgaaaatgggcttgcaaaagatttttgtttattctgagttcttgcctttgcaggagctgaggaccaggatggggagggagaaggctccaagacaggtgagtctgaacttggagctggccctcttggctgggagagggacatatgggaaaggagagaggactctaggatctggaggggccagatttgctgtaaggtttgaatgaaatgtgttctgtggactcagacctccccaccccggtgagtctgctctttgcccagagttaggcaggaagtggatcacccagttccctcccaggtgtggcttcatttctcctgccaacctttacccatctgccagggccgattccacctgattggccccacaccgtggagtctggtggcttcctaggggtgggagcaggggctccggagatagggagtctgggtttaagttcctgctccatctcaggtaaacagagtggccttgagcaagatgctttgcctctctggcttcggtttcctcttatgtaaaatgaggataatcacagattcataggttgtttgaattattaattgagataatgtatataaaggacctagtatcatatctagtgccaagtgcttaatactctggagtcctattactattaggcaaacagcttaagacaatactgttctagttacagactgtgtagctttgggcaaggtgccttgctcctctgggcatcagtttcccatctgtaaaatgtcatcctgaccctgccctgatggcaccagagggctgttttgaagctctttcaggtgactggagagggaggtacttgcaaaggacataggagcatggcacagtaagctgggggcccagcttgggtgggtgccaaggcactggtgcccatggccgactcccaggggatcctgggctgggagaggcaggtttccgctgagccatttgggatggttccagttaatgccagttccctccccacccccgcagaaggaagggcaggagattgacacttggggactgctataaattatgccaattaattctttgcctgttggtgcccagcgtggcaggcgtagagacagctctgggatcagacctcattcttcatgctcagaggcagatgtagttggcagaagggagggagtgaggagaagagtgtgggtgatggagttggtcagtctcattccacatggtcccaggcccacctgcaaatctgccagcctcctttagcttctcacatcaccctgtgtgtacattgggctcagggcacttccgcatctccagctggaggtggagggctcgagggttgtcccattctatagatgcagaaaactaaggcccagagaggagaatgacaagccacagagtggaactgggacctgggactggggcttgggacagcaacctagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctcaaaaaaaaaaaaaaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 93 - DNA, 126782 bp, Homo sapiens
ttcctgcatcctaacatgctcactgtgggttatgtcctgagaagacctgcttggtttagcagctgtggtacccatgaaagaaatacatctctgatcctgtggtaagtgaaatcaaatttccctgcatttccgtaagaccccctataccaaaacattgttggggctcacaaactgatacctcaaaatatgctcattgacatacttaactgaagaagcctcaaggtctctctgatcttccccatctggcccccccagtctgtcccaaagacaggatgatgttgaagttcatttatctggccagacatggtctctcacgcctgtaattccagcagtttgggaggtcgaggtgggcggatcacttgaggccaggagctcaggaccagcctggccaacatggtgaaaccccatctctactaaaaagaaaaaaaaagaagtttcttcatctgtctgagatcctgaacagatcctttcacaagataacatacaagttcatctctgttccttgaaccgttcattctctccagcaattcccataacagaatttctcttctccatcaccccataacctattttgccaggatggtacataagtttctgaatcccgttggggtggggtaatcactctgcaattcattctgtgtgcatgttaataaatttgtatgccttttcttcaatcaatctgccttttgtgagttgatttttcaatgaaatttttttttttttttttttttgaggcagagtctctgtcacccaggctggagtgtagtggcataatctcggctcactgcaacttctgcctcccgggttcaagagattctcctgcctcagcctcaagagtagctggactacaggtgcctgccaccatgcccggctaatttttgtatttttagaagagatagggtttcactatgttggccaggctggtctcaaactcctcacatgaatattcacactgaatattcatggtgatctgccctcctcagcctcctacagtgctgggattacaggggtgagccaccgcccccggccctcagtgaaattttagagtggggaggggaagctttccttaggcccctatagcacaatggtcagtttagtataccttgttttcgattccttttgtctttgctaagaatttaagtaacacctgaagcaccagtcaggcagcattccaaagaaggttcagccgcatttaaaccgtcgtgtccccctgtgaggcactccaggccagatcccaatctcagccacattcttcacttacacttgactggctgagaaagaacagaacaaaactgccttgggtcagaggccacttttttatatcagatgatctaaactgttcctggaaggatgtttatctgctggaacaaacaccctggggcctcctggctgaagctgggctttcctctgtccatgcatcctccaaggctatccagagtgctttgagcagcccgccttgtccattctttccatttgtctctgtctccccagagagaaacgccacagggaagtacatgacaagctgctatgttaccttaacattgaattcccagcagggatcacaaagccatggaagatactggttcagaaattagctgagagggacagagggcttttagcagacgagtgctggctttgccttagagagctttctgggtggtgctctgactaagggcattcaggtctttatgattcagggttattataatggcggtgctaacttttcttgcgtactgatgtaactggcagcacattaagtgcttcacctatattactgcagtcttcccaagaatgctatgagattggaccattagtgctaggaggtagaagggctgggaggttcccttacccatggccataccaagggtctgagccaggattcacactggtctgcctggctttagcattcatccctcactgttactatgctgcagaggatgaattggcagcccatgggctggattttgtttagcctgccagtgttttaaaagacatttaaaaatctgagccaatatttaaaatgcaagtgatttcacatataaacaaacaaaattctaacatctcttaaaaatagctatgactggcaacactgggtcctcaatcccaaaggctcctggctattggaggtaagtattggcttccctgctacatggggcatgtgctcccagtttcccatagaacctagtatggcaggctggctccattcatgtacctgctccagaagagccagacttgcattatagccttctatagcatgatttttgggtgctgtgtgtacccctgacctggcatagccctagaaacagaattctgtgccaataccatagcttgggttggttaggaacagagaactcaagtgtaagctgctgagggtttgtggcaggtaatttatggttaattccaaagtcagttcatctccaagggagagggcaggataaagaggtggcatgggaagtgctggaagtgaccatagacctgggattgactccaggttctgccacaggctggttacatgagccacattgagtcactttctttccctgtacctataagaaggagagattggagttgatgttgtcaggtgggtgtcagctctgaaattctaatatgccactgcttgttagtcaaattttcacaagagaaactgactttggaggtgtatcttctggcagtggacaatgggtgcaaacgaataggtaattagcaaacaactccggctcaggttcagagcagctggaaggttatggacccggcccagtgaagagaggtgtggcccaaagcactgcagccattttgaatgccagagctttctgtcacattagttcaggggtcagttcagggcttggctctttatttagaaaccataataggaactacttaaaccattcttttccagagcaaatgcctcaccccaaaaaatatcactgggaactatattagagagaattgcacaatctttcagtgcattcagaggaactcacaggaactgtattgttttctactttcttccttgcttttgaaacacaaaccttatcacaacaaagtgaacctgtttctccaattaaagcagtcatgaaaataaatagttatccacaaaactgcactgtaagaaataaaaataagtcagtagatcaggcaaagtgccaagaaaactccttcgtaatacattttacttatctcctcttttgtgcctctgcaggtctcttaattccctctggcctgtcaccatctctgagtgtatgtttcattggcttctttgaataagccttattgtctctttagcaaaggtggtgtgtgcaaccttatgttctgttgcttgtctgaaaatgagacctcaggcatgacttcctggtatctcccaggaatgagcaggttttaggatgtggacccaatagaaactcttctgagagccagataccaattgaggttcttagagacctctatgagaaggccaacttgactgaactgagcctactggcttgactttgtagaaacttccttctatagcggaggctagctgactttccagcttgttctggggcagtgcctcctagatcaaggcttctccaactttaatgttagaatgtagattctcattcagaaagcctggggcatggtccaggagagggtctgcatttctcccagggcccctggtgatgctgatgctcctagtccaaggactgcattttgagttgcaaggtcctacactagtaattctcaagtgtctgctaccaggaccaacagcaacagcatcaactggtaacttgttagaaatggaaattcttaggctccaccccagatctcctgaatcagaacccctggatgtgatccagtaatctctattttttttttttttttttgagacagaccctcactcttgtcccccaggctggagtgcagtagtgtgatctgggctcactgcaacctctgtctcccgggttcaagcaattctcctgcctcagcctcctgagtagctgggcttacaggcacctgccacaatgcctggctaatttttgtagttttggtagagatggggtttcaccatgttggccaggctggtcttgaactcctgacctcaagtgatctgcccgccttggcctcccaaagtgctgggattacaggcgtgagccactgtgcctggctgtaatccgtgttttaacaaaccttccaggtgagcctgatacatgtgagagtttgagaaccactgtctgtgtcattgttatgggttgaattgtgtccctcctctaaaggatatatagagaactcaatatatgaaatcctaacctctagtacttatgaatgtaactttatttggatatagggtctttgcagatttaatcaaattaagatgaaatcattaggatgtacctagcctaatatgatcagcgtcctttaagatgatcatgtgacatcacagagacacagagggcaaagatgatctgatgacaacagaggcagaggtttgaagtgatgcatctacaagctaaggaatgccaaagatgaccagaaaaaaaaaaaaagaagctagaagaggcaaaaaaaagaatgtttttttctccgtgtttccgaggcaacatggccctgccaacatcttaattttgaaagtttagcctccagaagtgtgagacaataagtcgctgtcattttaaacaacatcatttgtggtacttcgttacagcagccttaggaaactaatacaatcgtgaaaggctttccctgctcagtgatagaacagcaggtacttatagggctcaggtgcggctattgactgatgggtagcagaagatagggaaagaaatggaagaaggcaaaatagaaagcaagaagcagtgatgatttttgttctgaggtatttgtgggcttaataatttttaaaacattatttgtaagttaattatcaaacatttattgaatgcttactacatgccaagatccgttttagattctggggatataacaatgatcaagtccagtttcttttcctcaagaaacttgcagtcagtacaggaaagagttgagtaaacacgccctcactatgcaagggcagatggcactcagagtacacaggctatgggagcagggaagccacacagagttgtattggttgcgcattgcaccacacatagtcttagatgtaaatggtctcccctagggttgtgtggtgcacaaatgctctactgagcatgacagctccgttaggaagattcaagaggaacattaaattcagttcttttgatttttattttatttatttatttatttatttttgagatggagtttcactctgtcgcccaggctggagtgcagtggtgcaatctcagctcactgcaacctccacctccaggtttcaagtgattctcctgccttagcctcccaagtagctgggattacaggcacccgccaccacacccagctaatttttgtatttttagtagagatggggtttcaccatgttggccaggatggtcttgatctcttcaccttatgatccgcccaccttggcctcccaaagtgctgggaatacaggcgtgagccactgcacccggccgtctttttattaatttattaaattttcaaggcagtcctctagggtccattcaatttattcttgaaggtcaagaaaagtttcccaagggaaatagtatctaaactgagacctgaagggtaagtagaagttaatcaggtaagggaagctgagggggctttgggtaattgaaaaggaaagtgtttagaaaaacaaaactgcacataccagactgagagacaatgggagcatctgtgaggtgtgtactccatcaagggctctgtaggcaaaaagctaactacctgatttgctagtcagattcttttcagggcctagagccccttaaataagctccattttgtagtaagactttctttggttgctcaaatatctccgaagtaattaaagcctgcagatcttagttgttaaactgcctgatgcaaatttcttataatagaataatttaggtgtctaatggaacagaatataatatgagtagaagacatgagatgtcaatgctatgtttaaaatgtgtatgtctaattggctaagtaactgtaacttttaactttctattttagccaggagtcttcctcttttccttcccaatgagggtcagttgtggggagaccatattaaagctggcttgttttttttgtttgtttttttgttttttttgagacagagtctcgctctgttgcccaggctggagtgcagtggcgtgatctcagctcactgcaacctccgcctcccggattcaagcaattcttctgcctcagcctcccgagtagctgggactacaggcgtgtgccaccatgcccggctaatttttgtatttttagtagagatggggtttcaccatattggccaggctggtctcgaactcctgacctcgcgatccgcctgccttggcctcccaaagtgctgggattacaagcgtgagctatggcgcctggccagctggcttatgtttttaacgtactgtaccttctcaaaaatccaaggctgtgtaaagtccactcatgtagagagaaggaacctgctcaagttttattcttggaactagaaaaatcagtcttccctttggtgttgagtgtgaatttctgactgggaagtccaagctgaggggcaggtggaggcctgggggagttggccatggcttggagaaggcagccacagctcagctgaggcagccatgagcacagggcaaattgggcagactactcctggcagcacaagctagagagcatgttgggtgcgtctgttagcggtggagaatccatatgggtctgcaacaacctcagttcttgcctcctcagaagaaagaatttggccaaggggtataaagcagaaaaaaagtcctggcaagttttagagcaggaatgaaagttcattaaaaagctttagagcaggaacgaaaaaaagtaaaacatacttggaaaaggaccaagcaggcaagttgagagatcaagtgcacagtttgacatttgacttggggtcttatatactggcatgcttctgagattgaatccctctttccctgattgttcccttggaatgggctgtctgcatgcgcagtgtgtttatgggagttgtacgcatgctcacttgaggcattcctcccttgcgagccgaaagtttctagaagatcacataccagttaaactctgccattttcctcttagtgtgcatgcttgagcccacttgctcaactcctgagatcttatcaggaagctgctgatcaccacttttaagtgttttctatctattaggagactgcctttccctggagccagctgtgcccaattgttattttagagagacagttaacaaaccaccggaccatcacctgatggttgcctgacattacaggtgtgggaaggggccccctcttgtcctgctcccatctgcctgactatctactggaacccttctccagcagcagctcataatatcattcaggtgagaccaggatgcactgaacactgggtctacaggctggggtggggctgatggtggagcttcaggggaggcccaaaagagcaacacacacacctggagagcaaagcagcagctcctagttgcaatcctcatattgggagttgagggataagctaagatctggctgtttatttacaagctgaaatggcctttgcaaaagtatgactgaggaaattatgacagtgaaagaaatcagacctaaccaactccatcttgcttctaactttaagctgtccttgttcattcctgggcatagaccaaactaactttgggaaggaattcagttcataatttgactctgaaacaaaattgataacagccctttcctgaaaagaccacccttcttgcctgggaaccagttcacctttgcaggactaacaaattagctataagatgagaaattacagtttaggggtcatgcagtctctggctccaagagtctgaaccgccccaaattttaaaacctaagatcagtgcttgagatgttttacagaccctgcacttgatggatcagctgacaccacccagaccagtaatctggctcaatcagttttgccatcccacccaggaacagaaaacagcaagaaaaactcaccttgaccccctttggttccatctccaacctgaccaatcagcactcctgacttcccaagcctccacctgccaaattatctttaaaaactctgatccctgtatgcttggggaaactgatctgagtaataataaaactccggtctcccacacagtcggctctgtgtgaataactctttctccattgcaattcccctgttttgataaattggctctgtgtaggccgtgggcaaggtgaacacactgggcagttacaaagcctcagattcctttaggaccaacgattgaaatttcttcctaaaatcaggaattccagaagtagaagcagtgcgaaggtcatcacatataagaatcaccctggcctcgaacatcacacacgggggcctgtcgtggggtggggggctgggggagggatagcattaggagaaatacttaatgtaaatgacgagttaatgggggcagcaaccaatatggcacatatatacctgtgtaacaaacctgcacattgtgcacatgtaccctagaacttaaagcataattttaaaaaaattaaaaaaaaaaaagaaccatcccagcctcatcttgccctccagttccctccagagctgtggtgccctgcagcccaccaacagctgggtatcatgagagcaagttgctctctgtctcctgaacacagctgtggctgaggaaactttccttttggattgagtgacaatgaatctttctgtagctttctttcgccagaattgttgtccctttctcggagacctccaccacaaccttgctaagtgaccttgggaagctcaccttttctttctgtgtccacattttctctgcctgtctaatgggatttctggcaggatcaaattaaattactatgtgaaagcactttgaacaagtagactgtacatgtggtggtcacggtggttattggtgtttggtattatgtttcggctctctctgaccatggtcttcctgtgctctgccagctgcagagctctataccctggactatgaagaagagatcttgtattccagggcccagctgtcccggtgtgagccactcattgttctgatctcctcaagagaggagtgaaaacaaattgaggaatttgaaacttttagaccacacccccaaacacagccctaataaataacatacattcagttttctgaaaagattaaatcttgtccacatactccatcaaaaactacaccccagtgcatccaagagctcttcaacaggggtgtttacaaacctgaaaccagccatcagagccactgaaacttcagctggtgcctgtatcggggagtaaaaagacctttattctctgtgtttaggcttagtgcctggggttctgcagatgaaacagagaaaacacaggttagcaagagaaaagggtttctttcatacacatatggaggaggctcacagaaatgaaaaaaaatccaaggggtgctcatacctagaggcttatataccattttaacaaaatggtatataaattcaaacaaaaataaatttgtaaagaagtgagaagataaaaagagtttgaagttgttacgagtagtaaattgtgggaaggtaaatacagggaggaaataaatggaataaaagagatattttagtaatatttggtatgttggttcctctcagactccagtgattaagagtctaatctctctgcccttcctgctatgagagaggaaaagggtaatgtcctcacaaagggaatttatgccctgcctttaggcaaatgggaggaggatagagaactttttttgtgtctgctgttttttagttgccttcagctcaaaataatccttatgccaaagtggcatatttgggggtggcctattctgagcaccttcacttgcataactgtagcaacagcatcttctgagccatttgtacctctgttatttccctctcattgtcctttggtcaaccatgctgagactgaaaattatccaagagttttgccggccgcagttaagaatccccatctctctaaccaaagggtcaagtcccatccctacctgtcaaaatcctacttgtgtgtaaagggattattttaaaggcaataagtagtttctgagtacagagtcattggtttggaagtataaccacaaattgactttcatcaatcaattgttattgagtgcctcctaaacaccagggcctattcaatgtgctagaaaacaaagataaatcaagcacaattcctgccttttggagagctttacctcttgggggtctgatatagtttggctgttttcccacccaaatctcatcttgaattgtagtttccataatccccacatgtcatgggagggaccagctagagacaactgaatcatagtagaggattcccccatcctgttcttgtgatagtaagttatcacaagatctgttggttttataaggggcttttctccattttgctcggcagttcttcttgctgccgccatgtgaagaaggacatgtttgcctccccttctgccatgattgtaagtttcctgaggtctccccagccatgctaaactgtgagtcagttaaacctctttcttttataaattacccagtctgaggtatatccttataccagtgtgagaatgggctagtacagtaaattggtaccaagggagtggggtgctgctataagaatacccaaaaatatggaagcaactttggaactgggcaacagacagaggctgaaacagttgagaaggctcataagaagacaggaaaatgtgggaaagtttggaacttcctagagacttcttgaatggctttgatctgaaagggatatggacaatgaagtctaggctgaggtggtctcagatggagatgaggaacttgttgggaattggagtaaaggtcacgcttgctatgctttagcaaagaaactggcagcatttttcttctgccctagagatctgtggaactttgaacttaagagagatgatttagggtatctggtggaaaaaatttctaagtggcaaagtgttcaagaggaagtggagcataaatgtttggaaaatttgcagcctgacaatgcaacagaaaagaaaatccccttttctggggagaaattcaagcccgctgcagaaatttgcataaggaacaaggagctgaaagttaatcactgagacaatggggaaaatgtctccagggcatgtcagagaccttcatagcagcccttcccatcacaggcctggaggcctaggagtgaaaaatggtttcctgggccaggcccagggcctctctgctctatgcagcttctggacgtagtgccctgagtcccagctgcttcagctccagccatgactaaaaggggccaacatacagctcaggcccattgcttcagagggtacaagccccaagcctttgtggtatacacatggcattgggcctgtgggtgcacgaagtaaagaactgaggtataggaccctctgcctagatttcagaggatggatggaaacacctggatgttcaggcagaagtttgctgcagggacagggtcactgtggagaacctctgctagggcagtgtggaaaggaaatgtgaggttggagcccccacatagagtccccactggggcaccgcctagtggagctgtgagaagagggccatcctctagaccccagaatggcagatccgctgacagcttgcaccatatgcctggaaaagctgcagaaactcaactccagtcgtgaaagcaagtgggagggggactgtacctggcaaagccacagaggtggacctgcccaaggctgcaggagcccacctcttgtatcagtgcatgctggatgtaagacatggagtcaaaggagatcattttggaactttaaggtttaatgactgccctattggatttaggacttgcatggggcctgtagcccctttgttttggacaattatcccctttggaatgggtgtatttactcaatgcctccattgtatctaaaaagtaactaacttgcttttgattttacaggttcaaaggcagaagggtctcattgtctcagatgagactttggacttggacttttgagttaatgctggaatgagtcaagcctttgggggactgttggaagggcatgattgtgttttgaattgtgaggacatgagatttgggaggggccagggtggaatgatatggtttggctgtgtcccctcccaaatttcatcttgaattgtggttcccataatccccatgtgtcgtgggagggacaaggtggagataattgaatcatgggggcaaggtttcccccatcctgttcttctgatagtaagctcttacaagatctgatggttttataaggggcctcccccttcacttggctctcattcttccccctcttgtcaccatgtaaagaaggatgtgtttgcttccctttctgccatgattgtaagtttcctgaggccttcctagtcgtattgaactatgagtcaattaaacctctttcctttataaattacccagtcttgggtatgtccttatagcagcatgagaatggactattagagggtctcagaatctaaattgtaagttctctgaagagctataagtgctgtgatagcctgaaatgtagtatacaatgtggatatagggaggaagaggtcagttctatctgagcaggatggggtgggatagggtaaagcagagaaattatcataaacaagtgatgttcaggctgagttttgaaagaatgggtactcagtgggtgtttaggggcctggggcaataaaatattgcaatgattcccttgtttctcaatggtttgcaccatttacccaaggctcagtcattagtcacatgtcaagatttctattcctatttgggataatctggtttcttcattccttggctcagcaagagaacctaaacttcaacttgacaaactttcaatggcagcagccaccttctcaattggaaattattttatttgtgtgcctatgacactttctgaattcccttcttataggatttacctagtattgtaattgcttatgtacctatactatctgtaatcagttgtaagtgtgatcagagctttgaaaggagaagcccagtgtgatgtttcaaggtaaagtagggaaactgacacagtggagatcccaagaaggtgccctcaatgggtacataatttttttttttttttagacggagtttcactctgtcacccaggctggagtgcagtggcacaatctcagctcactgcaacctccgccttccaggttcaagcaattctcttgcgtcagcctcccaagtagctgggattacgggtgcatgccaccatccccagctaatttttgtatttttagtagagatggggtttcaccttgttggtcaggctggtttcaaactcctgatctcatgatctgcccacctcggcctcccaaagtgctggcatgagccccagtgcctggctacataattctatgttgtttaaattaagctggaagacacttgtccccaactcctgcctggctagttttactctttggtgtgcaatgctctcatatttaccctctagctcaaaatcctataaaatgcctctctatataaattcactgtaccagagatcaaagccccaatagctatctatccttctcttttcatttgtctccttctctgtcttctgtaataaaacatcaatatttagctgggcaaatggttgctcaggtagcaactgtatttcccagcctttcttgtagctaagagggaaatatgacaaaattcctcctattggagtgtgagcagaagtgatgtgaagaacataagggccacattctttatagataaaagggcttgttgtgctccactatccatttcctattgtgtgggaaagagcagcaacagcagcagccaccttaggccacatgggtgccaccactgagggtgacagagctgccccagtgccagtaccttgggatgatcttagggagcagcattgcctgtctgctctggaattctagactctctatggacccttccaggagggaaaattaaacttctgtctcactgtactttggggtctctttgccagggcagttaaacttgtatcctaactcatatatccaggcgctgccttttggcatgtctttagtttagctgagggccataaaagcatttatccactttgtcataatctgtgtatagtttcagtgggagatttctcttgagtgattttccagtttaaattttctcatgatccccatctggctgtcatttcttttaactcatcctcccctaatgctcacttttattgtacagaagctctaaatattttgagaactgaagtcatggagtcatgggatttcttggctaggtcataatactttgggaaaagtggactaggagagaaaggggatgtgaatgagattctaatatgaagatgaaagtcttagttacccagagtcacagctctccattaatatgaatgttttcaccacacctagagaaagaaaaaaaccatgatcaaatcagctgttattagagatccattcaaaaaaacaatcttgtaggcctatgccagagtttcagcccaattggctacccttccatggtgacaaccacaactctctgtgatgaagtgagaatttgtcataatatcactgaggccatcttttcaagatcagagagtctctgctttgtcaaagcattttatttgaggggaaaaatggatggcaatgcttattaaagaatacatcataaagaaacactatacaaatgtgcaaaggtacacatataaggatatttattgtggtattgcttacattggcaaaaaagtgcaaacatcctaatagccagcagtatgaggaagattaataaagtatagtttgtcttattacataaagcaaagcagccacttcaaagaaggtatgtctgtatcgactgacttgcaaagctgcccacaatatattgttagcagaatgattctatctttgataaaattagacaatagatatttatgtatacattttcatatacctagaaaaatagtctggaaggatatgcatgaaattattaataatgattacctctggggagtagaattaggagagatggagtagactttcatattttactctgtataattctatattgtttgaattttttatgatggtgggaattcatgatgaggcagagatcatacttatcctgctcactgctctctcatgcagagaatagatgaggtgatcaataataatagtaacagttatgtagcacctaccatgtgctagtcaccttcctatggaccttacatatgttaatctatctaattttcatatatatactatgagataagtactattactatctccaatttaaagatgaggagacagagcatagagagaacaagcagtctgctcaacgtagcaaagtgatggagctgagattcaatccaggcagattggctccagtgactgatcttaaccactatcatttgtcgtgttgattaatcgattgaatgaatgaatactaaaaaattaattttccagctaagtcttttataagtagaagaatcaataagccaggaaagctcattccgagagtattctacttaatcagggttttacaatttatctttcattgcaaagtaatgggctatttatacttagagccttccaaatgctgaaaagacactgatgttaactgttgttgatgagtgaccaggagaagctgaacattttaatttaaagtaagtgaaagaattaattgccagcatattaaaagccttcatctgctgttcctctgccttccacctggaacaataacaagggcatcatgagcacaagcatgacagcctggcttttccttttcaagctgcctgattttccagcttgtgaaattgtcttctctgtgcttacatctggtaatttggaaatgtaggacagaattctgtagtctggaactatctctatgccttacgtgaccaatgggactcctccctcagggaaaatggctaaagaatagaccatgtccttggggcagaggaactagcttttatcttattagtattctcagcatctggcagagtacctggtgcatagtaggagctttatatagcctagaacaaggccatcttaactgtcaggtcaatagaaatttttatggtttagagaaaggcataagaaaaataaaggataggccaggtgcagtggctcacacctgtaatctcagcattttgggaggccaagcgggcagatcacttgaggtcaggagtttgagaccagcctggccaacatggtaaaaccgcgtctctactgaaaatacaaaaaaaattagctgggtgtggtggtgcacacctgtaatcccagctactcaggaggctgaggcaagagaaatgcttgaatgtgggaggtcaaggttgcagtgagccgagattgtgccactgtactccagcctgggcaacagagcgagactctgtctcaaaaaaaaaaagaaagagaagaaaaaagaaaaaggaaaagaaagcatactccttggctaaaatagttttctaagtataaaaatggcattcatttagcaaatgaatacttagcacctactatgtgtaaaatactgtgggagatacaagtgaatacaaaattgtcccagtctttagcttgtactagagcctgagagatatatgcgcatatgtcagccctgtgaatttagataggagaattttgtaaatttgcagtagctcccccaccaatctttttttttttttttttttttttgagatggagtcttgctctgttgctcaggttagagtgcagtggcacaatctcagctcactgcagcctctgcctcccgggttcaaatgattctcctcctgcttcagcctcccaagtatctgggactacaggcgaccaccaccatgcccagctaatttttgtatttttagcagagacggggtttcaccatgttggccaggctggtctcaaactcctgacctcaggtgatctgcctgcctcggcctcccaaagtgctaggattacaggcatgagccaccctgcctggcctctctcaatcttaaagtacaactcaggagtaattttttgggcatgtggaatttgtatacatggctaaaatgcatttttgtgttatagagggaacaaatagaatctcttcctgaggacaattgaatgtggtttcctggcagatgggggttggtttacccatgcacagttgagttgagagtaggtctgcagataaccactcctccatgagagagaaggcagaagaaaatcccatgggaaaaagacacatcagcctgtttgatggaacaaatgaagttttgaggggaggaggaaaggagagcagtacttaaatgaacaattgttggcctggcacggtggctcatgcctgtaatcccagcactttgggaggccgaggtaggtggatcacgaggtcaggagatcgagaccatcctagctatcacagtgaaaccccatctctactaaaaataaaaataaaaaaaattagccaggcgtggtggcaggcgcctgtagtcccagctactcgggaggctgaggcaggagaatggtgtgaacccgggagtcggagctcggagtgagccgagatcgcgccactgtgctccagcctgggcaacagagcgagactccgtctcaaaaaaaaaaaaaaaaagccaggcgcggtggctcacacttgtaatcccagcactttgggaggccaaggcgggcggatcacaaggtcaggagatcgagaccatcgtggccaacatggtgaaaccacatctctactcaaaatacaaaaattagctgggtgtggtggtgggcccctgtaatcccagctactcgggaggctgaggcagaagaatcacttgaacccgggaggcagaggttgcagtgagccaagattgcgccactgcactccagcctgggcgacagagcgagactccgtctcaaaacaaaaacaaaaacaaaaacaattgtgcaggctccctgatcattaatggtcttcataaaaagggcatagagcactaaataactgacacaaaattagggtggagttagaaaggtacttgtgggagaaaatttgtgacgctcacactgtgtctcactcaaagaggatctgcacaagcattaaagttctgagctcacacagaatgggaatgttgcaattctgtttgtttctgtttagaaataataatacctcagccaggagcagtggctcacgcttgtaatcccagcaccttgggaggctgaggtggacggattacctgagctcaggagtttgcaaccagcctgggcaacacggtgaaaccccatctctactaaaatacaaaaaataaaaaaaaataatttgccaggcatggcggcatgcgcctgtagtcccagctacttaggaggctgaggcaggagaactgcttgaactcaggaggaggaagttgcagtaagctgagatcgcaccactgcattccagcctgggcaacagagtgagcctccatctcaaaaaaaaaaaaaaaaaaaagaaaagaaaagaaaaaaagaaatagtaacacctcatcatacatttttcatgaatctttgagcctttgggaagacagcatagtttagtgatgagaaaagcaggtgccagattgccagggttcaaaacttatcagctgtgttactctgggaaaacaaacaaacaaaagaacaccttatgtgggcagtaatatattcaaagggctaatgttaagattaattgagacaatatatgtaaaaacatcataagtactcaagaactgctggctatgaacagcaacagctatacaattatgcattacaacaagaggtaatgtgtgtagaaccttagtttgcaaagtgttttctcatgcgtgttctggggtgggatcttacaggtctgagtttagatactggttcccttctcaccaactttgcaaacatggccaagttagttaacctttaagctgcagtttcttcatctgtaaaatgggatgataacagtatgaagctctcctcacaaggctaacaagaagacagaaacatagttaattctggacagaaatatagttataattgagcattaatcaggctgaactttgactcacttttttttgcaagcaaaagtcagggagcactagatactgaccacttggatccccattgttcctatagataggatttctagtgttagcatcataaggcttttgtttaagatagatagaatatctgacattagaatcataaagcttttgtttaagaattgctaaagcagatcctgaattctggttgaatagctgatgccaaccagtttgaagacccccacagaggaacctaatcagcattggaatacagtttctttatcttcctgctcatgacataaccctgtatgcttcaaccaatcatccatctccacactttgacccactctaaaacctttaaaaaccctaaccccagactcctcagggggatggatttgaggtatccttccatctcctcagtcagaagccctacaattaaacctctttctctgctgcaacctgccatcttggcatattgacttgctacacattgggcaatgaacctattatggttacaagtacataaagtataacttttatgtaaccataataagccaattatggttacaggtacataaagtgtataaagccgttctgaatgttaaattgaataatgtatgtaagttgcttagtgtatagtaagtgttcagtaaatgttagcaattgtttatcttcctatttattctcagaggtctgttctgaggagcctaagactcagagctggaagcattccagagcaggactgaaatcaaactctagtgcatgtggagcccttgcctgagaacattttccagtgatgacataagggagatgatatagtttggatgtttgccccctccaaatctcacattaaaatgtgattcccatgttataggtggggcctagtgggaggtgtttggatcatggcagaagatccctcatgaatggcttggtgccatcctcacagtaatgagggagttctcactctactatttcacatgagatctggttgtgaaaaagagtctgggacctcctgcctctctctcttgctccctctcttgccatgtgatacatctgctcccccttttgccttctgccatgaggaaaacttcctgaggcccaaccagaagctgagccaatgccaatgctatgcttgtacagcctgtagaaccatgagccaaataaacctcttttctttataaactatccattctcaagtgttctttagagcaatacaaaacaggctgacacagaaagtgtctcaggaaatgagctggaggctttcagaaggcacaccttgtacctgagccaaaaatgaagattctagtcccagaggccttaaagccagcaaaccctttcccatggaggaaggactccatttgaatctggcacagtgacacagagattctgtcactcccctaaatgagtacattaagttggcgttctccactaggcttctttctcaccatcaggaatgaaagccagtagggaagtcataatgggccttgatgtgcccagagagcccttggctgtcctcacagctctgctggccatgccctaaattaaagaaaatacaatacagggagtcaagaagtggggccagcttgggcctctttgatcagcatccatgatgctgtaggatgcatgattcagctctgagatctcctgctaagtcagaggtaatggtctccttacaggcacgtgtagcatttgcagcaagagacataaaagaactacattctgtttctgttgattctatcctccattcctcctacttattttctctttccccctccagttaactcccacattgtgcttactccgaccccaccttcttccttgtgaacccctaataactgagacaggtctcagtcaatttaggaagtttattttgccaatgttaaggatgcgcacctgtgacacagcctcaggaagtcctgatgatatgtgcccaaggtggtcagggcacagcttggttttatacattttagaaagacgtgagacatcaatcaatatatgtacaatgtatatggattcagtatggaaaggtgggacaagtggggtgggggggcttcctggttataggtagatgagatacaaaggttgcattcttttgagtttctgatcagcctctctaaaggaagcaatcagatatgcatttatctcattgagcagagggatgacttcgaatagaatgggaggcaggtttgctctaagcagttcccagcttagcttagtgattttggggtcccaagatttattttcatttcacatcctgtatgcagatgtctactcactcaactctgctactgagttttatatatgcatgatcctctgcatagaccacactgtcttgatgagtgtctatgcctgtctatgtacagtgttcactgcagtgtgcatgtgaatgtgtgtgttggtgtgacatagatatttagggtcagggacttaagccaaaaccatgaagctaaatcctaaaggaaacatactggtttgctgaactaaggtaaatctagaaattaagcttaccttgaaccaaagcttagaaaaaaagggcttaatttgatttaagacaaagaataatttttaaaaaaattgtttaatttttaaagtagataaaatgtttatatgattcaaaattaaataaacttttacacctatatttcttttttccacccttgtcctgcatatgtttattcacctttgcaaaccagtaacctgccaatgttttccttgaattctttttttttttttttttttgagatggagtcttgctctgttgcccaggctggagtatagtggtgcaatctctactcactgcaacttctgcctcccgggttcaagcaattctcctgcctcagcctcctgagtaactgggactacaggtgtgtgccaccacactcggctaattttttatatttttagtagagacaggtttcaccatgttagtctggatgacctcaatcttctgacctcataatctgcctgccttggactcccaaaatgctgggattacaggtgtgagccactgcgcctggcttccttgaattcttctagagattttacatttatatacaagcaaatgcaaatttacaattcaatctcttcctttccacacaaattagaaaactatgcatattattctgtatcttacttttttctctttataattcatcttagcaatctttcaatatctattcatagaaagtgtcctcattctctttatattaatacaactatacaatagtacaatagtctattatatggatgtactataatatgtttaaccaatcccctattggtggacatttaggttgttgtcaaatttcttgctacagtaaccagtatttactgcaatggataactaattttttttttttttttttttttttatatacagggtctcactttgtcacataggcaggagagcagtggtgtgatcacagctcactgcagcctcaacctcctgggctcaagtgatcctccaaccttagccctcgaagtagataggactataggtgtgtgccaccatgcctggcaaattttctgtattttttgtagagacaaggtttcaccgtgcttcccaggctggtctcaaactcctgagctcaagcaatctgcctgcctcagcctcccaaagtgcagggattacaggcatgagccaccacactctgccttgaataaccacttttgatagttgttgctaagttgcccacctacatgagacaccaaatgccatttgcaacagcgggtaggatagtgctcatttccttcttccatgatgacagtgtgcattagtacacttcatttttactaatttgatagtgaaaatggtatctcatggtagctcgagtaacatgagtaaggttgacattcatatatttaaaagctatatgtacttccttttttctttgaactgtctctttatattctttgcccaattttcttttggataattggtctttttttattggcctgtaggagtgcttaaaatattaaggacattaaacgttgtctgtgaaatgagttgcaaacaacttgctcccgtttgtcttttgacattgctcaagtagtttttgccaagcaaaattttgatttttatggaatttaatttttaaaaccttttcctttatgccttctagattttatctctcatagttagaaaggtcttcctgctctggatttatacaggaatgtttcttttaggacttactttttacttataatatttgattcatttggaatggatcctggtataatgcatcaggcataaatccaactctattttttccaaatggacccagagttgttccaacatcatatattgaatagtctattattttcctcactgatttgagatagcaactctatcataaatccctatatgtatttgaacctatttctaaatttttgattctgttgtactgatctgtcaaataacagaatatttaaaactgtgtaaatcactgagctatcagccaaaacagaaatatatcctaaaggacagagaaatttgggaaatgaaaataatactaaactgaagccttctacaggaatactcgcctttcacaatttcagtgtgaatctgaggagcggggccaggaaaaaggtcagaaggatggtcctgtgtgatctgaaggctgggcacaaacatccagatgatactcgtggctttgctatgttctccatgaagccttgcccgtccagccatagatatctggcccagggttgaggctctgacccaacagagagccaatcaaaaacctttccaggaatttctgaacttgagaccagaaagagaatcaggcagttcttggtggaggtaatcataaaatgtaaacctcggaactaccatgagccaggttttttctgcaagaaataggcagcagagaaagaataaaacaatacagagaaaaaagcagagatgatggaatactattcagcaatcaaaaggaatgaactacagatcacacaacagcatgaatcaatctgagtgaaatcagacaaaaataaatacctactagatgattccatttatataaaacccttgaaaatggaaactaatttgtaatgacagaaatcaggtcagtcacagctgggaaaggaggagaggagaagtgaggcaggtatgggagggggaaattacaaagagatatggggagattgggggtgatggatataatgatggtttcaaggtgtgtgcgtatttcaaaacttatacaactgtatgctttaaatatgcagtgtattttatcattttaattcaataatacctcaacaaagctgttttttttttttttaaaaaaaaagcagagatgggagggaaactagtagaaagaagcagaaaggagggttgtgagtaggagagagggcaggcaagaggaagaatggatttagattacatttgttctttagttatagatgcccagctgtgtctccaatttgttttcttaacctaaatttggattatgaggataatatagttatcattttgcccaagctgagtttctgacttttgcagacagaataataagaccaatatttacccacactcttcccaagaaagaatcagagtccattttgactattcttcctccttatctgtcacactcagtttatcacccagtacaaccaattctacctcaaaatatttcttgcatttgttttttcccttccagatgtgcagagtccaggctcccatcctcttctacttcgactcttttaaggcctcccaagggggctctcccccatcttctatctgccatgttgtttccaaagttacatatttagagcatagatctgattctttcatcccccttcttaaaaaaataatattggcaattggtgaccacttaacatggtatggtgctcactgagccaacccccagcgtcccctcccaaaaatctccagcagacccaccactctggcaagaattgaacctcagccatgccaagtatatttacccttgagtgctcttatcttatttgtccacctgacaaacttccaacatatttaaaggcccaactcaaatgttgcctttttatatctttatttggctctctccggctgaattaattgttccttcatctgtgttcccatagctcttatcatctctgttgtggtgattaatgagtctgtttttcccacaagatgataaacttctaaagagcagaaagtgtgtcttatttatttttatatccctagaaacaaggatacttcacaaaatgtagcaggtgcttaattaatgtctgtgtaattgatttaaatcgagggaattgaaatagatcaatggttttcaagcctttttgaatacccctcagtacaactctttaaaaacaaaatggtacaaggaatctcaacacgtagtttagatgaaggtggaactgatcttgttgaagagtaaattaatgtatttgatgcagatactattctggtatttcatagttttctttctgtctgcatctatatatataagaggtttgcttttctgccactttcctcgatttcctcatcttctccatcacctgatgaagactccattcaccctttttagatagaagtatctgtaacccttctgtatcatgaaatatcccccaaaacaactctttgtgctaccaggcgcccctgctcacagctttcatgtatcgtcaaaaattcccagtcatgaaaaaaccaaatgaacaagtttttggacaaagctgtctctgaccacagagaaagacagttctcataaagaggcttctgtttgctcaagttactaagctagtttccaaacaagttaaatgcaagcttaaatgtgtctctaaagtaccaaggagtctgggagtgaaaccactagttaagtcattcattcctcctgaggttaaataataataataggagtgcttttcctatttattcttccttcatgcagagttttaatttaaaattttgagtctgttgtcttttatttccagaataccgctttataaaattgattctgacgttgttttttgtcctgtattatctaaagagataccatgtattaattcttcctgcaattttataaacaaaactcattcaatatagaacccaatgggctacatctgtaacccacgggaagcattcagaatatttgtgatgtatcaaatttatgacaaagataaaactaaagcaatttcattgtgtttgtaggcaaaacgagggcatttagccagatgttcaccaagggctcttccaaccttgtgagtttatgattttagggcaaatgagaacaacagcataggtttcagattaattgtgtgagaagtatattgtctttgcacagatgaatagaacataacggcaacgaatatcaggaagaacatttccaaaattatcttaaatgctttattattgtacagcttcattttttggttttcttactttgtaagaaatgccactattgtggggtttcaagcgtaattcagcaaatggtatgtctaattgtaatttcttccatattcccaggacagaagccacaggaccaagagccattttgcaaggtcaatgggactaagtgagaaaaggggagaacattatccagttgtttatgtgtccagaaagagagtttttcaaaagttcatctcttggtaggaattcaaaatgcctttgcccaaaccattgagactatatggttaggttaccaggctagattctaagagcctgtttaaccctaaatataaaaagattattaaggcagacatggtggttcatgcctgtagtcccagctacttggggaggctgaggcaggaggatcgcttgagcttgctcctgggctgcagtgctgtgtgctgatcaggtgtctgcattaagttcatcaccaatatagtgacttcccgggaatggaagaccacaaggttgcctaaggaggggtgaactagctcagtttaaaaacggagtaattcaaaactcctgtgctgatcagtagtggaatcacacctgtgaatagccattgcactcttgcctgggcaacatagcaagaccccacctcaataaataaataagtaaataggattcttcaaaattttattttgatttatttagcctcatgtatagcatctttttcttaggaaaaaaagtccacactcccagctgtaatgccatagacatatctcccccagcccagcagtagaaacagacttgcagtgtgaagacagtctatgggcagggatcggtgtaggtgatcaaatccactcagtacacccaagctttatatctgcctaagagaaggcaaaattgttgcaaactggagaacaaggaaaagttaccttgaggagtggagttctgagtgtcaactctctcccttgctatatttaaattatattacacattgaatattcacaaagggctgcttgtctttgcattcattttgaatcctgttttgtgaccatgattggggacgcaaaggttttttgtcctttgtcatacttagtaaatggttttatgttccttgattatgatacatttgtttttgaaattcattgcaatatctaaattgatgattatcacaaatgagtgtcagtgcttggctgtcagtgtttttcttttagcagaaatgaatgaacaacattttttgaattactatcttgtgggtttcatttttaactactggaagagaaaaaacacagaatgaaaaactatattttgaaccaaacatgagctcaatcattcattcaacaaacatttattgagtaccaatcattgggctaagtgctttggagtataaaaagatgaatgaattgcatttcctgaactcatggaacatgatttgaggaaataagacagataaataaatagctctactaaaggtaaagtgaataaataccttaagagatgacagagctcttcgggcatcaaagtgggagcggagaccccattcagctgagaattttccagagaaattggcacataaactgattcttgttagagagggaggatttaaaaagtgttgaaacgggaccccgaggggagagaatggaaaaccactgatggttttagaaaggaaaatgacatgggttagctgtgtggtttagaaagatcacagatactagctcggtggctattgtaatgattcaaataaagctgtgagccaggtaagagaccgcaaatgtgaatggaacacacagatttgagagatgcttcagatgcagaatcaacaaaccttggggatgctttggaaacaagaggtggaaacacagatctggcaatcagtaaaggtaattactaaaatctaaaaatgtggttcttaagcttatcaagcacaagaattacctggagagcttatttaatggcaggtttcaggctccactctgccgagagaagattcagtgttgagcccaggaatctatttttaagcagcatcccagaagatgtggatgcaggtgctgggctgatcacactttgaaaagcactgcgatggaagtggaggtcccccagagtgcctaggaagaacaaaagcctcctgagaacagcttttgtgaaccacctacactcaggaggtgggaggaggaggggaatctgcacactggagctcctactgtgtaccccatgcttttcctgggatgtcctactgtgtgccccgtgcttttctatgtcctgggatagcaaggccttgacttcttggagcctccattctaatgtaaaataatacatacagtagacaaacacataaatatataacatgggtttaaatagtgccatggagaaaataaagcagaataagggcttgagagtgatgggacatggggaagtgggggaggggggaaggggagtgggggtggaggagcactttttgattgaataaggagaagcctctcaggcagtgacatctgagtagaaccctgagacgaggtggccataagaagatctggaggaagagcattccaggcggagaatgagatgcgtaacaattctgagttgagaaacagctggttgtgtctggggaatggctgcagggccaggcagggtccagtggggctgtagcagagtgagtactggggaggggagcaggagaggaaggcagaggagccagcaggagctgggccagggaaggaggacttttggctgtggccttgtaggccatggtaaaggtcttggagcttattcttagatgtgttggggacctcactgggagctctgaggagagtgacatgatctgacttgctttttaaaggaccagtttgtctactgtggatggtagaaagtaagtatggagtggaagactcaccagcaggccactaagctggtgcccagagatcacagtggttgggccatggatgggagcaggggagatggtcagaggcgggcaaacctgacatgagttttgaaggcagaaacaacacaactgctgaaggattagctgtggtatgtgagagaactttctggttttctagtgttttggcagaaggaacgattgaacatttaagaaataaacatgatgtaatgggatggaaggcaaaggaaaagaggacatcagagccttctatgtcttggtattgctaatgccttgcaccatgatgcgcagggcaagctcttaacaaatatgttttgaatgaatgtttggatgactcaatgctgcatttaagctagggaggcaaggactgaaaaagccattagatggtataattaagatgctgttgggggtcaaggtggacggttatgttactaaccagatgagggacatggaggaagctgcggttttcgggcaagaaggtaacagtttacagaggtgatgaggaagatcaacagaggagaatgggccttggcagggctgagctgacaccgatgagggagaggagtttgaacctagagtggtaacctagaccaactgaataatgtctgataccttgaagcagcaccataattaagtgctaaatgattcttcaccctctcctgtggggacatgtgtgtatgtatagatgagtgtgcttatacatttgtggagatttggatccatgagagtggtgtttgttaagaggaaaaggtgtttatatcttgagaaatatatctttgtgccagcaaattgcagaagaactttcttccatgcttccctttctctctttcatctctctcccttcattcttcctttttcttccacctggttttcttcattaataattttatattgattacatgttaaagtgatattattttgaacatattgggttaagtaatatataagtaaaattaatttcacatctcttgtaacttatttaatgtggctactaggaaatgtaaagccacagatgtggctcgtgttgttttccatgggtcagcgctgctgtggagcctcacactcagcggcaatgttcttgcctgctttaaagacctttaatcaatgagctaagatactcccttggaaagaggttctaatttaactatcctggtaaacaagaaggaaataaaggatttctgaccaaggtcatactttaacaaggccctaggacaaatgggagtagatgttgtgtttccaagctgaattggtgacttaaagtgtgtttcaaaagagcctgaggctactttctaaacaataagtcagtggactgccctttgtgtaagtgtttctaagcataggtaaactttgggtgtcctttcatctgtgaccctatgaactattttggtcagaaaatatggttgcaaaaggcttaccccattccagtaaacagcatccattatcacttaatggatagaatcttggagaagtagttcacatgtataacattttatcttttccagacaggcccattaaattagttttaagtacctcataaaataaggccatattccaagtttgtgttcctataagattatctttaaataaaataatataaagaccttttctcttgacacaataaactaccattttaatacaacctcctgaatttgagaaaattgtcctatctaagtaatcacttttaattggttaaacaatctgcctattctatgcaaacttacaacagcaaaactgataccacattgggctagtaccccacctgctttttttttttttttttttttttttgagacaatcttgctctgtcacccaggctggagtgcagtggcacgatctcggctcactgcaaccgccgcctcccaggttcacgccattctcctgcctcagcctcccgagtagctgggactacaggcgcccaccaccatgcctggctaatttttttttatttttagcagagacggggtttcaccgtgttagccaggatggtctcaatctcctgaccctgtgatccgcccatctcagcctcccaaagtgctaggattacaggcgtgagccgccatgcccagcctatatcacctgtttttaaagatatgtgtacaagtttttgttgcacctgcttcggttttgggtggtatatacaaaggagtggaattgctagatcatatgctaattttatgtttaacttaatgaggaaccaccaatcaactgagcaccttttacggcatcctctctgaagactttcttgaactgtcctttccccttccacccaagttatccctccttctattcccaccatttccaatttacacatctcttagcacttgaacttgagtttaataaccttatattacctgcctcctatcagtagtttgtaaacctcttaagagcttacagaccttattttcctttgtattgtttacttcaactccatttatctttgatgtagtaagccctcgataaatctttactgggcaaaatcatagaaggctgttctgggtgcagaaaagacttagcttcaaacagggtgacttttcatttggggaaccaagaacttgagatgttgtgaagtggtaattgctgtttttatctgtaattgctgagactatgctggctcaccaaggttgctattatatttatttagacaagaaagagagggtgtatgtgtctgtatgtgtggggaaagggaggctgtatttggtatgctacagctttttgacagtaagctacatttacaaaatctgtctaccagccaagtgacctcaaccaatgtgggaggaacttctcagaacttcaactttgcacaagcctgagttgctgggctcctggctggatatgtagatgtctgaaaatgctgcattttacaagccatggttctgcctagggaggctaaaatttttggtaatcttgcaaaaatcacaagggttttaattaaattgcttccagcaaagctttacttaatgggtcaaaggacaaaatgttgaattaacacaaagaatttcctaatggagtgaaaacaaatgggaggtggcttctctcgtgaacttcctgtaattggaaccaccaatcagaggtgttggcatgagggctccctgaaggaatcctttttttttttttttttttttttgcctctgagtcagcatacaaaatgaaatgctgaagaaaggttggctttccaagtgcatcattgctgaggatcagacagagaagctaaggcattgcttttctgcttgctaagagcttatcatctagctgtagaggtgtgaaagggacacaaaagatcataataaatgtaggtagcatgtaagagaactaaaggaataatataaacaattggcattagtggcgttagttgggatggaagtcgaggggcgagtgctcactgcagccttgggtgggaagagagatgtcacttgagcatgtccttgaattgtggagaagttcgttaagacaggcagagagggtgctgtgtgccaaaggaaaagcatgatgattgtgaaaagcgtgtgaaggtcaagggccatggagtaatctagtttgaatcgagtaggacattcaacggtgctgatgcaagaatggtatgggtacgttgagaaccagattgaaaagagcactggaaataaaaataagtttaggcaaggccaagcatggtagctcacacctgtaatcccagcactttgggaggccgaggcaggtggatcatctaaggtcaggagttcgagaccagcctggccaacatggagaatccccgtctctactaaaaatacaaaaattagccgggcatggtggcaggtacctgtaatcccagctcaggaggctgaggcaggagaatcacttgaacccaggaggcagaggttgcagtgagccgagatcatgccactgcattccagcctgggtgacagagcgagactccatctcaatcaatcaatcaataaaagtttagacagattttcttctgtagggagtgagaagtgtttaggtttctgagcgggagaatgatacattgacagttatatttacagcaaagtaatctaacaaggttttgtggactggcctaactggagaaaataatggaaaagagaaataaattaagagcctattgaaatagtacagctgagaacagagaacttgaactacagtggtgggaatagggatataaagaagggtatggtgggggcaggtagacccaatcaataaagttgaggtctctttttttttttgagatggagtttgcttttgttgcccaggctggagtgcaatggcgtgatctcggctcaccgcaacctccacctccggggttcaagagattctcctgcctcagcctcccaagtagatgggattacaggcatatgccaccatgccaggctaattttgtatttttagtagagatagggtttctccacattggtcaggcttgtctcgaactctcaaactcaggtgatctgccttccttggcctcccaaagtgctgggattacaggcatgagccaccgtgcccggcctaagttggggtctctttagttttaggtaggtattttaaattgatgggttttatttttaatgtctctgttcctacttcattttccccagacactgctctgttggacatcagaatcccttagctgaccaacacacagtcatgggactgctctcattcatagctttggttctaacctcaagtgggtcccaagtgctgcctggcagtctgagcacatttctctagtggattcactggagtatgagctctgcatggacagagatctctgtgctatcccagctgcctggaagagtgcctggtacatgacatgtgcagtgaatgtgtatggctaggcatttcatattctctcgcctttcctcagacctcaaattcatttaccacaatttgcactcagctgttggtcttactacttgttccactgtgaaaatagaattaatctgaagagaacatccacacactcccacaacaaagtcaaccagcccacgtgcaaccttatccacagggctccttcccactcatcaccattcagcttgtcccagctgctgtctaaggctaaccctcccaactgtgcaatggatattacccttcctactggttgactcttctgtctcctgcatgatcagttttgcctctcaatgggataattcccatcagtatacagagaagttctggaggaatccctgaggtggaaaagcaaagaggtcctctggtgtgtgtctgaggtaggatgctagcaacttgcacagacctgtccgcagggctgccttgaggtgggttgcaggcacccacaacacctgctaaaggagtttacacagttttcccagtacataattttacacctgaaaataagtaggtgctcgataaattgtcactgaagaatggatatctcccatcttcaattgtcccttccttgattccacatcccttccagctaccatcccatttatctgcacccttttttggcaaaatccacaagatcattgtttatatactcactgtcttctcctgtcctcttagtctctcttgctgtcacttgtttggacttttgtctttactcctctactgaaacttctcctttgagatcaccagtgacctccattttgccaaatccagttcttagaccttttctgatttgacctttcaagcaccatttgacaagtgagtcgcctcttcttcccttttcctcactggccccttcttctcagttgaatttgctgcttcctattcagctctccaatctcttcatgttgtagtctcccagcttctgcccccagacagctcttttctatcaccctctccatcttaatgtcctgtctcagtgctggtgactctcaagtgtacatccaggccctggatgcaagactcatgtattcaacatctcctcttgggttttgaatagacatttctctcttctaaatttcaggcacatagaatcataatctgtggttgatgacactcttgtttttgtcagtgcttggccctctttctaaattttatttatttattgttttaaataatccaataaattcctgtgaacacacatcccaatacagaaaatagaacattgacccaaggcccacaaggccctacatgatctaactctatgcgtcctcatctgctagcattctccttgctgttcctttggcatagtctttgaagttgctatttcaactgtctagaatactcttttctgagatatcttcatgtctttctccctcattttatttgcgttgttacttatcagtgaagcctcctcagcatcttcattaaaaataatattcttgcttggctcctgatatagtttggctgtgtccacacccaaatgtcatcttgaattgtaattcccataattcccatacttcccatgtgtcgtgggagggacctggtgggaggtaatcgaatgatgggggtggttaccctcatgctgttctcatgatagtgagtgaattcttataagatctgatgttttgttttgttttatttgagatggagtttcactcttcttgcccaggctggagtgcaatggcacgatcttggctcactgcaacctctgcctcccaggttcaagtgattctcctgcctcagcctcctgagtagctgggattacaggcatctgccaccacacccagctaatattttgtatttttagtagagacagggtttcaccatgttggccaggctgttctcgaactcctgacctcaggtgatccacctgcctcagcttcccaaagtgctgggattataggcatgagccactgtgcttggccgagatctgatggttttataaggggcttttcccccttttgctcagcacttctccttgctgccaccatgtgaagaaggacatgtttgtattcccttctgccatgattgtaagtttcctgaggcctccgaagccatgctgaactgtgagtcaattaaacctctttcctttataaattacccactcttggatatgtctttattagcagcatgagaacggactcatagagctcctaggtcactttccaatttgcttattctgatcatcacctcctttaacttattatgtgtgtatttgtttattgtctgtcttctcccagtagattgtatgctctgtgagggcagggacctgttcttgttcactactctaagccacaagctagaatagtacctggtacttggtagccacttgttgcaggttggttctctgggaagcagactctgcaataatttgatgtgcatgacttctattagggagtgctcttaggatcaacagctataaaagggaaaagaaggaaacaggatggggcagaggaagaagttgagctgtgatgcagtcttgacgatagccccagccaatctcataggaggctctgaagttgttccaaattagtgtatgggcctgaacctttataaacccacatagaccagttattcatgcaggttgtcctagaaagggggcatgactttggagaaggggctctttttaggtagacaattgtattgtgtgataagggctgagggcttgctgtcagcagcacccccaggagctggatagcacatcacagtgtccgtaagagcacccaataaggtgtatggttgaacacatgaactcagtgagatctaaaaacagagtggatgcagtgaggttcatgacatgcaagacagaaagacaaggagaaccaggtcagtgaatcctcatgcccaaagtcctccattttcttgtttatccattttcctattatagacaaagccctgtctgggtactataagggatctaacatcacagacaatgtccctgacctcaaggaagagaatgaaacctaggcacaaacatccatggtacaaagcattgtgatataatttacatgtatagcacaaatgggtgcttatagaggggaaagagaagggagagcccttcccgcagagggaaggaggaggaaggcccagggaaggcaacatggaggaggcttttgaagccctgaaagagaactaagatttcgttgcacaagggaggacagagggcagccagcaggaaaagaggtagtagaacaagggttcagttgtagaaaatcccaagcttggggtcaacagtcctctctcctcctatgctctgatacttaaaggttggaggcttgaccacatatgaatccctcaaatgccatacaacccgtgtgttcaggtcaaatcctgaaagaggaaagaaagtgctgcctctttgcctgccaacacaatcagcctcaggggctaaatttgtagttctgtgtgacttgttctatttttaaaactgtaatgagccagtaaatctaatcatccaaactgtaaagcagtccattgtatttgggaaatggagtgtaatctgcatggaaaagaccatacctttctgaagagaaaccaatgggatgttagctgggtccctggttttaaaagtttagactcaagtacgtggtataaaactcatcactagggtaatgttacagatgaagaaactgaggcacagaaaggtgaagggacttcctcaaagtcacacaacagatcagtgtttgaggtgaaatccaaccataaacacacagtccctgcgttccttgaacagccctctaaagcttttggtcagagctccttgtatgatgtctgctttcctgcttcttgaattaaccgcaacaagagccactggccagccaatccagctgcaggtcaagtggcccctctcatctaatcgtaaccactgcaaagaggcctgacagcaatggagtcagcttggagtgtgttttcttgtagctcgtggatggcaagcccagaaataaactatgggctttattgttggagtaagagaatgatttacaaggccctggcaggtcatcggccttggctctgatggaaagaaggaaatagtctggggctgcaatttcagggagtaacaaatagtcacttgaaaccatggtttcagcttgagattccaacttggctttgtgttttcctgccagttaactaatttctgtttgcctaacataatcaaactgagtagcaacttcctcatgtgcttctaaaacagtctcttcccccactccccatactagaaaggcacccagcattttttaaggaactagactcctttgactattgaacagtgatctcagactttagcttggaatgtgtagagtatcttgtgatcagaccagggaccaaggtgaacactgggtgccaatagcagttactgcagggtttgactttctagaatcaaaacccagatgggaaatgacactgtcagaaattaggcctgaaagatacaatgagcccacatacaaaattattcaaaatgtgttatcagacctcaagaaatatagaagcaggtaaatgtttattatttattccaaacgtgatggcttttaactagtgaagaggcacgcccagttttcttagtagcaagccacatgaccacagatacctgggtgtggaccacatgaatcctttattcataattatgggaattcaaatggtccatgcttgccctacaagttctggcagggaccaagtacatacagatgttcagttgataccaattattctatttgtcaggatcccccacaatgcccagtttcaagatgaaacttgggtaggatgaaaggttatagaattacactcaggctcaaatatcatcattaatgtataaaagccagctagtgttagaccaggcagaagcagtgtgttaggccattcttgcattgctagaaagaaatacctgagactgggtaattaataagaaaagaggtttaattggctcatggttctgcagactgtacaggaagcatagctctggcatctgcttggcttctaggaaggcctcagggagcttttactcatggtagacggcaaagagggggcagacacatcacatggaaaagcaggagcaagcaagagagaatgaggggaggtgccacagacttttaagtgaccagatctccctggaactcactatcacaaggacagcaccaagccatgggggattctcccccatgatcaaacgcctccaccagaccccacctccagcactggggattacaattcagcatgagatttgagtggggacaaatacccaaaccatagcaagcagttacacagctgttgtgcttgtgtgatggagcttattagatactagtggcccgccagcttaagggttaggcaactcgtaaaaacgtttttgcttttctaaaaatcttagaccagccactccttatgggtcacagtttggagactacagttcaacctgtcacttgttagtgcctcaagtttccattctctccatcattcacttctctatgccagacttttgtccaattgtcttgttcaaagatggattaaccatgccattaacttgaccctttcacatctactaggtacctgattctatcgttctccgcatggctgcaaatctcaatttaatcatttcttactattcagattctaccatgatggcctggtggtggtgatggtgtgtgtgtctgtgtgtgacatacgtcatcttgtttcgttctaaaagcagccatgctcattcccattttacagatgacaagatgagaggatgcagtaatgacatggtaacaggtgccagatgaatgcagacctcataggccaggacagtttagctcaagtgggaaacgactggagggttgttaggaagtacatgatgtgatctgccttatgcatttgatcactgtggctgccactgtgtgaataacagacttggtgataagagtatcgaggagcctgcgaggtacttcagaagagagttcatagcttctgttgcccattgctaatccttgatcttcactcacccagcaggctgaaagcaagtgagggaagctttggtgctgcctaggatagcaagatactggttcttctcccacatcccctccacccattgctgctcaagtgccccttgggtggagtggttggaagcagactcaacaggactgactgctgtcaaaccctcttccctttcagactcagtgacactgatggctctacctcaggaaggccacgagccaagaatatcccataaggctaagatgcttgatagcctgctttggtttggttctggttttggtaagaagggagttatggggtgttgggggacatggggaaagaggtatgatgatgaaagacaaattgaagtaaaagctggctgcgatgaccagtgaaagagaggaaaggagaagaaaggaagtcacagaaagtgcccacatttaccgaagattcttatgatgccaccaatccagggactatggaagcagtaaaaagagggtttggggcttcatcccacttttgtgtccctcacaaatgtttggggtggcagattattctgcctaactaccattccaacccctttcctccctttatatctcccttcatttttttctttctctctccctcccttccttccttccaacctgagaggcttttgatctgtcatgtagctgatttcaggatagtcattttctttttacgtgtataaggcactttcctactaaatcggagcttcccaagaacagcaattgaatcttataattgtacctcctgaggtgcttggtacatgctacatagatgattgatggatcctggcatgattgatgccaaggtctctcatctatgagacagagataagcattctgatttcgtggcttgttagaaagatcaaattagacagcatgtatgagcatctctgacacacagtaaatcttcttcaataagtctatgaatctgaattaactggggtctttccacaatcattgggccaaacccatcatcagttatttggattgggtggatgtggccttagtcatctgtgtctaagaccgcccactgggagatgggtacatctctcattatgggaagccacagcagagtggggcaacatgattttctgatagggccacaagttctgggagtgattatattggaccagcatttctgaattcataattgtcagtttcttacctggaagtttgcctccccaagctaagttctccctctctattgtgtgtcccatggtcactgaagacagctatgcttttaataagcaatcatttgtggagcggctaccagggacaaggcattatgttaggggctgtgagggagaccgacagaaccaccatttgttgagtattgttttctgtgtaccaaactctgagctaggccttttatataccttatttcatttacaaagatgaataaagtttctcaccatgaggaggtaaatattatttaaggaaataagcatatagacacaaaaggataatgaagaaggaagaagtcattgctaagggtgtggtcatgaaagtctgcaaatgaaaagttggatttgatatgggcttgcaaggaccagcaacatttgggaagggagagagaagaaaagtaggccaggccggacgcggtggttcacgcctataatcccagcactttgggaggctgaggcgggtggatcacctgaggtcaggggttcgagaccagcctggccaacacggtgaaaccccatctctactaaaaatacaaaaattaggcaggcatggtggtgggcacctgtaatcccagctacttgggaggctgaggaaggagaatcacttgaacctgggagacggaagttgcagtaagccgagatcatgccactgcactccagcctgggcgacagagcgagattccctctcaaaaaaaaaaaaaaaagaagaagaaaagaaaaggaggccatccactggaagcattgcatgagcaagtctacaaatggggatgaatttctgtgcccatcaggcattgaggaacccactcctgaggactgagtaggataaccccctccaataactgagagacaatagcgtcagcgtcaaacaaacttggactcaaatcccacttgtgtcacacactaactaaattagtaaacctttctgagtctcaatttcctcatctctaaaatgggaataaaacgtttcatccccagagtctgaaagaggattagatcaagttatactatatgtaaagtacccagccctttatgctggcaatagtgagaccagaaaaacagtttacatcatgtactatgtggaaattgattgagcttctggtgttagagccccacatggtttgcaaaacattctcacaaacactacctcaacagagatagcctcccaataatcctgtgggtaggtagaggtggcatgactctgattcccattttaaatttgggaaatctgaggtttagagaagccttgactttcccaagttcctggctttagggtcagacagacctgagttcagaagctgactctgtcagtgagcagcagggacacttaacctctctgagcctcagcttctttatggcctgtggtcaactttttacatccacattatttcctaaatatttaattttattatttcaattcttgaatagatagtacaagtttcaaaaattaaaaaaatacaaaaagctacatgatggaaagtctccctcccacttctgtccattatgtgccctgttccaccacatcctatgggtaatctgtgactcctatgctagttttctgtgtatccttttctggtctctttatgcatatagaagcaaatccaaatgtgtgtgtgtgtgtgtgtgtgtgtgtgtatatatatatatatgtacttctgcaatttacatcattttttaccaacacatcttgggtattttttcatatcagtaccttccagcttccatatttttttcacagttgcatagtatttcattatatgactatacaccacctttacctacccacaggattattgggaggctgtctctgttctggtagtgtttgtgacagtactttgcaatccatgcagtcctttttttttttttttttttttttttttttgagacagagttttgctcttgttgcccaggctggagtgcaatggtgcaatcttggctcatcacaacttccacctcctgggtttaaccaattctcctgcctcagcttcctgagtagctgggattacaggcatgtgccaccatgcccggctaattttgtatttttagtagagatggggtttctccatgttggtcaggctggtctcgaacccctgacctcaggtgatccacccacatcggcctcccaaaatgctgggattacaggcatgagccaccgtgcccagcctgcattctcctattgatgggcatttaggtcattgccaatcttttgctattataaacaatactgcatattgcatataaacatttgcatataaacaatactgaataaccttgtgcatatgtcactttctatatgagtacactgtaggataagttcctagaaatacagttactagatgaaacaatttgtgcatttgtaattttcatagctgttgccaaattgtcctccatcaggttttactcccacccacagtgtatgagagtgcctgtttcctcatgtctttaccagctcagcatgttaccaaacccttgtatttttgccaatctgacaggtaagaattctatcttgagggagttttaatctgaatttgtcttactatgaatgagattgagcgtatgtccatatatttaaacaactatttgtattttcttcaccgtgaactgtatgttcataatctttgcccatttttctactgagttgttgggctttcatattttataagaaggaaatttacatagggaaaagtgtgtattagaaacctaagccctttgtttgtggtatgagttgcaaataactttctcatgttgattttgctccttacgtcagttatttttttctgtgtacaaaccatcccaaaattgtttggctagaagcaacagtcacttgtttgctcaagattctatggtttgggttccgctgagacagttcatctgtattcgtatggtggtcacaggttccaggaaacagcaagagagcaagcaccaatgcccacgtgctttaagaccctacttgcatcacatttgttattgtccctgtggctaaagcaagtaatatggcaaggctagagttaggatgggaagggaataccaaagatgtgaataaaaggaaggaattttgtggctatttttgcaaacaatctaccacacttatgacatttgtttgcttggtttttatttcttttcttggtgatagtggtgttagtttatttttctatcaagtatgaaatttttaagtaatgcagtttgtaatgcaatcttttccttcaaaggttctgagttttgaataataattagaaagcccttccccactctcagcttatgaaggtaattcctattttcttctagtacttttacggcttcatttatcacatataaagtttgatccatttagaattcacctttgtgttcactccacatatatgttcttagctaaagcctagttctcctctatttgggaaggttgtcttttcattcgggattggcaaagttatgaccaataacaaacaacttttaaatctcagtggcttttaacagcatggtttatttctggctcattctatgtgcccatcatggtttggcataagctcagttccatatgaaccttcctccaggccccaggccagtggaccacttccatctagtcttccattaccagtctcgcccagagggagagaaagcacaaccaagcatgcactgcctctcacagcctcctcttggagatagcccatgtccctcccattcatatttcattggctaaagcaagttacatgaccaatcctgctgtcaacagggtagcaaagtacaatcctcccgagaccttagggacagcaaatattgggaacatttcatcctccatcatcgtcctttctgttgatgtgcagctttgaaaaagcacacacctggagccagaagcaggctggggagcccatctcaccaggtaggccggcacatcatcactggcctgtgatgatgtgtctcagagccaaattaaccccacacccaacctttctctccaagatcttgcatcctgctcagagcagagagcatgtgtgcagtcaggagcagcagagtggagatagggaggaaagtgggaatcctccagggaacattaggatcaaactgtgtcccactatcttaatccatttgggctgctttaatagagtaccatgaactgggtagtttaaacagccaacatgtatttctcacaattctgaggctgaaagttcaagatcggggtgtcaacatggtcaggttgtggtgagggctctcttctgggatgcagactgctgaccttttgtttttcctcacatggaagagagaaggtgagagagctctccggggtctcccagctttttgttgtcgttcttgttgttgttgagatggagtttcgctctgctgcccaggctggagtgcaatggcgcgatctcagctcactgcaacctctgcctcccaggttcaaatgattctcctgcctcatcctctcgtatagctgggattataggcacccaccaccacgaccagctaatttttgtatttttttagtagagaccaggtttccccttgttggccagggtggtctcgaactcctgacctcaggtaatctgcccacctcagcctctcaaagtgctgggaatacaggcatgagccaccgtgtctggccaggggtcccttttataaaggcactaaatctcattcatgagggctcctccctcatgatctaatcacctcccagaggtcccatctcccaatgccatcacatcagggattaggatttcaacatatgcattttggaaggacacattcagtccatcacacctcccaaaaagatatactagagtcctaaacatccccctttagtacctcagaatgtgacttcatttagagttagaatttttttttttttttttttgagacaaagtcttgctctgtcacccaggctggagtgcaatggcatgatcttggctccctacaacctctgcctcccaggttccagcaattctcctgcctcagcctccccagtagctaggattacaggtgcacaccaccacacccagctaatttttgtatttttagtagagatggggtttcaccatgttggccaggctggtctagaactcctgacctcatgatctgcccaccttggccttccaaagtgctggaattacaggcatgagtcactgtgcccagcctggagttaggatctttagagaggtattcaagttacaatgaggtcattagggtgggtctaaatccaatatgaatggtgtccttatttttttattttttattttttattatactttaagttttagggtacatatgcacaatgtgcaggttagttacatatgtatacatgtgccatattggtgtgctgcacccattaactcgtcatttaacattaggtatatctcctaatgctatccttcccccctccccccaccccacaacaggccccggtgtgtgatgttccccttcctgtgtccatgtgttctcattgttcaattcccacctatgagtgagaacatgcgttgtttggttgtttgtccttgcgacagtctgctgagaatgatggtttccagcttcatccatgtccctacaaaggacatgaactcatccgtttttatggctgcatagtattccatggtatataagtgccacattttcttaatccagtctatcactgatggacatttgggctggttccaagtctttgctattatgaatagtgctgcaataaacatacgtgtgcgtgtgtctttataacagcatgatttataatcctttgggtatattcccagtaatgggatggcttggtcaaatggtatttctagttctagatccctgaggaattgccacactgacttccacaatggttgaactagtttagagtctcaccaatggtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagacaagtagattgcaaaaattttctcccattctgtaggttgcctgttcactctgatggtagtttcttttgctatgcagaagctctttagtttaatgagatcccatttgtaaattttggcttttgttgccattgcttttggtgttttagacatgaagcccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaacagggaatcctttccccatttcttgtttttgtcaggtttgtcaaagatcagatggttgtagatatgcagcattatttctgagggctctgttcttttccattggtctatatctctgttttggtaccagtaccatgctgtttcggttactgtagcattgtagtatagtttgaagtcaggtagcgtgatgcctccagctttgttcttttggcttaggattcacttggcaatgcgggctcttttttggttccatatgaactttaaagtagttttttccaattctgtgaagaaagtccctggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagtaattgtgaatgggagttcactcatgatttggctctctgtttgtctgttattgatgtataagaatgcttgtgatttttgcacattgattttgtatcctgagactttgctgaagttgcctatcagttttaggagattttgggctgagatgatggggttttctagatatacaatcaggtcatctgcaaacagggacaatttgacttcctcttttcctaattgaataccctttatttccttctcctgcctgattgccctggccagaacttccaacactatgttgaataggagtggtgagagagggcacccctgtcttgtgccagttttcaaagggaatgcttccagtttttgccaattcagtatgatattggctgtgggtttgtcataaatagctcttattattttgagacacatcccatcaatacctaatttattgagagtttttagcatgaagcattgttgaattttgtcaaaggccttttctgcatctactgagataatcatgtggtttttgtcttcggttctgtttatatgctggattatgtttattgattgcatatgttgaaccagccttgcattccagggatgaagcccatttgatcatggtgggtaagctttttgatgtgctgctggatttggtttgccagtattttattgaggattttgcatcgatgttcatcagggatattggtctaaaattctctttttttgttgtgtctctgccaggctttggtatcagaatgatactggcctcataaaatgatttagggaggattccctctttttctattgattggagtagtttcagaaggaatggtaccagctcctccttgtacctctggtagaatttggctgtgaatccatctggtcctggactttttttgttggtaagctattaattattgcctcaatttcagagcctgttattggtctattcagagattcaacttcttcctggtttagtcttgggagggtatatgtgtccaggaatttatccatttcttctagattttctagtttatttgcattagaggtgtttatagaagtctctgatggtagtttgtatttctgtgcgatcggtggtgatatcccctttatcattttttattgtgtctatttgattcttctgtcttttcttctttattagtcttgctagcggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagtacttttaattgtgatgttagggtgtcaattttagatatttcctgctttctcttgtgggcatttagtgctataaatttccctctacacactgctttgaatgtgtcccagagattctggtatgttgtgtctttgttctcgttggtttcaaagaacatatttacttctgccttcttttcgttatgtatccagtagtcattcaggagcaggttgttcagtttccatgtagttgagtggttttgagtgagtttcttaatgctgagttctagtttgattgcactgtagtctgagagacagtttgttataatttctgttcttttacttttgctgaggagtgctttacttccaactatgtggtcaattttggaataggtgtggtgtggtgctgaaaagaatgtatattctgttgatttggggtggagagttctgtagatgtctattaggttgctttggtgcagagctgagttcaattcctgaatatccttgttaactttctgtctcattgatctgtctaaggttaacagtgggatgttaaagtctcccattattattgtgtgggagactaagtctctttgtaggtctctaaggacttgctttatgaatctgggtgctcctgtattgggtgcatttatatttaggatagttagctcttcttgttgaatttatctctttaccattatgtaatggccttctttgtctcttttgatctttgttggtttaaagtctgttttatcagagactaggattgcaacctctgcctttttttgttttccatttgcttggtagatcttcctccatccctttattttgagcctatgtgtgtctctgcatgtgagacgggtttcctgaatacagcacactgatgggtcttgactctttatccaatttgccaatctctatcttttaattggagcatttagcccatttacatttaaggttaatattgttatgtgtgaatttgatcctgtcattatgatgttagctggttattttgctcattagttgatgcagtttcttcctagcctcgatggtctttacaatttggcatgtttttgcagtggctggtaccagttgttcctttccatgtttagtgcttccttcaggagctcttgtagggcaggcctgatggtgacaaaatctctcagcatttacttgtctgtaaagtattttatttctccttcacttatgaagcttagtttggctggatatgcaattctgggctgaaaattcttttctttaagaatgttgaatattggcccccactctcttctggcttgtagagtttctgctgagagatcagctgttagtctgatgggcttccctttgtgggtaacccgacctttctctctggctgcccttaacattttgtccttcatttcaactttggtgaatctgacaattatgtgtcttggagtttctcttctcgaggagtatctttgtggcgttctctgtatttcctggatttgaatgttggcctgccttgctagattggagaagttctcctggataatatcctgcagagtgttttccaacttggttccattctccccgtcagttttaggtacaccaatcagatatagatttggtcttttcacatagtcccatacttcttggaggctttgtttgtttctttttattcttttttctctaaacttctcttttcatttcatttcattcatttgatcttccatcactgataccctttcttccagttgattgaatctgctcctgaggcttgtgcattcatcatgtaattctcatgccgtggttttcagctccttcaggtcctttaaggacttctctgcattggttattttagttagctattcatctaatcttttttcaaggtttttaacttctttgccatgggttcgaacttcctcctttagctcggagtagttcgatcgtctgaagccttcttccctcaactcaactcaaagtcaactctcaactcaaagtcattctccatccagctttgttctgttgctggtgaggagctgcattcctttggaggaggagaggtgctctgatttttagagtttccagtttttctgctgtgattttccccatctttgtggttttatctacctttggtctttgatgatggtgacatacagatggggttttggtgtggatgtcctttctgtttgttagttttccttctaacagtcaggaccctcagctgcaggtctgttggagttttctgaaggtctactccagaacccgtttgcctgggtatcagcagcggaggctgcagaacagcagatattggtgaacagcaaatgttgctgcctgatcgttcctctggaagttttgttccataggagtacccagccgtgtgaggtgtcagtctgcccctactggggcgtgcctcccagttaggctactcaggggtctgggacccacttgaggagacagtctgtccgttctcagatctcaagctgcgtgctgggagaaccactactctcttcaaagctgtcagacagggacatttaagtctgcagaggtttctgctgccttttgtttggctgtgccctgcccccagaggtggagtctacagaggcaggcaggcctccttgagctgcggtgggctccacccagttcgagcttcccagctgctttgtttacctacttaagccttggcaatggagggtgcccctcccccagccttgctgcttccttgcagtttgatctcagactgctgtgctagcaatgagcgaggctccgtgggcataggaccctccgagccaggcacaggatataatctcctggtgtgccgtttgctaagaccattggaaaagcacagtattaggatgggagtgacccgattttccaggtgccatctgtcacctctttccttggctaggaaagggaattccctgaccccttgtgcttcccgggtgaggagatgcctcgccctgctttggctcatgctcagtgcactgcacccactgtcctgcacccactgtccaacaatccccagtgcgatgaacccggtacctcagttggaaatgcagaaatcacccgtgttctgcgtcgctcacactggcagctgtagactggagctgttcctatttggccatcttggctccaccccaaatggtgtccttataaaaagaaaaagttcggacacagaggcagatgcatagaggaaagatgatatgaagagatataaagagaagatggccatctacaagccaaagagagaggtgtggaacagatcctttctcgcaggctcatgcctgtaatccaagcactttgggaggctgaggcgggcagatcacttgaggccaggagttcaagacaacctgaccaaaacctgtgaaatgtggtgaaaaccagtctctactaaaaatataaaaattagctgggcgtggtcatgcacacctgtagtgccagctactcaggagactgagatgagaggatcacctgatcccagaaggtggaggttgcagtgagctgagatcatgccactgcactgcagcctgggcaacagagtgagaccctgtctcaaataaataaatcagtgtgggttctgctgaccagggattccactcaggccccaggacattctgacttagtgataacagtaggggtcacacaaatttgtgaactggtaaatcaataggcagggctgctaggaatcgatgcctgagggcttctggctgaaggatgaggaaggaggaatggagaggaagcatagcatctgccttagatactggtcctctgcctggccagtgacgaagcaatcagcccttcccttatatggaggccctagtaactagtggaagaaagtcaaggtctcagacaaagtgatagctcgttaatatttcaccagatgtcagcatccctttcaattagccgtttgaagtttgctatattaagactacaaggtctgctcttcccagctctgcaaaatattataagatctcttctcctttagcaggattccaaattcctgctaatgacaaggtgtttatcagaattgagactacctttgcagaaattataacagtgagaaaattatggcagttggggagatctgatctagccaactcatttctggcctttagccttcaagctatacttaattattactgggcttgggccaagctaattttgggagacatttagtttatagtttaagtgagaatagcccttccgccaaacttaactgcctttgtaaagctaatgagagaccaccaggctaggaggataggggagcctgaattctgctaaggtgtagacataaacaattgccagccattactccagaagtcacaatgacacaggatttttcttgatcactctgccagttggagagctcctgccagcaatgcccctgcccaggccttgttcaggcccaaccctttgattgtcagcatgacctcattttttttggacatgggactggtgaagggcagctgccccatgcaacggaaagcagtggtggtgccaagtttgccccagagctgctggcgagagtggggcaaggaaatgacagagctgttaacatgccactgtccactaggcagcagaagccgggactataagagctaattagcatgctgtaacaccccctctggggctttggggtcatggacacccctgcctaggtgccactgcattccccttgtctggatgccagagaccaccaggggagtggcttgcaacatgcctggtccagtcgcaagcacagcacagagcctgcttctgtgccagcacttggaacaaccggctaggtccacattcactcatgggcgggtgctcttcctatcagagccagaatgtgctgtgattccaaggaaatgtaagccttatacgcaggaaaatatgcagctacacaatgagaaaacagagctccaggtgactgggctatttaaataattttttaaaaaaattcataggccgggcgtggtggctcacgcctgtaatcccagcagtttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagtgagactccgtctcaaaaaaaaaaaaaaaaaaaaaaaaattcataagacattttggttccagatacattaagtaatctctgtctctctctttccccaagatcaacaaggagagaatagattttgtgcttatctcctacgtctgctttacctttgtcctaatcataaattgttcctctatctcaaatgcaacttgttctctgctgcctctaatagtgtcaatccagctcagaagacatctcctctggaaaatgactgatcacaccccaagttgatccctgcttactcatccatcaaatgttactgagtgctttttatgcctggcacggtgctaggacctgataacaaaaaaagatgaacgaggcctagtttttaccctccaagagctcacagactagcaatgagatagatgcataaatggaaaatagtaccattactgtgtgctgtgaaagaaaaatgtacatttatccaacaaacatctaatgattgcttactctgtgcatgccttatgctggtgtgaaatacaaaaatgaataagacacctttctatttctaaggtgtgtctagtgaaggagacagacaattcaatggtcccaatttaggagcatagtaagtagcaccaggttcacatgggatcccgaagcatggcacctgccagatggtagttgttgggaaagtttcccataaattttatataaaacaagaaaaaggcagggatggattccaggtagaaagagcaacttgtgtaaaggcaggatggcttgggagagcacgctggcattttagagcaacctgaagcagtgcagtacggctggtccacagaggaccaaaaggagacatgagggaaaaatctggagaggtaggcagaggccagaccacaggctctggagaggcattggtcatttcaagcaggcaagtgcctcatcagatttgcattttagaaagatcattctagtggaagtgggtggatcagcacaagtagaggcagactaggaaaaggacactatttaatagtttaattcaaattggaaatgatgagggaggaaatctgggcaatagtattggggatagagagaagggatggacttaggaggcatagaggagttttacgggctgaattatgtctctcctcaaaattcataaagtcctaaccccctgtatttggtgataaggcctccaaagaagtaattaagttaaaatgaggtcatcaggatgggccctaatccaatatgactggtgttcttataagaagaggagattagggctggcactataatcccagcactttggggggccgaggcgggtggatcacctgaggtcaggagttcgagaccagcctggccaacgtggtgaaaccctatctctactaaaaatacaaaaaattagctgggcatgttagtgggcacctgtaatcccagctacttgggaggctgaggcaggagaattgcttgaacctgggaggtggaggttgcagtgagccgagatcgcgccattgcactccagcctgggcggcaagagtgaaactccgtctcaaaaaaaaagaagaagagatcaggacaaacacacacagagggaaggccacgtgaagacacagggagaagaaaccatctacaagccaaggagagaggcctcaggagaaactaactccgctgacaccttgatctcagccttgcagcctccagaattgtgagaaaatacatttccattgtttcaaccaccagtctatggtacttttttatggcagccttagtagactaacccaaggaggaggaatcagggatgtagggagccaggcaggcggaataaagggtgactttgaggtttctgactgtggcagcctagtgtgggatgctgttgtgttccaaaagatgtgacctagggggagcagccgggttagagatgggagatggtgccttctagacagccgattggagatgtccactaagcagctgggtatgtggggttggggcttggtcaagggaagggagctgaggatgcagatattgtgatctccagagcagtcgaagcagagcagtggtcaaggttgcccagggcacatgtgtgctatgagaagaaaaggcagaggacaggaccacagggacccctatcacttatgggagaggcgaaggaaaagggcctgggcacaagacagtgaggggcattagtgagagtctcagagaacagtgtcaggggagccaagagaggctttcaaatgctggagagttcaatgtttccaagactctctctttacacgtgcacgcgcgtgcacatgcgcacacacacacttttgggctgttgctttgtaatgatttccctcattattttgtgtgtgatattcttcaagttttggagtcagaaccagagtactgtccatttgcttctccagaggcagcagaatgcttttcagctccacatccctgccaggtaatgcctgccctctaacaggtgggccacttcagctacattttccctctcactcggaggtgtctctgctgggttgtcttgattttccctccagggtcatccttagctgtccctttagtgatgatgcatggctagaagagagaaactccatggctctgccccagggtgtttgaggtggggctgcttttttgttttttttttaagacagcatcttgctttgttgcccatcgtggagtatactggcacgatcatggctcactgcagcttcaagccccactcaagtgatcctcccaccccagcctcctgagcagctgggactatatgcccagctaattttttgtttgttttcctgttactagatggattctttttttttttttttaaattttgtagagacgaagtctcagtatgctgctcaggctagtttcgaactgctaggctcaagaattcctcctaccagccaggcgcagtggctcatgcctgtaattccagtacttggggaagtcgaggtgggtggatcacttgaggttgggagttcgagaccagcttggccaatatggagaaaccccgtctctactaaaaatacaaaaattagctgagtgcggtggtgcacctataatcccatctacttgggatgctgaggcaggagaatcgcttgaacccaggaggcagaggttacagttacagagccaagattgtaccattgcactccagcctggacaacagagcgagactcagtctcaaaaaaaaaaaattcctcctaccttggcctcccaaaatattgggattataagcttgagccactgtgcccagctgaagctgctcttcttaaggctcattgaggggtagggcagaatccctgtgcctttggttggaattacagaaaccactgctcccactgccctcagcttccccagacccgggaagtgaccattcagcactggcactgcatagattccagggcatcaccctttacttattctggggaagggaaagcacatagacccgcctctcatttatccctcactgcaacccagtgagacacacattgaagtaaagtgatgttctcaaagccacatgattaattaggaacccaggaattgaacctagctgtttgactctaaaggtctttccactgtgaccttgccctctcctgctgccttattttcaccactcagttctctctgctccatctttactcaatggttgctccacctgcccatacgcaaacactaggaggatgctgctgaaggcctggagcaccttcactgcaaacatagtcagtcagcagcagcagtaagccaggcaaccagtcatgaaactttcccatccaaggtacttctgggggctggaggaaacaataaggagagagagagagaataagagagagagagagcaacgtttaggctttaacgagaatcttgcctagttggcaatctgctggatgaaatgtcagagatttttgctaacccactcacctttgacagcaatagcttctgagtattgggatctccagagagaggggcagttgaagcagagcacattcagtgtctttttggagtctcaaaaaaattgcaaggtgggaagtgctggccctctcctgctcccactgaaatgaagctggaagagaattgcacacccagctgggcatctcaggagacctaggcaagttcagtcttgagtgacaaactcagtggtcttgtcacttcagctcatggccttcctgaggtcccccagcatgagtctcctccacgagagacctgaccaatggtgacccagcctctgtttgagcgtcatctaccagcagagatggggactcctggccccaaggctcccagcatagcctgacactttgagctattccagtcctttcttattttgagattaaatctccctccctacagctcccttccacagtcaggaggaaagtcctgctgaatgcaggccctgaagcaagggccagggaagcttttcctcgtcaccctcccaaagtcaagacttggaaaggcagctctgagcccctggcttggctggctggccggagcaggcagccactgtgcctgcagggaattctgcacagccagtttcctcatacctgagccgtctacagctgcacgcaccactcccggcctcaacacactatttaaggccaatacacgggagctggttgtgagtcaccaaggaaggcagcggcagctccactcagccagtacccagatacgctgggaaccttccccagccatggcttccctggggcagatcctcttctggaggtagtatatactcttctctctatccttatgggtgaagggaacagcagtgaggtcttttggggatgctgagcactgctgggctgtcccataggaccccacctgtaattttatctgatccagcattgggccagcgggagcctggccagacaagagcctaactggatttgacttaacatcccacctcagctgctcaaggcacctgttcagggttagggaggtttttggttggtggcctgccatggagggctggcgcttgctgggcagcttggactgaggggagtacgtgccaagctgggcattcccctgagatgtcaaggctgtgagcaccatggggacactgagcaggctggtgtgggttgcatggtgggatggcagggaatccatgactgcgacagtggaggggatgcaggaggaccctttatgcagcccccagggggacggaggagaatgtgctttcattctctgtgggtgtgatttcttgctactcttgagcaattcacaccaacacccctccccaggcccccccagctcaaaggttgggtccctagttttcctaggagctccttggagaggagaacttgctgctgctgctgctgctgctgctgctgctgaactccccagagaggaagaaggaagcaagttccctcccctaccttttgcttctcccctgagctacattctagttgcctctttttccctcagaacagcatttaccctcctggaaggaaagagatggaaagtgcagggttttcttgaaatgattgattcagtgtcagtcacaactcaggacagtgtttagggaggctgatacttgttggttctagaggttgtttgaaggaccagtcctccaatttgtttctttttcccacaaaaggaagaaaagaagagagggaaggagagaggaaaggaatcctcaggtcaacagtgaaaagtttgtgaagagactacgagagtaatgttacttcccagaggcagcctagaaagttcttttccttgaaacaaaatatcagctcccctgactcgactcacgtttatctgaaatcacctgccgggtagcagaggtgaaggactctgcagggctggtgggggtggctgcagcggcacttctgcccccacccctgtgcctggctacagcactgtgctccaggagaagcagtgggtggcaggggcttccctctagacccttctgccctgagaggatgtccctaagaagcacctatgtcagaggagctagcattttgtgagtgactccttccctgccctgcactaggtgtcttagagcagcgtgtccaccactgccttgtgaagactcgttatcacctcagagaagttaaggccagatgactgtgaaactgtgcatgaggggatcttgctctgaaatcccaagctctctccccctgccacccttgcccctgctcctgccagtcccagttctccatgcccaccattcctccagccttgatcccaaggacatgaaacactcctcctgcaacaagtggctccattgttcagaggtcagatgggatgtgtgggctctctcgtaatgctttgcatccagtctgactggttttgctggaggattagcaggaggtgggtgttcaaaattcgtatcccctacccttcagaaacccactggaatcaacagagactcctcttgttggctcctgcatgccttgttggctattcatgctctgcagtttcagaagcagcgactgtccatgagggtggcagatcctttgtgcaagggacctccaggaagagggccaatgagcagcttcagtggggagcaggatcatgaaagctcatctcagggatgcaggtggagcctgcctggggtaactcttgaccctaataaccctcttcctttgtcataatggccttaattcataaaaatacctctcctggaggtgatcatgacagtggtgatgttggaacgctcatgaaagggcctgccatcctctgcagacccagtgagttattctcctaagtattcataatttccagagagcctaattccttcagatctcactctcagcatgcatgctgctcagggatggaatgctgatgtgcagattttaccgtgcctggcctctgtgcacatttaggaactgtgtgactagaaccctcctcccctctccccatcatggctgttgacagcagcagcattcgctcatgaaacatttgcagaatgcttgctaggaggacaggggtagaaaacccttgctctgagggggttaagttccagtcaacaatattaactgagcactcactgtgtcctgaatattgcactagacaatggggcaaaagtgactaagatgctgtcaaggtcataacctaatggaggagaaagactcccacataacaactctaacgcgccacccttaagtcctcagacaataagcacaggttgcaaggggagcacttccctcacccaaggcttttggggagggtttctgagccagagaatgggtgggctgtgtcttgaaaaatgagttcatatgacccaggtgaagaagggtggaaaaggctgtctaggtagaggaaacagaattaaatcaaatacaataaaactcatgaatgagcatggtgtgttggaaagctacacactactgtgtattatcatcataacatgaagtttgaggcaggaaatgctgggagatgaggctgagaggtcacaccaggtcacactgggccttcgatagactcagaactgggatttgtggtgatgaggagcccttacaggcacaggccatattggtgtccaactttcagcttccctgagcctataaaatctgagccttcagagccttcagaggggggtcaaggtggttttcgtctcaggtgggcagcaagcctggaggccagaagaagagttgggaaacagttgtggtcagagtatacaggatgacagggacctggcatagatgagagtgagagtaaagaactacaggaggaaaatggattcaggaaacactggacttaaaactggtgatatttgatcaatgattggaggggcaggtaggatgctgcagaataagagtaggtgaggcaaggggcagatcctggaatgactaccatgtttctggattgggtgcagtgagttggggacaaggaagagagaggagagctagttaatgtgttgagcttgagattcccctgggaccttcagatggggatgctccctgggcagcagagggcatgaggctaaaactaggagaggtcaggcctggggatagacatctagtgtcaatagctcaagggcaaggaatagtcatagggggtggctcctacggagagcatgtggagggagggaagcaaggggccaggacggatggctgaagaacaccaacattcaagggtgggcagaggaagaggggggtcagggaaagagctgagaataaatggcaagacaggtagcaagaggccaggatagagattaatggatgtcaacagagcagagtttcatggaacacacaaggctagtgatccataaacctttaccctgtttcatctgaaatcactagtgacaatggcattgataaaaacatgtcacaggaaggaagctactgagtagagaaggagcagggatctttctaccataggaaggtggatgaagtagagaatgagggatcctgggacaaggaggctcagggagtttgctttggaattttggtttcccatttctcctaagtttgcaagctggtgcctggctcagacatctcagaccttgaaggtcagagaaaacagtgcctcgcaacaccatggaagcttgtctggtaagaaaatcttgcttgagcctgggctgaggagatctcagcacaggccgtatttgtgtccaactttcagcttccctgagcctataaaatctgagccttcagaaccttctgagtccatcccgtgaacaggacaggaatctgcaaaatgagataaattgtacattggaagaaagacttaaataggtggcacctgtgttcctgctcctattgagggtagatgattttctgagtgttatgcttttcccccatctccacctgttgcaatgctagtcatttctttcaatattcagctcaaatgccacctccactttgaagtcttacaggatctttctagttgccatcaattgcccatcttatgttcatagtcagcatcaacagatatgaatatctgttcctgtgcctgtttccctcaccagggttcgctccttgagggttgggactctgtcatgcaccttgttgtagggaggcaatgtagcactatggctgtgcatctggattcaactccttgtgccaccatgaacatttaccctccaagagcttcaattgccctatctatgaaatggggcagataatagtacctaactcctagggctgtatgaatgatatgtaataattatgttcctggcacatcctaagaactccataaatgttagctattgctatactcattacttgcaactccctctacaatccatggttcttggttggctctccataaaaatttgttaacttcaatttcacgactccactggcacttctgatcctgaaacagatgttgcagtgagggtatactttggattaattgccccagggatctcttaaattcagttagctctaaaagaactctggagaatactcatagagttctccagattcttattctacaaaaaaaaaaaaaatgataataataaagtccaccacaccttttgttgtcgtgaatctgagacacaatccttctctaaacctgaggatgctaggatttagacttattaaatgtctgactcttttaatgccagtatagagcattaaaagttggtggtgaagagcttcagggtgggtgagatgcatctgggaggtcctagtgtgtacaagctcagcgtctagatctctgatgaggcactgctgacaccaagaacaacaacctcaggggccaattggagcgatgcgactatgaccaagcacgtggtaatgcttaactagctaaactgtctcatagtcctaatcatctccatttcacagatgcaaatgttgaggcaagttaccttgctcaatatctcctaggcagccaatggcaggaaccaacatgttactacctagtcctctatacctacttttattgaaaaattacctttctaatcagctgtgcttattctcttgctagttaagcagaacccttcatcactggcaaaaacacacctcctcagtgactgtcatggcagaagaattcttagctggccacgggaagagctgctcccagaattagctgcagcctgtggattgttggtctgtgttgcttcaggcagctgctctagatgaatgagtgcaggagtaaggagttactgaaactcagtaagaattatatgctggccaggcatggtggctcacacctgtaatctcagcactttggaaggctgaggcaggcggatcacttgagtccaggagttcaggagtttgagacaagcctgggtaacatggtgaaaccccatctctacaaaaaatacaaaaatcaacaaggtgtggtggtacatgcctgtagtcccagctactcgggactgaggtgggagaattgcttgagcctgtgaggttaaggttgcagtgagccatcattggtgttactgcactccagcctgggtaatagagcgagacccccctctctctctctctctctctatatatatatataaaaatatatatatgacatgtatatatacatatacatatacatacatatacatacatacatatacatgtacatatacatatatacatatatatacatatacaggacacgtatatatatacgtgtatatatacgcatatatatatgctttcagagcttaaaagttcagaaagtcagtacacctcattttatcaatgggataatcagaataaagtaggcagcttgtccaagggccatacattaaaaatggtagaacagggttttttcttttttcttttttgtgagacagagtctcgctctgttgcccaggctggagtacagtggtgtgatctcggctcactgcaactttcacctcccatgttcaagtgattctcctgcctcagcctcctgagtagctgggactacaggtgcatgccaccacacccagctaattttttgtatttttagtagagacgaggtttcaccgtgttagccaggatggtctccatctcctgacctcatgatccacccacctcggcctcccaaagtgctgggattacaggcgtgagccaccgcaactggccaaaacagggttttttcaagatcctatattgcccagggaccctagctaagaactatgttggaccctagcagaccacattttacccaagcagcaagaatccacaaatctgagagaccaagacttcatacatacttacttttgccatatgaaagtgtggaaataatgtggaaactggagttagtctgatctgtggatgtattccagctctccacttcctagctgggtgacctcaaggaagttacttaatctctctgtgtcttcattaccttatcagtaaattgggcattaataatagtagcacctaggtcacagggctgttataaagactaagtgagttaataaagtaaagagctcagagcagcgtcttgtatatagttagcactttatgtgttaattagtctcaaattattccctccgatgtttttgcagaaaaacagagacttgcagggagggagaggaatgacaagtccaacaatagcagctggacttaaggacattttgtgtctggaatcttttgggatttcaatggactcagacatcgtctttctagtccttgttctgtgaggtgcgggaaatcctctgccacctgaagtggtgaactagatgaaccctaaggccttccccatccaaactcgatgttcaaagtatggtcttccaaccagcagcatccacatcacctgggaactattagagatgcaaattttcattccccccatcctgcaaagaatcagaaattctgggggcagggcctggtaatctgtggcgtaacaagacctccaggtgattctctgtattagcagccgctctgtgctccctgattcctccagaaaagcacaaggatttaatccagatagatataaatttcacctgggatcatttatcattccacattcttctttaagaaatgtgctaaagagccacagatgggtcttgatgaaaacaaaggaaaagccatgaagtttctacaggtaagaaacccaggctacatttctctctgtgtgcgcttttcacaatcccaaaccatctgcctgcaatgcttctgatttcctatcacatcacttcagatgtgttcctgctgctgccagcacagcggtcatgggaaagagggcaggcagtttttcctctttctttttctgcaatttaaaatgaaaaatttcatagataaaaaccatgaaagatttgagagacagacagtgcatccataaaatttaggaattgtctcttgtagctccctgcctcacctcctcattgtgttttctcagcacctccacccccagaatggccatttcatacctctcttccctcttcaatcctcttacaacccccatcccttctccccaccccagcctcagatgattatcttgctctacccttcactgagaaaagagaaaccagcagacaggtactccttcatcttttcacatccaaaactacccgctaccctcactgggtgccctttttctttgcctcccctcctggtaccagaggatttgctgagctcctatcaaaggtcagcccctctgtgctctggatccatctcatctcccagctcgcaaacacctcctccagcagacatcatcaatctctcctctgcacctctattatccccatcagcatgcaacccgtgtatcaggattttctgtcttaaaagaaaactctctctcagccccacaacctctccagctacccaccccatctctctttttttccttttcagcacttgtcgctagtgttgtctggagtgagtgttcatcctggtttcgtggcattgtgaaaggagagtgaggtagaggtttcaagcacaggctggagccaggttgtctgggtccatccaactctgccactttctaactgtgagactttgggccatctagttatcctctctgtgcctggattcctcatctgtaaaatggggataatattagaatctacatcataagattgttataagaattacatgagctaagacataaagcgcttagcagcatattcttatttccttttcaacttactctagatggattttgtccccactataccaagatactgttccggtcagtgcctctaatcacctccacattgctgagtctaatgtttacacctctgttcttatcttgtcttcacttcagcattcaacacagatgtcctcaccacctccctgaagctctttcttctcttggtttccatgacactacactcccctgatttgctgctctccccctcactcctgacatcaagctggtctctcagcctccgtttctctatacccggttgctggtggcagcttttctcctctgctgccccaactcgaagccaccaagctctgtagtcaggtacaaggacataaccctttcatccatttcctatatttgatgattgaccctacttttgccaaaatacctaagtgttcaggaacagaatataacagtatgagaacaattatcctttaaagtggtgggcagaagcttcttaaagtcttacgaggcatgatagggtaagtcatgtaatagcaggtactgtgtgggagggaatttcttttcacatccagaggagccccaggcataagcccttaaagcttgagataaggtttccagacaggtcctggtggaaagccctgaggcaggagagagttagatgagggaggcaagaagctgagatttgatttcacttctgctcatccaaggaaactgccttctagcctcttccttctttcttccatttgttaaagagagaccaaatattaatgattctctgcagccaagagagaagcagccagatttgatgggaaagtcatggtgtcattttattggccttaggccaggggatctttgtctaatgaccataatgtagggtcatagcaatttagcaaaacaagccaagtttttaagctccccctcaccccatcccacagtggtcaccttcaccttggggccagctctgtgggtgcttccccataaaggggctatatctcttgggtacttactcatgccaggtcctccagaaggacagtatgcaaggaatattaggggcaggcttgcaaattgctgctggctcagaacctaggaacaaggctgcatttgggagtgggatgcatgcagggaaagggggagatcaggattccagaatttcccctacacagagggattcccccacagagccctggagagaaagccataatcccgagttactgtgcctttctggtcggcagctctgtgattctgctgcactgggactccctcccgcaggccaggctttgtctaaaggcctggacagaggaattctcttgggctatgacagtctcattctccatcaagaggctgctgaggggcttttgggacagtgacctaagcaagcccaggaagacattttcccgtggacacagctttataagttggaccttattccctaagttaaccctcaagagtatattctatattgtagttgtgcatttatgataggattatttttctactattttcctttcccattataaatgtatagaattgtctgggcagggtggtttatacttataatccaaacactttgggaggccaaggggggcagatcacttcagtccaggaattcgagaccagattaggcaacatgcagaaaccttgtctctacctgctgcaccccaccaaacaaaaaacaaaccaaaaaaattagcctggcgtagtagctgggattacgcctatagtcccagctactcaggaggctgacatgggaggttggaggttgcactgagctgagatcacaccactgcactccagcctgggtgacaaagtgagatcctgcctcaaaataaatagatgtgcagaacatctaaaacactggaatccaacagacatctagggccttgctggaaaagctaaccatcatttgtaaatagtgttgctgtaagatcctgtacagaacttcaaataaccaacttaaacacaaactttggaaaagagccactgggtggtgggaatacctgaagatttggggatctatgtaggcgggctacatctgggtaaggaggcaaagaagatattcaaagggtaatgtttacctgtcccttaggtcttggagtccacctagctcaatgaggaggtcagaggaacttaatactgaagtcctggctggaggtcatcttatccttgacactactctgcaatcttggaaagaatggggagggggtgcactgggatttttctcagaattctgttttccaggctggaaggcagcagtgagatcatggctcattgtagccttgacctcccaggctccagtaacctcccaactcagcctcccaggtagctgggattacaggtactcaccaccatgcctagccactttatttattatagagacagagtctccctatgttgtccaggttggtctcaaaaactcctgggctcaagcaatcctcccacttcagcctcccaaattactggaattacaggcataagccactgtgactggcccatagttctatccttataaatgactcttttcttttttgtttttgcccttttaaagcccaactgtgaatagttttttacatagttattaatacaatgtgtgtgcttttatgctctgctttttccatgaaaactttttgcattaaaacaaaattttaaagcaattttacagttaaaagaatccctgcaggctgggcgtggtggctcaaacctgtaatcctaggactttgggaggccgaggtgggcggatcacaaggtcaagagatggagaccatcttggccaacatggtgaaaccccatctctactaaaaatacaaaaattagccaggcgtggtggcacatgcctgtagtcccagctactggggaggctgaggcaggagaatcgcttgaacccagaaggcagaggttgcagtgagccacgactgcaccactgtacttcagcctgagcaacagagcaagactccatctcaaaaaaaaaaaaaaaaaaaattccttgtggccgggcacagtggcccacgcctgtaatcccagcactttgggaggctgaggtgggtggatcgcttgaggtcaggagttcgagaccagtctggccaacatggcgaaaccccatctctactaaaaatataaaaatttgctggacgtggtggtgggcatctgcaatcccagctactcgggaggctgaggcaggagaattgcttgagcctgtgaggcagagtttgcagtgagcagagatcgcgccattgcactccaacctgggagacagagtgagactcagtctcaaaaagaaagaaaaagaaaaatggtaatttcaaaggatttgacctaatatatattcttctaggacattcattatccatattagcatattaaaggatttcaaaaatcctatagacttaagtctgtttaattgtgattcacccaacattatgaaaatgtaatccctttaaaaataatacttgttaatgtacattaggacaccttcaagaaactaggcactggggtaattacaaaagaatagaagccacgaggagacaaaactatgtgaatgtgggagcccaggagcagcatctagggccttctcccaccttccaaactggatgcagatgctggctgagcagatgcccaggaaccaaagggcaggctggtatttttactttccaggaatgccctcccatatttgatatccaaagtcatatttttcaggtcttccccttctacagcagtgctttcttgactaaccttgccccacattggctttttttgtaactgacctatgctcttgcctctctcataaaagtatagggaggattcatgaggtgatatgaatggatcaccccgtatttctcaaatgacaggtattaaataaacgtgggtattgttttgactgccgtctcattgttataattttaattactttatctttcagggtattattctcatcttagtttataggtgttcctttcatttgctgacaactaccaggtgggtggtgctgatgtggatgcaggaggcgatgcagccctgggttgcttatgcctctacagagaatgtggatgctgaaggcacacgtagccagaatttgaattaatttttctgcagccactggagccaaatgtctaagacagggaatggaaatgttggatgggggtagaatcagagtacagtgaaacaatggccggccaggactaaatccccagtgcttctgcctttttttcttgttttactccactgtcccactatctggaatccttcccatgagagatcctttaacaggcttgtctgtcattcacatataacacacaagcctttaatagggctgtctgtcattcacatgttagtatgaccaattctctagagagtgagtaggcattttgacatcactgtgcagatctgatctggttatctagcagttgttagatgtgagtagaaataatcatgatacttcagggaagtggaagatgagagttgaaaggtagggtggggcttccctatgatagcacacgttaatttaattaaagtggttaactgtagctgagtaaggttgaagtgacattaaatggggccccaacagttttgtgtccctgcagtagaaggcagtgcccagagtgagtgtacctacaggagaaattcttggactttcaggggcattggtacaaacacccagttaccagcaggcatacaaacaagccttttgctttctcatgatggaaatggaagtacagcccttgacttagactcactgaagaagcaaacgctggcaaaccttgaacaagccatgccatctttcagatccttacctctcattttgttaccagtggagggtataaatatgttactggtggagggtggccaggttctcggagtcttgaacaaagaattgaagaaaatgcacaaagcaaggaaagaatgaagcaacaaaagcagagatgtattgaaaatgaaataatgctccacagggtgggagcaggccaagcaaaggggcgcaagagccctgttacagagttttcaggggcttaaataccctctagaggtttccattggttacttggtgtacgccctatgtaaatgaagaggatgaagtaaaggttcaaagtcgtttactcagtatactccctaagtaaatggagagaatatttactattatagctgaagtgtttccatttgacttagttctaggaagtcagcatgaatgggccctatgttccctgtctccagaccctattctcctgcctcaaatttgtcctctgtaaaagtcaaaaatatcctaataatatatcctgagttctctgagagcaatgagaagggggaggggtgtgaacattgctacttctctttaggtgcatgataaatctgttttctcatatttctacattgatattttctagtagacaaattactgggtcaatgaaatgcttgacttttatgggcttagcgaataagtacttacagtttcactaatactgaccccaacatattgtacttatcttaataaacatgttgtctaaaagtaaacgatgattttctgaggcagaaaaataggtgaactgcaagagaatctttttaatatgggtagaggctcctgctagcttcacaattttctacccttaaggcaaataaagttgtaaagaagtgagctgcaagatggtggctttcattagcattccccaaaggtgtcaaactgtgaaggaagtattctgtttatccgaaaattctaggggctccaggtgctgctggcttgagctctctggaactgaggctgctgtctaatcattgcctggggtagtttgtgagccatgtattgacttatgaagaacatgcttgctcacttaaatgaagaaaaacaagttatctataatttatagcatatattcacttgggtactagctctttctatgagagctcttctgaaaatgcaaaccactaacccaggaaagtatttaagttaccagctttatgggagcattaaatggagagatgcctgtttgcccaacatctaaaagagttagactgtactcttaaaaaaaaaaaggcagagttttcttttttaacatatgttttccttgtttgttttataagaataatattggattagtgtggaaaatttggaaaatacaaaaaagcacaaaggaaaaaaatatctatcggtcctaacctagagataaccactatttatatgtccttccagtcttttttttccgtctctctctctctctctctctatatatatatatatgtatttaatacatagtaaaatactgtacatattattttggaaatgactttctacttattggtcttataagtatttctcaaataaatcttcttctataatatgattttttaacaaatgcatagtattgccgctaatgatgaaccttaattcactcactaagttccctattgttggacatttaattgccttcaattatttgccaaaattattacatttattttattttattattatcatcaagacacagtctcactttgttgcctcacctggagtgcagtggtactatcatagctcactgcagcctcaacttcccaggatcaagtgatcctcccacttcacccttccaagtagctgggactatgggtgcatgccaatatgcctgactaaattttttaaatgtttgtagaggcaaggccttcctatgttgcccaaattggtctcaaacccctgggctcaggcaatcctccctactcatcctcctaaagtgctaggattacaggtgtgagccaccgcacccaatcctattacattaattttagtcaacactatagataaccttggaaatgtatcctgttgattctgtagaataaattcctagaagtagaattactggatcaaagttggctgtgcatatcataagccttctgatatatgtggccaaatttttcccctctccccacactaaagttggtaccaacttatgctcctaccaaccatttatatgctttaaagtaataactttcactaaagcctttttccagaaccagcactaaccctgccaacatattgaaaaagaaaatgacaaaattttaatttaacattaccatcttcttcaatatttgaggttttctttctcgtttcttagcctcccttctcttttttccccacagcttaattgaggtataattgacaaaaattctatatatttaaggcatacaatgtgatgatttgatgtacatatacattgtgaaacgattaccacaatcaggtcagttaacacatatactttacctcagttatttgtgtgtgtttgcagtgaagacacttaagacctgctctgttagcaaatttcaagtgttcaatacaatattattattattattattattattattattattattattttgagacggagtcttgctctctctccaggctggagtacagtggtgtgatctctgctcactgcaacctctgtctcccaggttgaaacaattctcctgtctcagcctccctagtagctggtactacaggcgccctccatcatgcctggctgatttttgtatttttactagagatagggtttcactatattaggctggtctcgaactcctgacctcaggtgatccacccacctcggcctcccaaagtgctgggattataggcatgagccaccgtgcccggcctacaaaacaatattattaactacaggccccatgctgtatattagatccccagaacttattactcttatacctgaaaatttgtaccctttgactaacacctctccattttccctaacccctatcccctggcaaccatcattcatctctctgcttcaatgagtgtaactttttaagattccatatgtaaatgagatgatatagtatttgtctttttgtggctgatatatttcacttagcataatgacctccaggttccatctgtgttaccacaaatggcaggatttcctgcctctcataggctgaataatatttcattgtaaatatgggacacaatttctttgtcaactcatgtattgatagacacagtttgtttccatatgatggctcttgtgaataatgctgcaatgaacgtgggggtacagatatgccttctagacattgattacatttcctttggatatatacccagtagtgagattgacagatcatatggtagttccatttttaattttttgaagaaccttcatactgttttccacaataactataccaatttacattcccaccaatagtatacaaatgttcctttttctctgcatccgcaccaacatttttatcacttgtctttttgataagggccatcctaacaggtgtgaggtgatatctcactgtggttttgatttatagttccctgatgattagtgatgttgaccaccttttcatttgcccgttagccatttacgtatcttctttgaaaaaaatgtgtattcaagtctttgcccatttttaaaacttgggttatttggtttcttgctattgagttatatgagttccttatatattttgacattaactccttatcagatatatggtttgcaaatattttcttctattctttaggttgcctgttcattttgttgattgttttcttcgctgtgcagaagatttctagtttgaagtattccacttatttatttttgctatttgcttgtgtttttggtgtcatatccaaaaagtcattgccaaaaccaacatcaaagggagcttttttcctatattttcttctggtagtttgagttttgagtcttatatttagtcttcaatacattttgagttaatgtttgtgtgtggtgtaagataaagatccaatttctttcttttgcatgtggactctggttttcccagtaccatttattgctgctgctgttggatggaatgttctatgtctattaggtccattttgtctgtagaattattgaggcctaccatttctttatggattttctgtctaaacgatctgtccattattgaaagtaggatattaaagtcccctactattttggttttgctgtcttttctcccttcagttctgttaatatttgctttatatatttagatgctccaagttggatgcatagatatatttacaattgttatacccttttgatgaattgacccctttgtcattatctttgttactatctttgtcttcacaacaaattttgactgaaagtctactttgtctgatataagcatagccattgctcttctcttttggttaccatttgcgtggaatatctttccatttcttcactttcattctgtgtcctaagggtaaaatgaatttcttgtagacagcatattgtaggatctttttaaaaaatctgttcaatcattctgtcttttgactgaaaaatgtaatccatttacatttaaagtagttattgataggtaagtacagtcatccctaagtatctgtggggaattggttccaggaaccactcccccaccccaaaatgcctgataaaaaaatccacagatgctcaagttccttatataaaatggtgtagtatttgcatataatttatgcacatctcccatatactttgaatcatctctagattacttaaaatacctaatacaatgtaaatgctatgtaaatagttgttatgctgtattgttattcttatttccattgttattgctgtgttgttattttgttttcttcctaatatattaatatttgatacatagttggttgaatccacagatgtagaacccatgaatactaatggctaactgtacttactatttcattttgttaattgttttctaagtggtctgaagtttctttccttctgtctttctgtcttcctttgtgatttgattacttttttgtagtgttattctttgattcatttctctttatcttttgtctactagaattttttttgagttatcctgaggcttacgtaaaatacctataacagtctattttaagctaacaacttaacttcaattgcacatgaaactctacaatcttacccccaacacacacatcttatgatattaatgtcacactttacatttttaatagtgtatacccattaagaaattatagctatagttatatttaatactgttgtcttttaacttttatactacagtttaatgtgattcctgtaccacagttacagaactagagtattctcaatttgactgtatatttactttttccagtgaattttatacttttatatgctttcatattgttacttagcatcctttaatttcaacttgagaaaccttctttagcatctctcataaggcaggtctagtagtaatgaaatctctcagcttttgtttgtgaatatcttcatctgtccttcatttctgaaggacagttttgttaggtttagtattttgggttgacagttgttttcttccagcactttgaatatatcatcccatttcttcctggcctgtaagacttctgctgaaaaatccaccagtagcttcacaaagtttcccttatatgtgacaagcctgttttttcctgctgctttcaaaattctgtctttgtctttggattttattttattataatgtgtcttggagtaatattctttggggacgctgcttaaaatcttttgagctctgtaaatttggatgtgtatatatatatatctatatatctcctaagaattgggaaattttcaactactacatttccctcccaccccacagggtcttgcttggttgcccaagctggagaacaggagttcagtggcatgatcatagctcactacagcctcaaactctgggttcaagagatccttccaccttagcctctgaagtagctaggactacaggtgtttttcaccatgcccagcttattttttattttatttatttatttattgagatggagtttcactcttgttgcccaagctaaagtgcaatggcgtgtatcagctcaccacaccttctgccacctgggttcaagcgattctcctgcctcagcctcccgagtagctgggattacaggcatgtgccaccatgcccggctaattttgtacttttagtagagacagggtttctccatgttggtcaggctggtctcaaactcccgacctcaggtgatctgcccaccttggcctcccaaagtgctgggattacagcaaccagtctgttttttattttttatagaaatagtgtctggctatctggctatgttgcccaggctggtctcaaactcctggctgcaggcaatcctcccaccttggcctccgaaagtgctgagattacaggcataggccaccacgcctggcctattacatctttaaatagtatgttttcccctttctctcttgcttctccttctaagactcccataatggatatatttgatcacttgatggtggcccaaaagtcttctgtgctttctttactatttttcattgtttttctttttgttcctctaaatgactgattgcaaatgacctgtatttaagttcattgattttttttcttgtatgatcaagtctgctgttgaagccctctatcaaatgtttctgttctgtgattgcattcttcagctccaaaatttctgtttagttcttctttatggtttttgtttctttattaaactcttcttttttatgtactgtttttctgatttttgtttaatggtctgtctgtgttcttttgtgcatctcattgagcttctttaagatgattattttaaattcttgtcaggcaattaatagactttcatattttgggttggttgctgaaattttactagtttctttggtggtgtcacgtttgcctgatccttcttaatgtgcatagacttgcattagtgtttatatattgtaaggaccaaacatctgttttagactttatagattggttttggcaggtaaggacatttgcctgtcagttccctggagtgatggtattgcctccaggattgtagttaagcaaggttggagtggggttacataactgctcctgagtctgcagcagggtccactgttggtgggcccattaccagtggcttgggcagatatggatcctgtctggaggagtcctagattttggtcagtagggctgatactgaaccaaaggtctgcctcaggatctgcagttgggtctgtggacagtgggcttgttatcaggtgtgtgtatggctatggctcctgccaagtctctgtgggaggatacctgctgagttagtaagcaggaaatactggctctggtctgtggctaaaaggggctgaaaccaagtcacagagttccttcagcatccacaattgagaccaaggttttcaggcctacctctgcagacatggatgggcatggctcctgccaggttcttgggtggttaggactgctgaggccacagcctgaaaaatgctgaaggtaggtcatagggctgcttcacaatcctcagttggactgagattggcaagtctgtcttcgtgggcacagacagctatgtctcccatcaagtcctgagtgaacaggactgttccataagcacagcagagagggactagcactgggtcataggctgatctgcagtccaaagatgggaacaagatcaatgggcctgttacctgaggcacttgtgtgtggtgtgtgactcctcctgggctccttagccgatggttctggtggcaggaccaagaccaaatggggttgtagctgaatccacagaggatgaagctatttctggatctgtagcttgtggtgggtgagtctgccaccaaggcatgagcctaccttggtcttgggcttcactggggttttgcaacctcctacgtggattccaaggctcccacaaaggcactggtatccaccagtggttgccaaattaacattgctgtgggggaataggagtgggggatctcctatcccattttactgatgtccctcttcttagctgccttcctcttaatttaccacccaactctacttccagtaaggtaactaatacattcatttacctagctatcgataactaatgagtgaaatgttatactaaatattttaatcaggaacaaaaacaaagaaataacttccttgttctaaagtttcattttattatcaagctaaagatgagagttattttggggtgaagaaagtccacctctgcagggcttcagatcgggtaaagcaggtcatctgttcctcttgttcctgatgctgacttttgccaagtctccctttcgtggaacgacagggaaaaacagttaaatactcacagacttttctttctctacccaacttctcatgaaaatcttggcaccttttgctaaatctccacattctccaactcacaattacgagttcaatggagtaaatcatgcagagaaaactgaaaaggaaatgagagaaagggcagaggatagtggacctgcaggtgcgagacaagaaaataggcagcagggtaggcacagagggagaagagacgaggaagtgaacttcagagagagttttgaggaaattctaggaaagggaaagtttgggggaactgataagaagggtagaagttggtaatgagggtctttttaagaggaagttttgctatgcgttatccatgtaatgcctttgatatttttctagatattcattggtttcacctaaacttttccgccaggctgatattttgtttaccgtgacactgccaaaacctagaccacagacatctggactttatatgggttataataacattgtatctctggagttagaaaactattttttacttatatataataattaagagcagatttctaaatgtgtgtttatatttagttaattgtaattgttcacataaaacgacctaaaattattcgcataaaacctacccaaaagtataatttaaggagtcattaccctgaaataaaaatacgaactgctttcaatggcctgaaggatcttgggggaaaaaatgggctgccatgcagctgggctgtgtcatggacatattttggtatagtagtagaatatgtcccaaaatcagatgagctcagtttagcatttatcagatgcctaggatgagtcaggcatgatgtctgacacttagagaaataaatgtgattggtgaattgattcagcatgaccagtagttataatcaaaggaataatttctttttatatctgaccttttaaagtgcacatatagaaatacatgatgaaacttctgaagcctctgatgaaaacctggtttcaccttcaattgcctgatattgcctcagtcccttattccccaaaagtctacttcacacatgactctcactgctcagttccctctcccggttattcctattggtgaggactccacatagttctaggacatctgccctgctggaagggtacacattccttgcttcataaaagagtggtgactctcgcagctctctgtgttccctctctctgtctctgtctgtccgtctctctccttctctctctcgctctctgatctgttctagatcatattgaatttctcaagtatgatttaaattctaatccatggtgttccccaccttaccccatcaagaacacattacaagctcttcaagttaagctttgtatttgtgtgttagagagggggaggaggatgtttacatagcacagaagaaaaaaaaatccccgaagaaatatcttcccaaatcttttcctaccctgggcccttttaatacccttcatctgagtgaggcagctaagcattatggaaataattgtcaaagtgagtgaagtgggtaagaattatggaaatgattgtcaaagatcccccctttttttagtttttttcttttctttttttcattttataatttcttttattttttattttttgttttgttctttaaagattccctttttaaactctgcatagtgatgtggcacctcactttggtatgcagcatctattttatcttggaacctcagttgaaactttaaatgtaacatcctgttacacaaaaatgaaaagatatggtccctgttcttgagaaacttagaggagactaaaggagacacaaatgtgtgaccagataatttcaatacaatgtaacacatttgtgttagagcaatgtatctggtataatgaggacacagagacagtttctgatgcatatggctagtagtttccctgaaaaattatctggagggaagctatacactaaagaaggaggagtctgtgtatctcacaaatgcactgacaggatcctgtatgtcattggggacttcatgctattgctttgtcccctagttcctcaagtgcctgaaggaacaataatgaaattataggttcttggtaatactgttaaattggtaaagtgggtaggaaaaagctccttttttttttttttttttttttttgagacaaggtcttgctctgttacccaggctggagtgcagtggcatgatctagctcactgcaacctctgcctcctgggctcaagcaatcctcacacctcagcctcccgagtagctgggactgcaggtgcgcaccaccacacctaactaatttttgtattttttgtagaggcagggtttcaccttgttgctgaggcagggtttcaccttgttgcccaggctggtcttgaactcctggactcaagcaatccacctgccttggcctcctaaagtgctgggattacaggcatgagccactgctcccggccaaaaagctccttttttaaaggtttgtaaaagggcccagaaatcttagcagccacctgtaaaaatagtaatcccctctgaatctgccctaaggaattcaagaacagggtcaattctggggcctgaataacactgtttaatttgatttatggagaccaggtatgttgcccaggctggtctcgaactcctggcctcaagcaatcctcccgccccagcctctcaaggtgctgggattccagatgtgagcaaccactggcctggataattcagatgtgtcttcctacagtgcccatggcttcatggacatcagtgaatgtacagagaatatctggacttgaagtggagagggaaaataaggggccccatccattatacctaccctctcattccctgcattctatctcttatccaattatttcttttccttcacaataactagttcatttcactttccaagccccagttccaacataaaacacaacattataaaatcacaaaatacttaaaaagcataagaatgaacttgcttctctaatactgctgaggcaggcatggaggaagctgtaaccagttaagggccttgcctggtttatgcttctgagccccagcatcttgaagacgcttcatttggctgtctaagcaggtacaatccactttatacactaagaaaatgcctccttgggggtccaaccacaccatagctacatgactcagatttaatacgattgttctaatttcagctatattacttattgtctctccaaccattgacatattccagaaattcgaatagctatgaagccaaactatgcctttcagatctctcatgcctggaaatagctctcatgaccattgttgaactacatttccagtttctggaaaagatggttcctataactagggaccatatttcagaacagtgaagcagaatttcatgcaaggaatgtgtgaaactaaaagtatctgagacaggtcttaatcaattaaaaaagtttattttgccaaagttaaggatgtgcccatgacacagcctccagaggtcttgacggtatgtgcccaaggtggttagggtacagcttgctttgatacattttaggaagacataagacatcaatcagtacatgtaagctttacattggttcaacctggaaaggtgggacaacttgaagtgggggttggggggcttcaaggtcacaggtagatttaaaaattttctgactcgcaaatggttgaaagagttactatcaatagaaaggaatttctaggttatgataagagcttgtggagaccaagattttatcacgcagatgaagcctccaagtaggcttcagagagaatacattgtaagtgtttcttatcggataaagcctgtgttgattgtaatgctggtgggcttttcttgaattctaaaagagaggaggatataatggggcatgtctgaccccctctgcttcctatcacggcctgaactacttttgctgattaactttggaatgcccttggccaagaggaggggtccattcaggtggttggggggctcagaattttatttttggtttacaaatgccactttggcactgatcaggacatccccagcctaggtatattttgattctgatggcagcccatggaaactttttctggtggaatgtggttggcttccatgaagtagtagaaaaattgcctagatggcaaaggaccaagaccctagtcattcctgcctcttttcccatagggccctggtttctgctgccacaacttggtctttcctgggtttctcaggaagaaacctgagacttgaagtgaccacttggaactgttgtatttgactgaaatatgagaaaatgtctctgcccttggtttgggtaagatatgcctaaaagatggaagaaactaagaaacattataaatataaaactaacggtgctagttatttatcctaacttcttaagtctaagtcaagatctgacttagctgtggcagcattagaggtaccagcatttgttccttttcttacctctgggttagcaagaagcaaagctaattagtttctagactaagggaaaactggctgggcattgcttccaggcctaggaggattctcagtccctaacagaatctgcctctaagtgtctctggatgaaacattcttctcctaactctatccttcacccctttggccttgaaacacaacacgcttggtatccacagtcaccctggctcttgctgtggtccttagcctctgagtagcaggaaagggagccaacatctttagtgcctttgctccatgccaggcactatcctcccaacgctacatacacacatcatgaagaagggcaccaagtgaagaaaggagcttcctccctggactttaaatattcttccctgaagctcagaaatatgctgtaagtattaaaaagatggtagtactgcccactgacacccctaccagccagcatagaattcaaagtataaagaacactgaactataaaaatacacacaaggtaaaaaaaattgcttaaagtcacttctttctagttttcctgattataaatttctagataagttcattgaagcttaacttttccctctggtcactttttgtgtgtgtgttggtcagggatggcagagacaggttgccactcctgcttggctaatgctggaaggacaagctcagtcagcctcgcagatagcccagtgctgcccagacttcaggtgactctggactggcctaacaaatgccttccatatcttaaggttcttgatagcttggactgctgcacagcaaagctggggcagggggagtaccagaaggcaacaacctcacttggtcttggtgctgggtaaagaaaaaaatatatattccctgaaactgtgtatatataagacagtcatcatgcagatttgaggcctgaattcataacatctccatttcccaaaacctctgaaaccaagatttcattttaaagggctcctacttggcagtgagtccccagcttgaatggccccttagctttgtctctggtgtttggtatggctctgaagacagaagcttttggtccctggaatgcatagccattgcgcccagcactctcttactgatctggactcatgtgctggtttcatttttagcctctgcaaatctccctcatttttcttgctggcaaaaatgaagtacccaaaaatgtgtgtgtggttttgtcttttatttttttctttttattcagcatttcaagtatttttatcaaggatttttttaaaggctatttagtatgcactattctggaaatttaactcttcattccctacaatgtcctttctcttttagagaaacacttctattttgccccttgtttgtggagagaaatgtccaagaggactcaagtttaacaagtattcaagcacagctattatgaatctctaggtccccttcttagccacagccaaccaggtcttccatgtacaaccctccaaggcattttgttacaatttatagcatcagcaagatttctgataccacaattttttaaaagactgtttaaagagaaagataaatgatcatttctcccataaatggtttctcaaaagttaagaatgtgttagtttctctcagtagcacagcatggatatttatttattcattaattcaacatattttaaagactatgtgctagacgctccaagggaagcagtctgtaaggtggggcatttattcaacaagcatttggtaagttccttgcatgttccaagaacttgaaaaataataggaacgaaggcatggaggcaagaagcagcctggcgtagtcagggacccagagtggtttagaatggatggagtgtggaggtgacgggagatgggagaaagtagtcacaggtttatataaaatcttcttgagcttatatttttattcaaactttcaggtttagtatgctttcttcgctttctatgcttaaatcaatactttatattttaatcttattctttttctttaaaaaatggtatcagaatgtatagaaggcttagaaaataaaacagacatcttgtgattcataagagctccgtagcccatctccaggtcagtgtcaggccctgggcttcagtgggtcagaatggcaaccaaaggtggggtaggtacaggacacagcacatagcatcaggttgggagtctctaccaggggaatgttgaaatctatagaagaaaactaagactggtgccctggaagtcaggctggaccagagagaaaagaccaagtaacagaatctgaaatcacgaggcaggccctgtgttgaaggcagctccagggagtaagaaaactacagattccaggctggaaggcctgggaagcttcctttgtgtctgctacagatggtcaggaccacagaagggttctacataaggttgcctccaccctaggacagggagtgtctccctgccttgggtttcagaatgccccttgacataggcaggcaagggttgttatggtaccagagcagccgcaggggctgcagccgggaaattgctcaggcaagccaggccctcaaggggtgggtctggcagcctgattttcatacctaaattctcacaagctctacatagctacacctacagaactggggcccagtctaaaatatgagaatgtaggtcccagcaggcgaggatttgcattggaactcctggtagatcttttggaagactgaacaatacatcctctacttacttctaggatacagtggtctgcttttcactgggaggactttctgccattataaaataaagatagtggatgacagaagacttggagtgtacaaatatgacattgtacatagagaaatcagactgcctaagacaggtgtatgggctttcgtagagagaagctctgagggcaatagacgtacttgtttccagctttattaatgaataaacagtgcactgatcccagggctaggctttccgagaagcagccagcccaagtgcttctctgaatctcttcagtgacaggcacaggtttcctgaaggcaagaaaaggaatgaaattcaaaacagtcacggtggctttagggtgttgcaaaggtaatctagattacagctcactctccctgtcaggccatccatctgcctgaggcccagatcacggtgactgatgaccagggtgactgatgaccacgctgactgatgaccacactgactgatgacctcgctgaaatgcacgtccctcacagggagcctgccctgttcttcctctcagctcttttggggcctagttccccctcccagctcctgtctcaaaccttagtgccactcaagcacttcctcctcttgtcttcacacatgttcagcctcctgaggttcacctgccttcccactcccttaaatccatttaaaaaagagaagggagggcacgttctgggctggccctcaggaaggagcctgaggcaggtcagagctgagctaggctctggatgggcctgcttctcattacctgggaagaggtggaagggtgttctaagcagagagcaactgggcagtgaacagtctgatgagaatacagggattcctaaagggagaagggttagaaaaatagctcggtgcatttaaaggtggtcttaaattctaggatcagtttcaactttcctttttcttttccatgaccaccagtcaagaacagtttgaactttcataagcaatcaggagttacttaaatttgggaatagtgaaaagtaaaaataagcatttactttttttttttttttgtaaagacagggtctcactatgttgcccaggctagtttccaactcctggcctcgagcaattctcccaccttggcctcccaaagtgttaggactacaggcatgaaccaccactcctagccaagaattaacatttatagttttaaaataacagctaatatttacattttgtaaggaagagtttgtttctttggaccctcacgatagccctgtggaaaaagtcgtgttgaatctggaggcaggtataggatgaattgcagtgttgcccaactgttcatgtctcctgctcctgtggagcccccattaggaaatgccgggttctctgtagagtggataaggggaggaatagcagcagcttctttttgttgcatccattccagaaatgatcaggctgtccctgagcagtgctcctgcccttatctatggctgggctggaggaggagaggtgagcagaagtggagagaggcggggagagcaaggggatgccaagattatggtggggaggagttggtgaatggacagcagccaggacaacagccaaccatgaaaagaagtgttcattagcagccagatcccacccaggtgctgtgagcacccctgcaatctctcttaacctccactttggaagacagacaattaggctgtttttgttcacatggcagagactgcttatgggatactcagcttttctaacagtacaggccctttgtgggagggtcatgaaaggtttggagtgtgtttgttattcagtacaatgggatcagttatgctgctgaaggaatcttgtggaaatgtttttttctctgcagtgagaataaggaggagcaggaaacacaggtatgattacgaaaaggactggtaatcaaccttacattgccttttgtctcgctctgcttgtaccagtgaaaaatagtgtgcacaaggatgatgaagaaatgctaatacatgcttatggcaatcagggtgatgctataaataggacaggcttaagaataatatagaatggctttgctgcaaactcaaatacggtttaaggaaaggtgtctatttgttaacagtgtgaaattttccacctgatactcatgccccctccagttttccttccagagtcccaaatgaaagacacttcctgggggggagagaaatttttttcaatctatgtaagattgtatgtgctgtccttccatcagttacaactgtacaaacacaagcctagccactgattcgaatcccaagatttacaagtcttttgattaatataaaatatgggataatggttaagaccaacgatgatggcatctgagacctgagtctaatcctgctctctttaatttcccaggactgagtcctcaggggaattacttaacattaggcctcagcttcctcatctataaaacaaagataatagtatctatctccgtaggtcgtcatagggattagattagatcgatgaggcagtgtactcagataaatattagctatcattcttatatgattaacaaaggttttaggaggcatgtgcagacaaagccaaggccagagcaaatcccagggaatatcaaattacagaatcatgtaactaattatttgaaagggcctttcaaaattgtttgaagctttatctggtactagaaacttttcccaccccctgtgtgtttacccaggccctgcttgcacatgcatttgcaggccagtctccgcgagctctgttggaaagtttctccaaagtattttgagtctaaatctaatctcctagaactttcactcagtgcctctgtttcttcctccagagtgatggagaacaggccaaacaccacctttcaaatactgaaatgatatcactatatttagtcttcttcaaattaaaccaccctagttccctcaactatttttcaaaaaacatgatttccagtcatatcaccgccctgatttcccttcttctaaatcagtggttctcagctggggtgacacgtctggaaacatttttggtcgacacagcaagggtagtgtcagtactggtatctggaagttacaggccaggaatgctgctaaacatgctacagtgcacaggatgacccccaataacaaagaattatctagcacaaatagttcgtagtacggagtttgagaaaccctgttctaagtatgcatgttaatcagtgttctttttaaagtgtgggccaaaaatgtgcatggatgagtgtcagctaacattgctattgtaccgccactacattgctattaaattagcctgagattcccgtggttttgtagctagcagtgaattaaagcctcctttcatgtgtttctgctaacccagggatggaatacacagggcccacgtgctcacttagaaaacattcataaggctgggtgtggtggctcatgcctataatcctaatactctagaggccaaggtgggaggattgcttgatgccaggagtttgagaccagcttgggccacatagtgaaaccctgtctctacatgaaataaaattagctgagcgtcgtggcacatgtatgtagtcccagctactcaagaggctaaagcgagaggattgcttgagcctaggagttcaaggctacagtgagatatgactgtgcaactgcactgcagtcaggggaatagagccgggccctgtctctaaaaaaaaaaaaaaaaaaaaaacgaaagaaagaaaagaaaacactgaaggccaggtgcggtgcagtggctcacgcctgcaatcccagcactttgggaggccgaggtgggcggatcacttgaggtcaggaatttgagaccagactggccaacatagtgaaatcccatctctactaaaaatacaaaaaattagccaggcatggtggcacatgcctgtaatcccagctactcaggaggctaaggcaggagaattgcttgaactcaggaggtggaggttgcagtgagccaagatcacgacactgcactccagcctgggtcacagagagagactccatctcaaaaaaaaaaaaaaagaaaaaaaagaaagaaagaacaaaaacactcagccaggtgtgcctgtaatccccacacttttggagaccaaaatgggaggatcacttgaggctaggagtttgagaccagcctgggcaacatagtgagaacttgtctctacaaattttttgttttttaattagctgggtggtgtgcacctgtagtcccagctacttgggggaggtgtggtggaaggattgcttgagtgtgggaggccaaggctgcagtgacccaccatcgcaccactgcactccagcatgggcaacaaaatgaggctgtcgccacccccaacctaccccgccaaaaaaaaaaaaaaaaagaaaagaaaacactcattagtggtggcactcttccctgtgagcacagaggcaatcttgcagtctttttcaacacaatattctaagccaccactaccagtcattcaaatgattgttggcatacaagatgaaatctttctgccagccatattaccctagttttacagtgttgggacccaggtcatgatttaattctgggtcctgtgctttggaagaatccactaaactgtgctgtgattcttgggggtagctagaaagaaaagaggatgcttcaacctgatactcaacagcagccaagtctcttatatgcaattccccaaaattcctttcccaaatacaaagcctggccatctgctgccatgttgatggagcaggggctgcccagaaaggatgtcctgtctcttccacacacacccctcaagccccacataatgactcctcctcattgcaaagttctcctcaagcctgcactcaccattcctgatgcttctgctctcggtttcctggaccaaagccagccttgactttaccagtataaagagatacagggagaggggtagaggccaggaaacatactctacaccttgaattcttcagcaaagcaaaaactggagtagacaacaatctaagcttctcagaaacctgaaacctatgctaatcaatatctaggaaatggttagttttaccttgaagcccaatgctttattccacatagcatttaaaataattccttttcccctttataggaaatactttttccccataaagaaatttcctttcccgcttttaatcttctttttccttttttgtttttttggtttttttgaaatggagtcttgctctgttgcccaggctggagtgcaatggcacgatctcggctcacagcagccttcgcctcctgggttcaaacgattatcctgcctcagcctcccgagtagctgggactacgcatgcacaccaccacgctcggctaatttttgcatttttagtagagacgggctttcaccatgttggccaggctggtctcaaattcctgacctcaagtgctctgccctcctgggcctcccaaagtgctgggattacaagcatgagccaccacactcagccttaatctcctctttggataggctgaagtaaatgtctttaatttcagcattctttataaacctagtcacctcgttggtttgtgaacaatgtaatatgtttgctgcaacttgatttactcaaatatcctccttggtatattcaaataaatcacacatttgcaaaactaatctagttttcagggttttaaacatttatcaatcacacgagtggagctaaactaatgatctataaggaatgtggtatctcccagttctgttagtatttgagaaggaggcagaaactcgagaacatagaaaccattcatgtttgaataaaacaaaaagcattttatgttttccagactgagcattttgagctttccacactgtgtagcagatccagaaagctcttgtttttagaaaaggtgctcgaggaggtgacaggagccttccaaacatgaggcctcctgccactttttctagaagtatagcatgtagttaagacctcaagtctgtaagtcatacaccctcaaattgagacctgacattcccaccttccagctgtgacagcttcatctgttacttaagctaagcctcagtttccccacatgtaaaaaggtaatgagagtagtacttacctcatggggttgctgtagggttgaatgagaaacaatataatgaggcattatgcctgataagcatcggctcttgttatgccatgccatggacctctgataaatgaaaggttgtttaagagataggtgtctctggccaggcatggtggctcacacctgtaatcccagcactttgggaggccgaggcaggtggatcacctgaggtcaggagttcaagaccagcctggccaacatggtgaaaccctgtctctactaaaaataaaaaattagccgggcgtggtggcacgtgcctgtaatcccagctactcgggaagctgagacgggagaatcgcttgaacctgggaggcggaggttgcagtgaactgagatcatgccagtgcactccagcctgggcaacagagtgaaactccatctcaaaaaaaaaaaaaaagagagagagagagagagataggtatctctcttctggtttattttttggtgtgtgatacagtaatacagcctgtccgctgcagtatatgtttctatagcatcaatgagctcatgtgtggttgcaaaacgggaatgatggcaggacaacatggacgttgtgttggttcacatgccttttctttcaaagcaaggagagttgaaatagcagaatagaatgagaacttcagtgggaaaagcttagcatggctttcagttctatttttattttatgaaaaagaatttttttgaatgaacatctgcacacggggctccctctccagagaagtacatcctacccttgcgtgtcctaggctgcacatccgcttcacagcgaccacgccggctcacagcacccagcagcgggagtgtttattttattatatctgtgcattttttatatcccctgaagtagtttctggccctactgagtgcctgccttgtctgtctaagttatctcccgaggtactagttattgtttctgttagtagactaattacaaagtcgcataggtttcgagcgctctgcctttaagcctattttcccccataaggcctgttacctttattgtgaatgtgaggcttttcaggaatgtgcatatgttttaacaaaggcccaatttctttcacatgctgcagaaggcagcagcagctgaagcaggcatgtgagggaatcgaaccaggccctcctcaggaatggagacagaattccaggctgcaaagctgctccttcacctggaaggctctgggttctgcagcctctgaaagcaccttcccagcccacagcccagagcactaaagtgcaatgcttagatcctgaccccctgcacccccagtgcagcagaaataataccttttctgtgtgtttctgccttggacagagagtgtgtaacagcatggatcagctcaatatatttctgaataaagcctttttcttcactttctttgaaatttgttcatggaaatgcactttgattatctctgtttcccctgggtttaaattcttcctacctccctagatcttggctcattgtaatctccacctcccgggctcaagcaattctcctgccccagcctcccgagtagctgggattacaggcacttgccaccacgcccagctaatttttgtatctttagtagagacagggtttcaccatgttggccgggctggtcttgaactcctgacctcaggtaatccgcccgcctcggcctcccaaagtgctgggattacagccgtgagtcaccgcgcctggcctgttcatttctttactaaagccctgatcacattctgcctcagattattacaaaggtttgtgtgtatgtcacgtcagtttaactataagcttcttgagggcagggaccttgtttatatcatctctccatttctttcatattgactagcactatgtctttcacatagtaagtacttaataaatgtttactgaatgagcaagtcctccaaaagcattgatttttatttgggcccttttgtaatgagtgggtaccaaaagtacactgtgaatcccaatgcagtggttagaagacatagttttgcattaaaaatttcctgcagcatagttattggaaaccattgaggggaaagcaaagatcagaaagcaatgtaagaacccctgaagtgaaatatttttttcatctttctaaaaaattaataagcaataggcaagaattaatttagctgctctggtagttcctgcttctctttccaaggctctggaagttgaattgtttcccaagggaatactagctcagaacaaacctcacggtgattcctgccctgatagggaatttggtgacagatggcagggttgttttcacagcgagggaaacgtgggcctggtgtgatggaggggctcaggagctttggccgaaatgcacaacttccattgtcccccctcttcttggcaagggcccaggtatctgttcagtgtcgctgttcaggtcccctcccgtaaaagtcacagcttttaataataaacttacagcaatagtttataagtaaaatttatttatagtaaaaagtagtgtatgaatagccctttctgaataatgccacatttattatctaatttgatcctgaaacaacctttttgtattagtttgctagtgctgttgtaacaaagtactgaaaaccaggtggcttagaaatggaaatgtattatctctcagctctagaggctggaggccaggatggacatgtctgcaggatttgttacctgtgagagcagtgaaagagaatccattgcatctctctcccagattctggagttttgctggcaacctttggtgttccttgagttgtagatctctgctttcatctttacatggtgttgtgtgtgtgtgtgtgtgtgtgtgttcatctgtgtccaaatttcccctttttataaggacaccagccatattggattaggaattaaccactaccctactctggtatgaccttaactaactacatctgcaattgtgtccggaatttattccttctggtgggttcatggtcttgctgacttcaagaatgaagccgctgacctcgcggtgagtgttacagctcttaaaggtggcgcgtccggagttgtttgttccggagttgtttgctcctccctgtgggttctggtctctctgacttcaggaatgaagctgcggtccttcacggtaagtgttacagctcataaaggtagtgcagacccaaagagggagcagcagcaagatttactgtgaagagcgaaagaacaaagcttccacagcatggaaggggaccggaggagtttgccgctgctgtctggggtgcccagcttttattcccttatttggcctcacccacatcctgctgattggtccattttacagagtgctgatccgtgcgtttacaatcctttagctaaatacagagtgctgattggtgcatttttacagagtgctgattggtgcatttacaatccttcagacagaaaagttttccaagtcccccactcgacctaggaagtccagctggcttcacctctcacaatgaccccattagtaagtaaaggcacactctgaggtacttggggttaggacttcaacatgtgaatgtggggggggacacatgcagcctttataataggtaaagcaggaattactctgtttcccattttacaaaaaaataagcctcagagcgatgaagtattttatccaaagtaaatgaaaaccctaggccacacacaagtcggctgcctgtgtcagtagtcaaagacagcagatggtgcctctcgctatgactttatctagctgttctcactctcttggaccagtaagaactgaggctacactgaggtgtgggaaaagaggagcagtggccaaatatggtctcccttggaatcaatttagcagatgccctattatttaaagcttcgcttgctgccttgtggctgcaccttatgagggcttggccggcaggggaactgttgtttctgtctggtgggcccattcctgagccataggaggctgggaacaatgagcctattcagggcagaaagtgcaaagccccgcgtttcttttttctctctatagcatcgttctttgcctccctgtgcctttcttttgtcctgcctattgagtaacatcagcgtgggtgttgggagcgtgtgaattggcagccgtgtgagcgggcggctgaggacgtctgaccgatgatgtatgcgccaggacaggcagcaacgggcgagcttcccaggaaccactttgacctatgccttctgctctgcctgagtcactctcacgagctaaagcaggtgacccctcatggagtgcttgttccccttggcaaagaaaagggacacgccccatcggtgagctcctacccttggtacacttggagggagttgagtacagatttaagagacaaattctaatctctgctctgccacttgccaactgtgtgactttagggaagatgcttaatctccctgtgtcacttccccatctataaaatggagacaataaaatttgttctcctcctaaggttactaaatggataattgatataagttatacatgctgcttggttggaacaacatgtctgccatataattctagcacttagtacatgtaagcaatacttccttatttgtttatttagtttcccgggtgtcatttgttaatctgttcattaaaaattggtgaggatccaccagttagaatgctgataattaaaaagtcaggaaacaacacatgcaggcgaggctgtggagaaataggaacgcttttacgctgttggtaggagtgtaaattagttcaaccattgtggaagacagtgtggtgattccttaaggatctagaaccagaagtaccatttgacccagcaatcccattactgggtatatacccaaaggattataaatcattctactatagagatacatgcacacatgtggttattgcagcactatttacaataccaaagacttggaaccaacccaaatgtccatcaatgataggctggataaagaaaatgtggcacgtatacaccatagaatactatgcagccataaaaaagaatgagttcatgtcctttgcaggaacatggatgaagctggaaaccatcattctcagcaaactaacacaggaacagaaaaccaaacaccacatgttctcactcataagtgggagttgaacaatgagaacacatggatacaggaaggggaacatcacacactggggcctgtcaggggggctgggggcaaggggagggagggcattaggacaaataatgcatgcaggtcttaaaacctagatgacgggttgataggtgcagcaaaccaccatgacacatgtgtacctatgtaacgaacctgcacgttctgcacatgtatcccagaacttaaagtaaaataaaataaaaaataattggtgaggattatatcaaaacacagtggttgtatttagatgatgggattacaggtgatttatttgtctcatttttgcttgtttatattttctaaactttctgtagtaaatatgtttttgtttttgtttttttaataaaagaaaacagactcccactgatgacttacggagtgcagtagatgaggtgtgagtgggtacaaagtgaagaagatgtgaccattgtccttaatggagtttaaagtctatggaaggagataagacagggagacaaatgacacaagagagtggacagtgatgctcagggaaggctgggaacaggaccagtccttctcaagtggcacctggcattaaagaaatgttttcatcattcttgccccaacagtctccatatatggtcttccctgatctggaaataggacagtaaatggcacagtcagaggcaagggtcactcttttcattgatcccagagccccagggggatggggatggaattgctgaaattcctttctaaggtacccgtttctaggaacaagcttatgtggaagaaaaagttgagatgctttatgtaactcatcttatccacaacagatttgtaccccagttgcaaagcagcacatcaagaggaatggagaactaattttctgtttctctctctcttcccgtagcataattagcatcatcattattctggctggagcaattgcactcatcattggctttggtatttcaggtatgtgatttcttgcattactacaatctattcacccctcaccattaaactcctaatcactcagtgcgttagcatggaaagagcccagagctttgacccagaaaacctcagagtatagcattcattcttctacttcttgtgctttctctacattagtcagttaagtcctcgacttcagtgtcctcattttttattatttatttatttattttgagacagggtctggctctgttgcccaggttggagtgcagtggcatgatctcagcttactgcaacctccacctcctgggttcaagccatcctctcacctcagcctcccaagtagctaggactacaggcatgtgcaccaccatgccaggctaatttttttatttttagtagagatggggtttcaccatgttgctcaggctggtctcaaactcctgagctcaagcaatccacctgcctcggcctcccaaagtgctgggattgccggcctgagccaccgtgcccaggctagtttcctcatttttgagtggggagatactgtcaacatcaccagttagttgagataatcaaatgagatgtttatcagtagtctatctatcagtcagtgctgaagatgtcattctgggatcataggtgaagtgctgcctctgagccattctgtcagcggttggcctgggtagatgatttctttgcaacgaagcttcagctgaagtgttaaagaatatcaagtctttgtacacaggggtcttaggtaaagagacaactggtcatgactactgtaccatgtaggaaacagataccgctgtagcacagatggttagtttctgaacgtatctagccaatgtcagttgcagaagagtctcttcactttcctcttctgcataggccactgctctgaagcatcttttatggatgctgctttaattttgacactgaatgagttaaggctggcagttttcttctctgaggcaaattgtctgctctttttttcataaaccacctgactcagtccaacacattcattttaactcagtctgtgaccaaagctccgtaactttattttctatattccagtggcctttctgccatgcttctccagtgtagacatgctggcactcaatactgtcacaaagtcgaagctaagaaaacttgctagagttgtgtttgctagaaaagacattcatcccttccccactttctttgtcatcaatcatatattttttaggccagttgtggtggttcacgcctataatcccagcactatgggaggctgaggtgggagtactgcttaaggccagggttcaagaccaacctgggcaacaaaaagagaccctgtctctacattaaaaataaaaaaagtaaataacatgtgtattttatcttccattcatttttttctattggggtatttgtctttctctttttgatttgtaggtaattccttctttatcatggatgcaaactagttacaggtatcaccaaatctcttctactctacactttgcttttttactctcttaatgatgtttttcaatgagcagaagttcttaattttaatttttattgatccttttctttatacttggagctttttgtaacctgtttaagaaatctttgcctattccaaggtcgtgaagatgttcttctagattatcttgtagaagctttattgttttgtctttcacatttatatctgcaaaccatctcaagttaattttatatgtagtacaagagaggggtcaagattcattttttccttatggtatccaataaacccagcaccactactgaacacactgtccttcccccacttcccttcagtaccgtcatggtcgtaaatcacgtatccaaatgtgtggggatctgtttctgaattcactagcctgtttcattctaatactaatttcctatgttaatttatttcttttcctgttcataatcttggttgttttctctcaaccaagtttctgaaatcactagcctgtttcattgtaatattgatttcctatgtttctgtttctgatctgtttctgaattcactagcctgtttcgttctaatattgatttcctatgttaatttatttcttttcctgttcataatttcggttttttttctctctttctttctctctagtcttctctctttctctttttctttcttctgctctctctttctctctctctcatatactaaaatagatttataaggtattgttagctttatagtagttttgaaagaaccagcttttagcttatttatattttctctgatctgtattcctattttactaattttggcttttatctttattaatattcctcttcctgctttacttggccatctttcaattctttttctactgtctcaaaataaagcagctcacaaggagtgtgagtgcttaaaaaagcagctcacaaggagtatgtccaaaaggccaataaatagcttttagtagatactgccattcaattttccaaagtgatgagtcaatctactcttcaccagcaatgcatgagagatcaagctctccacaccctcaccaatactgggtgttgtggaattttgtggttttaatttctgtttcctggtgacagagactgagtacattttcatatgcaaaacataatgtggaactacagaagagcacaaaagagtaagttctgtatgattctatgcatatgaagttcaaaaacaggcaaatggatctctgctggtcaaaggtagaataatggttcttattacctttggggacaagtaagcaggtagcagtgaggaggggcatgagggcactgctgggagggcagtaaggttctatttcttggtgtgatgatggttacatggaataaagttataatcattcttcaagctgtacagttatgatgtgtggatttttatgtttgtatacttcagtacagacatacaaaaacatttgtaaatgtatatataaaaacataaaatgcatataatgtcatgtatgtatatatacattttatgtttacatacatatatattcttttttttttttttgagacagtcttgctctgtcgctcaggctggagtacagtggcataatctcggctcactgcagcctctgcctcccagcttcaggttattcttctgcctcagtctcctgagtagctgggattacagacgtgcaccaccacacctggctaattttttgtacttttagtagagatgggattttgccctgttagccagactggtctcgaactcctgacctcaagtgatccacccacctcgacctcccacagtgctgggattacaggtgtgagccactgctctctgatttacatatatattctttataaggaaataaaatatagactgataaaccaaatattttggaataacttttaaagatagtaatgctaaagtacattttggtaccttcctcactaaggcttaactctttttttctttttctttctttttttttttttttgagacagagtagctgggattacaggcgcgcaccaccacacctggctaatttttttgtatttttagtagggacagggtttcaccatgtgtagccaggatggtctagatctcctgaccttgtgatccacccgcctcggccttccaaagtgctgggattacaggtgtgagccaccgcgccaggccactaaggcttaactgttaattataatttaccctattcctgatcttatacatcaccttcaactaaaaccctagtatttatttgtcactctaaatcttgatgactaaactttcttggacctaaggctcactggctttgcatcagaactcttaagagagttgtttatcttttggttgttagtggtgttgactctcctagcaagaattttcacaatatcataacttccctgtgttagtcaggaggtttgctacttatatcttttcctgttgcatagcgacagccacctcaagaactgtactcagctccttgaatgcacagggtgctccgtaagtgctttttgaatggacagttggatggatgcatggaggtgtgaatagatggaagtaacagtctgctcaatccagtaatgtaccatcaaaaatttaaaactctactactgccaataaaaaggtgttctgcctccttcccatttcacagggtgacagctggttatttggataaaatgggcagtttgttagtttaatactgtttagttggattttttcaattgcctctattaaaaggactataacctttatcagagatcgtattatcacattttaaatgaattcaataaaatattagctggtttaatatataagacattgaaattaagcaaatagcgttaagcagatgatgatatgtattaggccgttcttgcactgctataaagaaattcctgagactgggtaatttataaagaaaagaagtttaattggctcacgattctgcaggctttacaggaagcatggtgctggaatctgcctggcttctggtgaagcctcagggagctttcagtcatgatggacggcgaggggaaacagtcatgtcatatgtcgaaagcaggagcaagagggagagagagtggtggggaggtgccacataagtttaaacgaccagatctcatgtgaactcagggcctgagagctcacttatcaccaaggggatgacccaagccatttataagggatctgccccaatgacccacacacctcccaccaggcacctcctccaatataatataattggggattatatttcaacatgagatttgggtgaagacaaatatctaaactttatcatgatgatatcttttgaatcctttcttcatgcacttcactgtactaaataactttgcatgcatgatttgccttactacacacaacaaataggaggtagatgttattactatgatgagatgagaaatgtgtggaaggacacacaacagtcagcaagtgagcatggctgtatttcaagccttgggaatttgtttcccgaacctacactcctacccatcaccccataccaatgacaacgttcacacagagttgtagtggagaagggtgttttatggtttgccttgcaggcatgattcctgagaccacagcttttgaaaacataaaacttttccccaatacagaaagaaattctatttctttgtaactctcctgatgctgtatatgccaccttctcatagccatcctcctccttacaaattctaaataaaaaccccagaaaacataaaatgcatttgcggtggaccatttgaaagagaggttgaggggttccaatcagcccctggttaaaggacaacccttgtggataagccttcgagaaggaaggagacgtgatggaaaggcccctaaccatacccagcccagtccctgcgctatcacgcaccctctgactttgaacagctctgtataatggaagaatctcagaatcagagccattccaatctcagcgctcacactaactgtatatcctttgggatacaacttaaatgtttcctcattggtaaaataggcagggtcattgtgagaattaaaggagagtccactcacacacctgtgtgtgataaacagctgccattgttatttatattgatgccatcaatgcttttagtaaaaatctgctattattaacgcattcatatagcacctcctaggaactgcacaatttcctggtcaaccaggaaaggcctcctttgaagccacaggatgctgcctcctaataattgttacaaacaaaacctggaactgtaacatgtgtcccgtatcgcccccgcaaccccacccccctgccagaactgggaagctgttgaaagaccaaagaatgacttagacaagtccagtttggtgagtaaatgagtttattaggacttacatacagggcactcctgggtggcagcaagacagccctagagatctgtgccatctcccatatctaagctgcttttaagctggttttctggctctttgcctgctgtgtgtttgcaatgagactgtttttcttggtgtgttctcagatactctctgggatgtttaggttctcagggacatctgctcctcagctgggcaccaaggccttggcttaccacccagctgttggggttcaagcagcagacatacacccctaaataacctggtgagtgacctatcacactacagtaatgctccagcttcagacattggataaaccgactaggtgtgtgctgataacaccaaaatggaaacattgcacagtttatttagaaaatatttgatctgtccaaaaaaaccttcgagtcatctgagaaaataaacagctgtgggcctttcttacacttattttgtggtttttagttgttttgatttttaagtgaagtagggatatcttcttattgggttggcactctacatgtctcaatctggccctgggtatcagcaaaatatggtagaaagggcataggctcagggccagaccaggttgtgtttgaccctgactctactaacagctagatccaaggcattcggcaagccatttaacctcatggagtctctatcctcatccataaatgggtataatggtcattcttactctctcatggcttaaaatgagtctctgtaagcaaacatttagtgaaatgttgttttccttacctcctggggctctgatctgcaatctttccaaatgattgtagttaataatggttattaatatcaatactgatttaaggtttagcatgtggcaattcaggtacaatatttagcactttacctgcattgtatcattaagtcctttcaggaaccctctaagggagcatccccattttacagattttaaaaaatggtgaaataaagggttagaaaacttgaccaaggtcacatatccaataagtggcagagctgggacttcaacccaggcagcctgtacctgtgccatgttctcaaacaccatgttctgctgctttcctacattgttcccgtatctggccttgcccagtgtccttttaaatttcttctcacggaagcaactgttctccccaccccaccgtcttctttggcaagagtgacactcacaggtttgaccccaaggttaagctttgcatttcgaccttgtaagccatgtactgtggtgcccatctggacagctgagttttagcagatgctggtgaccatctgctgaagacatctagcatgctctctatgctactggaatgtacgaacctgtctttctgagtcatttcaaaggacagctcattttccaggttttatccagcgctgtgggctgccccagcatcatagtttctgtaaagaatccttgtcttgtgttacctatacccccacttcaagatattcctactcctacaacggagcgctgattgaatagtactcccactgtgtgaacccagagctgctcaggtttcgtcttgcccctgctttaacagccccactttcctcatgcagacaggagctgtggtagttaattagccctcacaagctggataattaattttcagtaagtggctcagtcttccaattttaaaggggtttaatgaaatcttagaggtaaatgaaatgcttaaaatctgtgcccatttaatagaattctctatcaataggtacctgcctctagcccatctccatggggtccttttgtcctttgactcaacaagtcacacaagaatctctggtggagtgagtctctgtctccaaaaaataaaaaaaaaagaatctctggtggtcagtaggcctggagagtcataggaggccagatggcataatcctccttgagcctatgtttgtttgcaagtctgaatagtttcttttcttgtgagaagtaatatttacatgtggttgcttgcaaattaaattttgtcacttttaacaatcatttattcacttaacaaacaagtattttattgactgctttctgggtgcaaagcaatggctaggtccctgtggtttttttaagttctcactggctcttatttctcttctttatttgacattggggtggaggggatttaatcaacattacactcattccatctgccacatcattaatgcaaccttaaatgactagaacctgcagcaggtccctagggcattccacagctgcctacttttaatcattaacttctctgggagatatttcaacggattccctaactgtgagctcaaggccaacatattaaaattaattcagtaatacagttgctgaactaaggtatgtcattaccatttcattctctccataaactgtgctaatcatgtattttttctgagaagtaatctttcaattcaactttaatggcactttatcaacaaccatcaaatttacctttgctgtaacatagttgtatttgattcatgattttattgtgaacctctcagtatttttattgccttccttttcattggatcacatttccccaaagtttagatgtggtaatcctgccaaacgtcccttactcctacaataattttagcctatctcaaacaatgctttgatttctactgatttccatttatttattcatttattcataaactcagcaaacattatttttctctgcagaaacatagctctaggcactacaggacttacagataggattaagacagtttctgctcttgaaaagctcacaaactagttccagagatagattagagaccaggtagagggagacagctgctataataaaggccaaaaagacaaaaagttacaggaaagtaaagagagaatctactaatttttcctttggtgaattaaaagaggatttcatgggagggctgccatctgaacggactttgaatataagtagaatttgcataactggtgttaaagaagtgtgagctatgaattaataggtacaagatgaacagcagtgtgaaggcgcatagtgtaattgtgtaacccatgctagcctgggatgccttggatatcattctctaagtaacaatacttgcaaagcaaactgaatctttaaatcaatgttcaagaaaataccaatgcagggaatggaggtgtgttgtgttcttattacacagcaaaaacttcattttgtcctctttcataattcgtctcccagatctcccacaggaatggccatgcatggcagctgcttccaaagtgtcttttctcacgctctcaagcctccaaaacatccttccaaaccaggctatgtacttgtttttgtctcctcttcctccttttctagctataatttttcttccatcagtagccttctgttctttctgctgcaaatccatctagattagcttctccagttctcttcctcattcattaccctcatttactttgtagaggtctaggagtcaatgagataattccaacccctaataggctggaagaggagaagagccaaggatatccttatgttgataatgtttacctctcacattaaaacaacaacaacaacaacaacaaacacgtctgctttgtttgtatgttttttatttaaggcagaaaatcaacaaataatttgatacagacagacagaatggactatgaaaggatgtagttggagagaaggctgcaaagacagcaataagggctaatatgtatggagcatttactatgtagcaggcagtgtttagctttgaagtccaggctggaaaatctgaaatccattccacagctcttaggaaccattaaagatgagtgattagaaaacagatatgttcaaattgtactgtaagaaggtctacctgtaggattaatgcatgtaaaatggattggatggaggcgaagatgaaaggtagaaataccaataaagaagctgataagtccagttaggaagtgctcaggacccgttatgttgggcttttttggctgtaagaaagagagacttgtgcaggccactttaatatcaggtgttgtttaaaggatgtgcagagattaggacaggaactagacctgaacaccccaggatccaagacagctctggggatgaaagactctttccatttttctctcccatggtctctcccccatacttctttgtgtctcctccactctcctcttgggctccaaggccatctgcccttagtttcatatccaagccacagaaagagcctctcaagaagattcagttaattaaatcaccccaataggtgtcctcagtcagcagcccccagtgtacaatgaacagctgattgatccttccttgactgggtaggctgtaggctggccaagtgaggaggaagcagttggatacagctggcacataattaatatttctactggtggtatgtcagtagaggagagggtggctttcattttaaaccaaaaatcaactgaattaaatacagttcttcattatgctatagctagcactgtaaacttgatcaaatcagttattttctcactgccttagtttctatgtcattcaaacagaaataaaagttacagcactttagaattcagcatttttcagaatgactaggccacatttagttaacatgagatttcacttctgtgctacttctggttaactgagaataacaataccttatatgtgtaattacagtttgcaaatcaggttaatatccatttgatttgatcctcacaagaaacctttaaagtaggtgatatagtttggctctgtgtccccacccaaatctcatcttaaattatactcccataattcccatgtgttgtgggagggacctggtgggagatcatttgaatcatgggggtggttccccccatactgttctcatggtagtaaataagtctcacaagatcttatggttttatcaggggtttctgcttttgcatctttctcattttctcttgccactgccatgtaagaagtgcctttcacctcccgccatgactctgaggcctccccagccatgtgaaactgttaagttcaattaaacctctttttcttccaagtctcgggtatttctttatcagcactgtgaaaatggactaatacagtaaattggtaccagtagagtggggcactgctgaaaagatacccaaaaatgtggaagcaactttggaactgggtaacaggcagaggttggaacagtttggagagctcagaagaagacaggaaaatgtgggaaattttgaaacttcctagagacttgttgaatggctttgaccaaaagccttatagtgatatggacaataaggtccagactgaagtggtctcagatggagatgaggaacctgctgagaactggagtaaaggtgactcttgttatgttttaacaaagagactgatgatgttttgcccctgccctcgagatttgtggaactttgaacttgagagagatgatttggggtatctggtggaagaaatttctaagcagcaaagcattcaagaggtaacttcggtgctgttaaaggtattcagttttataagggaagcagagcataaaagtttggaaaatttgcagcctgacaatgtgaaagaaaagaaaaacccattttctgaggagaaattcaagctggctgcagaaatttgcataagtaatgaggagctgaatgttaatccctaagacaatggggaaaatgtctgcagggtatgtcagaggtcttcatggctgcccctcccatcacaggcctggggtcctaggagaaaatagttttgtgggccgggcccagggtccccatgctgtgtgcagcctagggacttggtttcctgtatcccagctgctccagctgtgcccaaaagggtcttgggccatggcttcagagggtgcaaaccccaagtctcggcagcttctatgtggtgttgagcctgtgagtgcacagaagtcaagaattggggtttgcgaacctccacctagatttcagaagatgtctggaaatgcctggatgcccaggcagaagattgctgcaggagtggggctctcatggagaacttctgctagggcagtgcagaaggaaaatatggagtcggagccccaacacaaagtccccctggtgcaccacttagtggagctgtgagaaaacagccactgtcctccagaccacagaatggtagatccactgacagcttgcactgttcttctggaaaagcaacagacactcaatgccagcctatgaaagcagctgggagggaggctgcaccctgcaaagccacaggggtggagctgcccaagaccatggaaacccacctcttgcatcagcatgacctggatgtgagacctggagtcaaaggagatcatttggagctttaaaattttggacttgcataggccctgtaactactttgttttggccaatttctcccatttggaatgactgtatttacccaatacctgtacccccattgtatctaggaagtaactagcttgattttgattttacaggattataggtgaaagggacttgccttgcctcagatgtgactttggactgtggacttttgagttaatgctgaaatgaattaagactttgggggactgttgggaaggcatgattggttttgaaatgtgagaacgtgagatttggaggggccagggatggaatgatatggtttggctgtgtccccacccaaatctcatcttgaattatactctcataattcccatgtgttgtgggagggacccagtgggagatcatttgaatcatgggggcagtttccctatactgttcttgtggtagtgagtaagtctaatgagatctggtgggtttatcaggggtttctgcttttgcatctttctcatttttctcttgccaccaccatgtaagaagtgccttttgcctccctccatgattctgaggcctccccagccatgtggaactgtaagtccaattaaacctctttttctttccagtctcaggtgtgtctttatcagcagcatgaaaatggactaatatagtaggtaagacagacattgttacctccaattttctaagatccaaggaggttacatgacttactgaaggttacatggctattaagtgacaaagccaagacttgaattttcatcttcaaaccccaagtccaatgtgttctcaaggtttgggttacttggtcttacataagccattatatatgacagatctgctatatatatatatatatatatatcaaaatgattgtcttcctgctctttctcttcttgtcttcttattgcctctcatgttcttctgtatttttaatttatcacagaagtctctgtctggctttcagcaatgaagggtttggttgtagaagttccaaggcttcccttagcattgatctttgcttcctgaactgcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggaggtgagttacttttggagagagattttttaaagcaccaaaagtatttgaggctaaagattatgagttgcttatgaaatatgttgtgaccaatatcagacaatgatgctcccaattctgctaacagctgtttttgccattttatggccaagactcacaccaaccccaaaagtagccaactataagagaggccttaaaaatcttttgttctgggttctctctgcttcagaatttccaggtgtgttctctattcaacaaaataaatgtagcctcttttgtggtagcccctggtacagctaataagagcagcctagcctgggacatttccacgctaagtagacccaagcgcaatcctgaaatcagtatcttcagagactcatgacagtgagtgcattttagaagttcaaagggaactaaccaaaacgaaaacaacattgtcctataaactcattaattccccttcccctgcaacaatgaaatccaccctttgttgccaacccaatttaacatatgttttctgaatttatatacaagggactcaggtactgtgagagtataaagatgattaaacagatttcccctacccttacagagctcataatatagatctcacagagttaggggtcaggacagagataataaaagtctgtaaatgataataattagtaaagtgtatcaaatgctttaagagaaatataaatggagtgattgagaagaagagagagatcccgttcaaatgcataggagggaagggatgggaaagccccctggagaagctggcatttgaggggagccttgaaggataggcagaaaccgggcctttccagcctaaactagtatgcacaggtctttcttgcacacctcataacatgcatatgcaatgattcgaagctcagatctagaatcagacctgtgtaagtacagtggcctgggcaaagcaatctctctgagcctcagtttcttcatcttaaaatggggtcatgtcaaagggatactggagccaactgaaagagcttccaatggcaaagctggaacaatttaagcaacaaaataagtaacatagtattgaattataactcaaaggtatagaataaatacatatgacttcatacttatttaaataaatgagggatatgaaacaaattccccttacagatgaattccaaataatttatttagatctcttccctccaaaaagtggagcttgaaaccttccctatcccactcagggtatattggacttagtgaagtccagcttccaaagaaatccggcaaacactgctttagccaggtgatccaggttaacatcattaataagtcatgttaacagcatgtaccttctgatataatgtgatgggaagggcactttacctcctgtgctcttcctctctaaaacctgtaacctcagtctaatcaggagaaaacatcagatgaattctaacagaggggcaacctacagaatacctaaccagtactcctcagaactgtcaaggtcatggaaaatacctaaccggtactcctcaaaatacctaaccagtactcctcaaaactgtcaacgtcatggaatatacagaaaattgggaaaacatgacagactagaagaaactcaagcaacatgatgactaaaagcatggtggtgttctggaaggaatcttggaacagaaaaagaacatcagtggaaaaactgttgaaatacaaatcaaatctggaatttagttgatagtaatataccattggcggtttctccgttttttcttttttttcttttctttcttttttttttttttttttttgagatggagtttcactcttgttgcccaggctggagtacaacagcacgatctcggctcacagcaacctgcgcctcccaggttcaagtgattctcctgcctcagcctcccaagtagctgggattacaggcatgcacctccacagccggctaattttgtatttttagtagagactgggtttcttcatgttggtcaggctggtctcaagctcccgacctcaggtgatctgcccacctcagcctcccaaagtgcttggattacaggcgtgtgccactgcgcctggcctccagtttctcagttttgactaatgcacattggttaagatgttgacattagaggaaactgggtgaggcctatgccagaactctataccttctatgcaacttttctgtacacgtgaaattatttcaaaattaaaagttgatttttttttaatggggatgatagtattcacaggagtgttgtgaggatcaaatgaaataaggtctggaatacagtactggcacagaatataccctcaatgaatggtggttcattgtcatgtaaacttagtttcccacatcatcgcccaagagcgtgttccctgcctgctccgagcatgagtcttgtctcccctgctagagaacagactccttaagggttaggcaagggctttccttttactacttactcagcaccagctcagtcccaggtaaaggaagacgccaaataaattaataaattatattttaccccaataaaaagtccaggcttaaacattttcccacaactgtctctctgcctggatatggggggaagctaagtcttaatttcaaaatgcagttaactctcctgcgaggagaattaccttggaggaaaacaaatgtctgtttctatccctggataccagagctggacaatctctacccaagcaaactccaaatccctgtgatgacaaagcttgtgaatggaatttctgtgggtgatagatgaatgctgtttgtttcttctttctccttctccctacccaccctaactttatcctccagggagaaaaatacataaaatccagaagcttcacagatccctaggaaaatgcctaattccctaagggataggcttttttatgaccactgaagttcctcttacttggagaaaattttctattgtaaccataatatacctagaatttaggtccttggggtttgtgattggccaaagggttgtgatgtatagcaatactatgagcaaataattattcgcacctataatacaatgggctatacacaggtggacctctgaggaagtactgagtggcttcaatgataaaaaaaaaaaaaaaaaaatgactgcatttttaaggcctagcgcttcaaaggctatattgtcttacgtgtctgactttggcatctgccctttctgacttttgaccctgcagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacaggtgggttcctgcatgcttttgtatggatttactggggaaagagtaaaatctaaattaaaatttaacttcattaatagatatataccaaggcacaaaaatctctagagtcctcttcactaagaatttgatcactcaattccagttgagattgtattacataagagaaagcccaacacaaaacaatatgtatggcatataggtcaaagatggcaattaggtttcatcttgtatgctttctcattgactggttgtctggagaacagtgtttaggattctgaggctctgtgtaactcagtaggactaccttgctacagcagtgaggaagtgataattacttgacatctttgatatgttcagctggacttcaagccctccaaaacttaggctagaaaccaaggtttgcttccaccctgcctttgagaaggctgtgaatctgaagactaaaagtctggagtctgacttagttttattcatccctcatgagactgactcatgatcccactaatattggctcaagattaatctgaaacccctagatggaactggtctcccagcaccctagctgagagctggctgagaagacccagcaccctagtctccctgcagtgctttagtgcatacaaaaccttaggttgagctagtatcaagaaaatgcatagactgaattctgacttttaagaccatccttcctggggcgaaattggattcaaactgtagtgaaaggagtacgtcaggaggctgccatttaaatcaagcctagcactgggcacaaaataccttacacattataagtaccctataaatgtttgccgaatctaactgaataaatcatattcttatgattttttaatttgaaattatacatatgaacccaaaattatctacaactcagatatatcaatttaaaaaataaattacactcacacacacaaaagtaacctatggaatgggagaaaatatttgtaaatcattttaaggggtttcaatccagaatatattaagaactcctacaactcaacaacaacaaaaatcaaataacctcattttaaaatgggcaaagtacttgaagagacattcaacccaagatgatataaaaatagctaaaaagcaaatgaaaagatgctcaacatcactaatcattggagaaatgcaagtcaaaaccacaatgagatatcacctaatgcccattagggtggctactctaaaaacaaaataaggcaaaaacagaaaataacatgttggtgaggatgcggaaaaattggaaccctcatgcactgttggtgggactgtaaaatggtgcaacttctatagaaaatagtataaagtgtcatcaaaacaattaaaaaaaagaactactgagatatggagccagccggacttcgtgggtcgagtggggacttggagaacttttctgtctagctagaggattgcaaatgcaccaatcagcactctgtctagctaaaggattgtaaatgcaccaatcagcactctgtaaaaatgaaccaatcagcactctgtaaaatggaccaatcagcgctctgtaaaatggaccaataggcaggaagtgggcggggccaaataagggaataaaagctggccactggagccagcagcagcaacccggtagggctgctgtctgtgatgtgcagggtttggtgttttgctgttcacaataaatcttgctgctgctcactctttgggtccacactagctttaagagctgtgactctcactgcgaaggtctgcagcttcattcctgaagtcagtgagaccacaaacccactgggaggaacaaacaactccagatgcaccatatctgaacatctgaaggaacaaactccggacacaccatctttaagaattgtaacactctccaaaaaaaaaaaaaaagaactgtaacactcaggttgggcatggtggctcacacttacactatcatatgatctaacagtcctgcttctgggtatgccttcaaaagaattcagagtctgaatgagatatttgaacacccatggtcacagtagcactattcaccaaagtcaagagatagaatcaacccaaaatgtccattagtagatgagtagataaacaaaatatggtatacacatacaatagaataccattcaggctcaaaaaggaaggaaatcctatcatatgctatgacatgaatgaactttcaggacattatctatgtgaaataagccagtcacaaaaagacaaatactatatgatttaaacaaagcatctaaagcagtcaaatgcacagaaacagaaagtagaatggtggttagcagagggcagggtggaagagttgaaggagaaaggtttttgtttaatgagtatagagtttcagatttgcaaaatgaaaaagttctaatgatttgttttataacaacgtggatatacttaacactactgaactgtacacttaaaaatgcttaagatggtaaattttgttgtttttactgcaatttttaaaaagtatctaactaaaaaattacatatgagagcgagagctcttgcaccatcttgaggaacaaattggcaactatcctggttaggattattagttgcctgtaacagaaaaccaatataaataaatctagtctgaaagggaagtgtaggaagtgtactagaatgttgtggaaccaaagacaggaagttcagttgacttcaggatcaactggaaccaggaacttaaatcccattgagattctttttctctcatttctacttaattctctctttactctcttgttttagtccatatggcaagacgtgattgccaagcattcctatatttaaaaatctcttactcaagagagtggtgagactgaacctcaattcatcagtctcattctacattcccaagaaggactttgactccacttgggtcagctgcccatacctaggccaatgaggcagtatctgatgaaaggccttcccagaagagaaggagggactgaagtattggtcatttaaaacaatgggtgctgacaacagtatctcagtccagttcccagtaaaaagctccaagctgtgtaaataatgtcttctagtagcaagggccacaactgaacaagacatagacattgagcacaccttttattcaattaacagatctgtcttctttacatgtttgttggatacatcaaaacaagtgttcgaagtgtcaggctaggatgaaatacaacttttggtagctcaaaattaagaaaatagcagaatttcttattgttgtagacaaagtaggtgctccatgcatgtttttaaacaagtagggccatgggatttacatattgtgttctctgcctatactgctaatttaggtcattcatttaacaaatatctattgtgtgccaagtatgttcagagtacttttttaagccccctgagatactgaaatgaatagcataagtatcaaaagagaagttaatcacagtgtagatttagtacctatgggaaagagttgttaattatgactgaagtggatccatagataaggcagagttccggctgggttttgaagaagaaaaaaaatggtttggataaaatgggaagacctgaagtcaggagcttacagtaatggtctgggggagaaattatgagagtattaactggagcaggggcaatgggaaagaaaagggggaagaatcaaaagttgcataaacaaaataatgtacagtccttggtgatgcaaatgtgaaagtcaagagaaatcacaagtcaaagtgggtttgatatttctacccaggatacttaggaggttggtgatgctaccagaaaaaaaaaaaaaacccaccccaaaacataggagcaatatgtgtggggagtagataagggttttagagatgtcgagtttgaaatgcccatagtgtacccaggtagagatgcccagtgcttagcacaatagccagcatgtgataggttttggggagaacactacacccttactccatatatttccttttatgagaagggatccccaccagtgtcatctttttagcctctctcttcctccctctttcactcttcctgagagaacaaggaattaatttatctgattgatgagtatattaggagcagctggacataagtagctcagctcctcctttttctttttgtttttgctaactctcaggaagcccgtgtacattctgctgtgctcctgcaggccgtcagttgttcaggggtagaatctgctcctgcaggagacttgcaccagtctggttctgtctgacagtggggagtctcggctgtagcccacttgcctaactacaaagcctcattctctattaacatattttcagcactaaaggtgatattttgatcttccagttgccttatttttttgtccttctctttaattggttcagagctaagctggggaagaggctgttatttattggacttctttgaaccccaatagtaggtactcagaaatatttactgaataattatgtttttaaatgacatatctagcagcaactggaaatctagatgtggaactcaagacagagttcaaactaaggaggtagacttggaaatgactagcatgaaagtgatatttattaggcttgagtgatgttggctttattgtcgtttttacagccagtacttatggagtgcttattataggccagacactgttctaagtgctttgcatgcactaactcattaatcctcataagaaccctatgaagtaggttattagtattctagccctatttatagatgaagaaactggagcacatacattgagtaacttgcctaaagtcacacagctggtaagtgacagagctgaaatgaaataaaagagataggattgtctagggaggaaattgagcaaaagaagtatgatttcatttctttacatctaccattctctgcttcagaatgagaataatacttcctagacactttatagtggtatgatgaaagctaatgtaatgacgtggatcctgtaaagatcactgcctggagggaaaatgcgtctcaagccaagaactggccatggctgtttgtttagcctattctttatttggtaacccataacaatctcttattggtatagtttttcattcggctgagtgttcactggagtggaccacagaatggaattttctttgaagaaagagaaagctctacttttaagccagttacggagaggtgggcaaaggggtaaaaaattgcctgaattaggaacaacttgttctgtttttcaggtacttttctttgctaaccagtcatgtgaagaagacatccagcttctcctgtatgaccctaaactttttctctcacttcacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacaggtgagattaatcacaaatagtgtgggatattggttctgtgggtgcttgtgctcctaatgagagtcggatagccttcagcatcagccacagaaagaaacatttaatgacaccagggctgtgacattatttccactagtactgggaaaggtaatcatttgttaggtcagcaaacagcatagacttcattgacagacccataggaaaaataacatacaattcaagtatttatgtaaattcaaataccttttaagttactcagtcatcaatgaaggcaaaataacttattgaagagaaagagatatttagccctgagtaattaccctggattccactgttatttataaagcatatcatcattcacataaaacccctccctgcccttccagccggcccctgtggacagttggcagatgactcaccaactagccctcctgctgagatttccttctcacttcagtcctctggctccaattattgttaggatatttccttttgaatattcttctgcatatgaaatgtgtataaagctgagatcatgaagttccagtcgatactcccatattactcagtggcatccccaccaagcctccagggttacagcctcagagctatttttgtctcccctctgtcccgcatgtcaatttcttatcaacccctacctatcacattttcccctgtgttgcctctcagattgaccctaatccagccttcatcatctcacaccccgactggttttgaaacactgtacctgctccttcctttccctgttttagctgataggaaacacggtgccagaatcgaagtattctgaaacacgatttcatcatagccttcctttgctccagagcctaaagtgactctctgggcataactatatcgaagtcaaagtcacagaagcatacctacccaccattactacctaccactactgctgcctaccactacctgctaactaccattactttctggtcttgctccctccctcactgtcttttcctggaaatcttctctactctgtggcaatttatacccactacttcctttatccattttaggaaaatgcttcctagcttatatcccacctccccaagagtctttgtattttatatcctcttggcatgcatgtatgatttatgtcttacactctccagggtacatgtattccttgcctacattgctaagtcctcagaggcaggtaaagatctgttgatctgcttcttttcattctttctcttgttctccaagatttcactatagtgcagtgaacaaaggagattctttgtaaggaaacccgccagttttcatcatttccaatcctccacagttgtcagcagagatttccctaaggaaactgtcccttgggaatctcactagtagagtgaaaagcacttttttctttccttgattccccacaacactgcaaatgagtgtttaataacctgcaactaaataatatgtcctatataacatagctgactcatctttaccttgtattcccttagagtaataatttacagctttaaaaaaatatccacgacatacatctaatggataatgttcacatgcagcacacgtaggcttatatacaattacccagttagctgcagtccacctctttctccctggcaccatagaggaataaccataaatcaagtagattttttaaagtaaatgagtaaggctgggcatggtggctcacacctgtaaccccagcactttgagaggccaagatgggaggactgcttgagcccaggagtttaaaaccaacctgggcaatatggtgagacccccatctctacaaaaaaatttaaaaattagccaggtgtggaggtccacctgtggtcccagctactcaggaggctgaggtggaaggattgcatgagcccaggaggtttaggctgcagtgagccaatgtttgcaccactgcactccagcctgggcaacagagtgagaccctgtctcaaaaaaataatgataaaagtaaatgaatagaacattatttgagacacacattataatgggtaatggcattttaggccacacacactccctggttaggaattgaggcagaaaccacctttccacctctattcaggagcctgcccagactcctctcagttctcatttactataaggacccatctcttctcttccttgagactgccactgggatgataccccgttaaggagagattcaagccatctctttttccccagcaacccatgggaccatgtggcctcaatagaacaacatcaaaatactgaaaaataagcccctttctaaacaagagatacaccacgcagtggcagggaagctctcagttctcaataattgttttgtgaatggctataatggtatcttattgctgttatttccacaatcccagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacca

SEQ ID NO: 94 - DNA, 35737 bp, Homo sapiens
caggaaaaacctcaacctggggcaaaaacgtggtagagcggaaggagaagttaaggactgagctgctttgcagatcacagtgtttgaaagtgaacagccaacctgacaagaagcaaaaaccacagaacagagtaccacatcgtctttctgttcactttttttcacaaaatcatccaggctcttcctactctcctctcttaccacctctctcttcttttttttttttttttagttatttcacagatgccactggggtaggtaaactgacccaactctgcagcactcagaagacgaagcaaagccttctacttgagcagtttttccatcactgatatgtgcaggaaatgaagacattgcctgccatgcttggaactgggaaattattttgggtcttcttcttaatcccatatctggacatctggaacatccatggtaaggcacctgcttaggttatttctggttttatttctcagggggtcttggaggcaacattctcccttgctgaacttagtacggtgtaacgtttatacgaagtgggtaatcgtagatgaaaccaagctgttacatttgcttaccgaagacatcgtagagcataaaccaaattagaacatagtattcacctgcctaatcataggcatcgcatcaatagcttggctgactttcttaaaaacatgttgatggtaggaaaagagaactgagtagatgttataaatagttaagtacaaatctatcactacttcttgcaaaaatgctctggctgccatactgataatgaatagatagctcgttctttccaaactgagtgcagtagagtgctgcagtgctcagttgggtaggacagttgttggataatcggaattatacatatctccatggttaccctcaaataatattacctctaaataaaatctctatacttgcttcattgggatgtatgccttgagaataccgattgagaaaatgctacaaaatataggagcagaacttttcgtcattgcttctattttgttgaaagggaatggttcctacttggttgtcaattgaacacagaaaataagttggattctgcaaagatgatatttagccacccctgcaaagactttatacaggcaaaaaaaaaaaaaaaaaaaaaaaggcaatttcttttttattgtaaagtcgcttcctaccttatattgcataggaacccacatattatcaagaggaaaagcctatgagtggctcatcagaagcttctgatttttcaggttttatttttttatttttttgagacaagagttttgctctcgtcacccaggctggagtgcaatggcgtgatcccgcctcactgcatcctctgcctcccgggttcaatcgattcttcttcctcccgggttcaatttattctcctgcctcagcgtccctagtagctgggattacaggcaccttccaccacgcacagctaatttttgtatttttagtagagatgttggataaccccaattatccaacatctgtcctacccaactgagcactgcaacactctactgcactcagtttgggaagaacgagctatctattcatcatcagtgtggcagcctgagcattttcgcaagaagtagtgatagatttgtacttaactatttataacatctactcagttctcttttcttgccatcaacctgttttttaagaaagtcagccaagctatggatgcaatgcatgttgggcaggctggtctggagctcctgacctcaagtgatccacctgcctcagcctcccaaagtgctaggattacaggtatgagccaccatgcccagtgatttttcaggttttaaatattctgtcttattattccctacaagcacacatttatcagtttggctactgcaattttaaattagaaaatctggccactgaggttctatggaaagtctatctataattttaaactgtgtagtttggaatatgtctctatgatgccaggatgccacacaaccaagtgcaaagtaaaaaagtccttagttactcaaacatctttatgtttgtaagtatctagtattaagtcaactaggtgcttagatggttgactgaattttccaccttccatcagatgcctacagtcacatagctacaactggagtcaaatattattaaatagatttcttccccatttgaaggatacataaactactctctatgaaattaagaacaatgagtttcagtgctaaaccacattgatggtggggtaagacctttatttctcccaatgtgcaacctagcatttgcaaaagtgaacttggctgttagaactgggttaatttactggctctgccacttactgtatggcattgattaagtctcttctcttctctttagtttcctcatttgtacaatacaggtaataattgtacctaaattatggggctgctgtgaagactgtagatgcaataatatgggtaaagtgcctcgcatagtaagtgcacgtatttaaagctcagtaaatgttagtggtatttttcctaaattattttcaccatgcaacctctatgtaattaaatgagaattatgttttaacattattatttaaaatagttgagtttttaaagttaaaaataaaataaataagtacaatatattttgcaatatatttagcccaaaatatagtgaatcaaattattcagaaaatgaaatatggctgggagccatggccctagcctttagtctcagcactttgggaagccaagacgggcagatcacctgaggtcaggagtttaagaccagactggtcaacatggtgaaaccccgtctctactaaaaatataaaaatttgctgggtgtgttgggaggtgcctgtagtcccagctactcgggaggccgagacaggagaatagcttgaacccaggaggcagaggttgcagtgagctgagatcacaccactgcactcaaaaaaaaaagggaaagacttgagtgaagtactggtcagatatataccagttgatataatggattgcagcagcagttgcattaaattaaagctataggttaagagaaggaacatttggtgaaatttgttctcccaggcagagctgatggctccatttcttaaaaccacattaaataccttatatcttggggatttcctgtgatttacttaattgctgagttctttacagtaatacattttcagtgtttaaagatagcctttgaagattttttccccctacttcaaagcaatgtgagatccgtgtccttgttcctaggagtgaggctgcatatataataaggctggaaaaaatgtaatgttctctacaaacttcctgtttaaggtccttctttattacaaaagtatgcttgcttactttttgtgtttctctaaaaaattagagaaacttgcccctcagtgtgtggcatacagtttctgtcctgatagaagtaataaaaatgtcaatatcttcccttcatgggcagatcatgctggcaagatctagactgcaagtggaagtgtctctgtccattgcctgccctgtcatcctggaccatttgtctgaggctgccctagaccctagttcagttgaggatcaaccaaggattccacttttaggcaggcaggaacactgcagttaatgtctgggtatcaccaacaccatatatgatgcagaataaaggcagttggaactgtttgattgattactggttattgtgatttttaaaaaaagcaatcctagtctggttcagtaagggaaagacacctgtattctggctcttttgagaatacagtggttagggctatgtctccattttggtctggcttgtgtcatttttttccctttattatgatggtccagtatggtccatggaccagcttttaaacaccgtgttccacatcccacacagattgttttgctctactacaaactggccatatctttgggtcaaaaaatatcattccttgaagttcaggttttgtagcacagtatctttataaggcatatttctatggcttcagctatttgttcttattgaaatgtgcatatggaggaatgctagagatagagctctgtcttctgccaagtgcctatgtattgttacaacaatgcctgccatatattaaataaatgtttaggaatgcattctgtggttacaggacttcttgaattaaagcatgaaaagattaaccttgtgctcattgcagccttgaatatacttttcctatcacagagaagtttttaaatttcttgcttcctctgtcctactaccaaagtttcctctattgtaaagttgacgtcaaaactatttatcttgcctcattgggactttcctacttaatttccattatttgtgagtttcatctttatgtagagttcagaattgttaaaagaaaaatatttacaggcatttgtaatcaggtccaaaaaataatcattttcttttttccttggagaagctgtgtggtatagtggctaagatcagggactctaaagccagactccatggattagtatcctatgtctgccatttaatggttttgtgactataaaatctctggttctcagttttctcatctaaaaaaatgggagaataatcttataaggttgttgtgactattaagtgaattaattctgtaaaacacttagaatagtgcatggcatgccattcagtgctgtgtatatttagctaattttttttcttttagtccaacatttcattagtttaatagtcctgttaaagtaacattgggtgacaattgggaatcaaccacaaataaaaatttggagttcacaaaagtcttctataaattactcttgatattattatctactcttttttttctttatttcttctaaaaaaggaaaacaggatacatgtgcagaaatgtacaggtttgttacataggtatacgtgtgccatgatggtttgcttaacctattgacccatcctctaagttccctctcctctccccctactccccaacaggctctggtttgtgttattcccctctctgtgtccatatattctcattttcaacttccacttatgagtgagaacatgcagtgtttggttttctgttcctgtgttagtttgcttaggatgatggcttccagcttcatccatgtccctgcaaagggcatgatctcattcttttttatggctgcatagtattccacggtgtatatgtaccatattttctttttccagtctatcattgatgggcatttgggttggttccgtgtctttgctattgtaaatagtgctgcaataaacatacgtgtgcatgtgtctttatagtagaatgatttatattcctttgagtatatacccagtaacgggattgctgggtcaaatggtatttctggttctagatcgaggaattgccatactgtcttccacaatggttgaactaatttacactcccaccaaccgtgtaaaagcattcctaattctccacagacttgccagcacctattgtttcctgactttttaataatcaccattctgactggcgtgagatgttatctccttgtggttttgatttacatttctctgaccatcagtgatgttgagcttttattcttatgtttgttggtggcataaatgtcttctttttttttttgagatagagtgtcgctctgtcgcccaggctggagtgcagtggcgcaatctccgctcactgcaagctctgcctcccgggctcatgccattctcctaactcagcctcccgagtagctgggactacaggcggctgccaccacgcctggctaattttttgtatttttagtacagaaggtttcaccgtgttagtcaggatggtcttgatctcctgacctcatgatccacctgtctcggcctcccaaagtgctgggattacaggcgtgagccaccgcgcccagccagtgtcttcttttgagaagtgtctgtttaggctgggtgtagtggctctcgcctgtaatcccagcacttcaggaagctgaggagggcgggtcatttgaggtcaggagttcaagagcagtctggccagcatagtgaaaccctgtctgtactaaaaatacaaaaattagctgggcgtggtgggacacgcctgtaagaccagctacttgggaggctgaggcagaattgcttgaacccaggagactgaagttgcagtgagccaggttgcaccactgcactccagctgggtaacagagtgagactctgtctccaaaaaaaaacagagagaactgtgtgttcatatcctttgcccactttttgatgcggttgtttgtttttttcttgtaaacttatttaagtttcttgtaaattctggatattaggcctttttcagatgggtagattgcaaaaattttctcccattctgtaggttgcctttttgctctgatgagagtttcttttgctgtgcagaagttcttcagtttgttgcaattgcttttggcatttatgtcatgaagactttgtgagaaaaatgccaaaagcattatctactcttatccttggtcaccaagaaaagctaatagtgcttgagaatcatgcgcttgagttgtattgtgtcagtgaattgtatcatatgcgatttgcttcacttttctaatactctccattctcttacctcaaaataagctcaatattttgtacctttctggtatactctcatggttatggacctgatttacatgtttatctcaatggaagaagtggcttgtgtgcagcatgtgtctgtgtgtatgcatgcagaggtgtcatacaatttgagattcacttagaacagagtccagaagagtgttagatcagtcccaggaaaacatcaagtttagctggcagagctctttaatttcttttttctgccttcttgataaccatgttcatcttataagcacaacctggaactcacacacatcacaaatggcctattatccagtatttggctacaagggaggctggggcattgagatttttatctggggggttatggccccacttcattttcctctataatattagaagatgagaattaatattggaagacatttagcagattctgtccacataagtattgtttagtatcttcaagggctttgaaaatgccagtgaatctcagtgtgatgtctgtggtagaatgtattagagatgtgaggaagtatctgggaagaaagtagagatggactttccctttccaatcataatacataagccacacttaatctgaacatcacaagtaacaatccttccactgaagtcaatatttagaaatactcatgttggtttctgatcaaatgccagaggcactcactgatgctactgtcaacagcttctcaggtatgctgtctacatttgctgccctatgtttcttcctgaaatccctgtgacaaaggtggaaaatttagcctctctgaaggacagggcctatgtgtaacaggcaatcaaagtctctctaaatcattgttctttaggactcattaagttgactagaagcttttactattcaagggcgataattacatgttgaccaactaaaaccaccagaaactcatccttgttacacagagtagacagggctctaaggagtgcaatgcatatgaatcctctggcctagagaagcaaagtcagtgaccagtagggtagatctgcaaggggacatttgtgacttggcagagatgtaatgaagaagtcctgaaagcaagcttagaaaattatcaaaggacaaagtttttttcaatattctagttttgaccaaggcaagccttgctggttaatatatttctgtagagtttcctctcccacataaaagaagagcatgcttatattggatgtgctgcctttcttctctctattatatagatatatttttgcctggtgtatatactagttattatgcaccactgctgatccctagaatggttgttgggggtaatttttcacagcagagtcttctgtgtttccatcttgtctttaccattcataggctttacacctctggacaatgactcaacttctgtgtgatttccctaaattcatcctatcagaaaacataataatatctggtactttatgttgttgttatgtgccaagcatagtgctaagaatatttcctatatgttctcatttgctttcacaacaaccctactggataagagcttgtgctttggagttagccacacctgggttaaagtcctagccttgactcttcctcctaccagctggtgatcttgggcaagtggcttatattctctaatacccagtttcctcaacttaaaaaaataaaggccataatagtaattccctcataaaatcattgtgagggtcaaatgaaacaatacatgtttggtatctaaaagtgcctacctcataataagaactttgaaaatattagtcatattctttttttcctcgtgttaagatggatctaggttgggtctacagtatatagataatgtgaggtggagtgtacctgtgggcaagtggcaaagaatgtgtagcagtgattctagaggtgatctcctaaatgtaacttaaactttccattgggcatctgacctcatgacctctaaggttctcttcttgttctactcttaaatatctcaaggagaggaaatgacatggggactttgtaagctttgctaaatgtcggaaaaagcaatgacaaatactagaatgactgattttagacaaaacaagttcagaattatttcaaacatgataaaatcaagagatacagagcttaaagtcttcagtggctcaatacaactgcattgaagagatcagtcttcaaatttacttgccaaatagtcatactacactaacaatgagaaattctaactgtagaagaaattgctttaaagtgtgctaataccatatgaaagtaaacttaaagaaaaatttcataaatgaatataagaagatatgtttttataagaaggggatttttaagaggaaataataataaaagatgattgtgaaaatgctctcaattttcttgtttcatggttgctttttttttttaaataatgggcataaatgtagatttatgccctgtgtattcttggcattaatactttccagttccatttttgtgaaggaaattttacattgtgtgtgtgtgtgtgtgtgtgtgtgtgtgtgtgtgtttacccagggagaaaatggctcttcttgtctaaagagcaatatcaggtgatatccacagagaataagttaaatctactattgcatactacatccttgtctgtgatctgtattgtctatgatctgtatctttagtgttgtttttcaggaaagacatatgtaaataaactttcattttacagaagggactgagggccagtcagttttcactgtactcgtgagaacaatcacagggttttccttaaagtaacaatagtcacttttacaaaagaagctctgattttaacatatgtttgtgtgtgtcatacttacttaattttctccaggtattcctagtacttctgagaatatctgacttatggagtggtttatttaccacagagttaaagtaatacctttaatagacattacataatacattaaatgaatactttctatatgaggtggaactcccccaccctaacctcatgtcaccacatttctgattttgtgagtgtatgtgagctagtttatgatgggaaagtatgctacctgggttttctgatgtcgtccgtgtgatttcccaaggtatgcaagtcaatgtcctcccaagatccttgaagtatggttccatggctgctattgctgtgtgtggatttgccctgactatgtacaaaccactgccttatgggatccctaaactctaatttcaagggaagatttgagagacagattatttcccttccctggtggccatcatctctcccctcctctctaccattccagccttctaaagtaaggcagaacataccatctggatgcctttttgctcctgagtgtaaagacttcattccttctgtagcctccccagcatgcgtctgaagttttggtttgcttgttgtttgtctgtgatagtattttctgatagaagctaaaatcctggttgatgtcacagaaaattattggtttattataccgttagtaatcattttagtttctcaaaaaatcatttgtttaatttctatgttaaactctgacactttcttagctcaagttaaggcaatctgcattcattacagtcattcatttatttgaatggttgcaaccactttgaagtttccataaatttgtaagaatttttcaatggagacatagtgaaactcaggtgagattttcctcatgataatggttataatcaaaacatatggtatttaaaaataagaaataatgatattttataaaatattcataatcataaccctctttttttttaaatggctgattggtttcaaaaattacctactctcttcagctcagcaactacacttgctcagctgggagttacgagactatacagttgtttgtggctggcactcctttctgatcagctgatctgtgtagctggatggccatggagtgtcacttgttaaatatttttaatatccacccctgagtggacataaatcaggccttttcaaactgaatacttgtaaagtctagcttttctttggtagttataacttaaccactgtaaggtatgttgagctgcatatgttcttcacctcagtgccttttagcccacctctctaagggcttagctgtctctgctgtgcaaccagtactacatagaaaggtaacacaccatcaaggaagtagcagactagatagaagacagaaacatgaacacatatgtagttataaagagtgatgcatgtcggctgggtgcggtggctcatgcctgtaatactagcactttgggaggccaaggcgggtggatcacaaggtcaggagttcaagaccagcctggccaacatggtgaatccccatctctactaaaaatataaaaattccccgggcgcagtggcaggtgcctgtattcccagctgctccagaggctgaggcagcagaattgcttgaacccggtgggtggaggttgcagtgagctaagatcgcgccactgcactccagcctgggtgacagagcgagactccgtctcaacaacaacaacaaaaaaggagtgatgcatctcacacaaaatagcatcagacatttgctagggagtggggatatgagggtatggtaagtttgcataaacttactgggctaggcccagtgcggtggctcacgcctgtaatcccagcactttgggagcccgaggcgggcggatcacgaggtcaggagatcgagaccatcctggttaaccgggtaaaaccccgtctctactaaaaatacaaaaaattagccgggcgtggtggtgggcacctatagtcccagctactcaggaggctgaggcaggagaatggcgtgaacccgggaggcttgcagtgagcggagattgcgccactgcactccagcctgggcgacagagcgagactctgtctcaaaaaaaaaaaaaaaaagaaaaaagaaaacggaaactgtgacagtgatgtggagaattgaggtggagggagggaaacaaggccaagtttggaatgtagaagaccatttggtacgctgtgacaataatccacatgaaacagaatgagatccaaattaaggcagtgtcatggaaacaaatatggaagacattttccatcctgaatcaattgaacttcatggctgatggaatgggacggtgacaaggaaggagactaagatggctccccaggttctggctaatgtgattaggtagatgatggtattatactgtgataatgagaggaggaccaaatttgcctgggggttggcttggaggaagaaagagatttatcttcccccatgaagcctttcctgattgacccagccagaaagactgtcttcctcttgagggatctgaaagctctgagagattatatcatatccaaaataatacaacaaaaatctaatggcaaaattgaaaagtggtgtaagactttcagcctcttctttgtgctagaaactgtctcgttactaatgtgtcaaggacagtgggatatccagactcctgggtgtgaacaagtggctccattgtctgtattgaatttaaaaacaactaaaagttgatttcctttttttttttttgacacagattttcgctcttgttgcccaggctggagtgcaatggcacgatctcagctcaccgcaacctccgcctcctgggttcaagctattctcctgcctcagcctcctgagtagctgggattacaggcatgcgccaccatacccagctaattttgtattttttaatagagacagggtttctccatgttggttaggctggtctcaaactcccgacctctggtgatccgcccgccctggcctcccaaagtgctgggattacaggcatgagtcaccacgcccggccggtttccttttaattatcaccacatactagcaaacatgaacaatgtcagaggtgaaatatttacccttcaaaatatttttggtctaagttctaaatactatggttactgttgagttttatgatatatatgtaaacttcaaattagcacatttgtagtatatatcatttgacaaacattgcattctacttgcaagttaactcagagaacttcccagttatacagctggccttggacatataccattcagctacttgtgttcattttgatagcaaatttataaagtccaggatcactccagtttcctccaaggacactttgtgtcctcatctctgtggtactacatactccagcctttcaacattcaattttaaataaacaataataccacagagaatgctgagacaaagaagcagaacaggagctgtttcatttttgtcatttggtgcaaacttcttgaatttttatttgtgtttaaaatttaaaacagtgaaaaggatacaaactgtgatatataaaatcttcggcttggcaactttatttcatgcataaaatgttagattgattaatatttttacaattgaaatttttttaatgttgttttaaaactaactttagaaaataaaactttagtgttacaatttagtagttacctaaattgtatctttgcagaatttcagttttaatacaatccatttattagttattggacaactatttacataaactattatatcagactataactaaagaatcaaagttcatactgtttaggtggatataaaaatgattgaataaatacctgtgcatttttctttttttgtattttaatttttttaaaacattttttcatttgtatggttttatacatgaagttcagcacaagaaaatattcattgtctatatttcttttctggccattttattacttgttttatctcatgattatttctgaaaatatttttatgtatagagaaaggggttgctcaaatgatgtactctagacctaaaataaaatatcatcggtaccacctgatcgtggaatatatataccactagtggttttgataaaaattttaaacatgaaagaatttctaaacctatagtgacttaacaagggatatttcattatataagagcctgggggggagtagaagtttttattctttgtttgttggtttgttttttgagatggactctcgctctgtcacccaggctggagtgcagtggcgcgatctaggctcattggaagctccgcctcgcgggttcacgccattctcctgcctcagtctgccgagcagctgggactacaggctcccgccaccacgcccggctaattttttgttttgtatttttagtagagacggggtttcaccgtgttagccgggatggtctctatctcctgacctcgtgatccactcgcctcggcctcccaaagtgctgggaccacaggcgtgagccaccgtgcccggccagaagtttttattcttttactgcatgtatttattttaatcatttttagcattgaaaatttcctgtcatcagatatgaatgcttgagaaaaacagcagagataataagagcaggaataaaaataactgatggttccggctacttgggaggctgaggcaggagaatcgcttgaacccggggatggaggttgcagtgaaccgagatcgctccattgcactccagcctgggcaacaagagcaaaactccgtctcaaaaaatacataaataaaaaatgaaatcaaataactgataattggaagttgagtaacagccaaaagcaactgtgatagttattcctcttcgggaaatatttatttgataagacaaacttttgggggatagctttgtgtgtcctaagtatcataagatggatatgcataattcagaacaggcagaaaaggggtgttaacaagcttgtcagatggacaattagaattgtgctatttgtcggccaggccggtggctcactcctgtaatcccagcactttgtgaggcagaggcgggtggatcacctgaggtcaggagttcgagatcagcctggctaacatggcgaaaccccgtccctactaaaaatacaaaaattagccgggcgtggttgtgggtgcctgtaatcccagccaccggggaggctgaggcaggagaatcgcttgaacctgggaggcggaggctgcagtgagccgaaattgcatcactgtactccagcctgggcaacaagagcgagacttcatctcaaaaaaaataaattaattaaaaaaaatagaattgtgctatttgtctcagtgtgtcatttttacactacaaacatcagtgttagcctctgagagataggaggtattataataccttgtttgtgcacagagggagtactcttgatttctaatgcctgcttgcaagcctacattcatcatcggttcattcctccattcaagaaaaattcctgtgccagtcagtgtggttgtcaatgatcattatcctgctgataagaatatttaggaactgcaatgtttccataatcctattgtgaatcagtgatgccaccaacacaaaaagctagctcttttctccacccctaacccactttgcgcactgctccggagcatacagtcacaaaagacagaacttgaagtgatgtctaattgtgccactaacatcaagtgatagccctatggctaaatagaaaggtaatatattgtgataggaatagaaattgcaggctagaagtggtttcgtagtttcagtcacacattaaggaaggtgaagttgtgtgtgtttgtgtggtcaggggatggtgagttagaactttcctacttttacagttcaatcctttcatcttattttgaagaaactgaggaccagcaaaactgggggactatcaaattcgctcaatgtgttagcatttgaaacagacatgttcaaatgaatagtctcatttgtagctatttccgtgccctttataaatatccccccaaaattaggcattgtattttctcatggtggataagcaaagtttaaactcctgcctaatgcttattccatttgttctgaaacaaccagtggtctccatatcactaagtcagaaaaccatgatccagttgtgtatcaatgatctaaatctatcatgagattcctggtccctaagacttttccgttccatttcctcactcttaaaatacctcctctgtcccatgcactgctctgattgccaaagggctactcattcaccaaggttcagctcaagtatagcctttccatgaagctttgccccggctgaagttaaccttctgcagacccatgcaaagttgtttgtatctttttttttttttttgagacagagtcttactgtgttgcccaggctggagtgcagtggcatgatctcagctcactggaacctccagttcctgggttcaagcaattctcctgcctcagcctcttgagtagctgggattacaggcacgcaccaccacacctggctaatttttgtatttttagtaaagacggtgtttcaccatgttggtcaggctggtcttaaactcctgacctcaggtgatccacctccctcggcctcccaaagtgctgggattacaggcgtgagccaccatgcccggccttgtttgtacctctttacagtgttatataacactctcccaattgccattcatttttatttcccattagaaggcaagctccacaaatgcagacatcctatctgatttattcctaggcttcctaacaaccagcatgcaacgtccctcaaggcttgctttcagctcagtaaactgaaagaaataaagactggtatatagtaaattgattctagaaaagtgtctagaaggtaaattgattctggccaggtgtggtggctcaagcctgtaatcccagcactttgggaggccgagatgagctgatcacctcaggttgggagttcaagaccagcctgaccaacataaagaaatcccgtctttactaaaaatacaaaatcagctgggcgtggtggtgggcgcctgtaatcccagttacccgggaggctgaggcaggagaatcgcttaaacccgggaggcagaggttacggtgagccgagatcatgccattgcattccagcctgtgcaacaagagtgaaactcttgtctcaaaaaaaaaaaaaaaaaaaaaaaagaaaggtgccctctttgttagatactcctggggcttaccaattaaatggtaaactctttgagggtaaaagatctttgtctataaccatctcattgttttttataattctagcacagacttagaggctccataaaccattattgacttatccaagaaaatgaaaagggaagttaggaggctgagggagtctattaacttcagggagaggaacggacttctggaaacaagagtttcacttgacctttctgcctctggccttcttactttttttgtcctaagtctaaccacattcaggtacacttccttttggtaaaatattttaccctttctcttcatttttttgaaaacctcatccttataacttacctttcagtttggtttcattttagttctaaacttttggaagcaactgaattaagaagtcttaaagtgaacttgcttgaggtctcaaagcaattataaataaataaatattaagaggttctaaaagttgtctgcaggtcctttttctcactctgattcctggaaactcaatcaggtttctattattctgagcagagattcatgagatgtgagcaggaagggtttttaagtaggatgtgagtgaaaggtgtattaggtgtgaggaaatagataaaatgagaatatttatgctggcaagggtgtagaaataaggtgaaaccttgttctggatagacatgtatgagaaactcagggtcaaaatttgctccttggttcaacatctgacaagctgtgtgatcacaggcaaggcctttagctgtctttgtatttaaaagagagttttggctatcatctctgttacacttatgtcattctaatgtatgatactgtacatctattcagaagaatgcatgaaaatgagtgaaataaataaatgaaggagatgaactagacattgctaagagagacggtagttcaaaacatagaaagaaaggctaagaaagaactgtaagagtggagaaaaaaataatttaaaagaaaatacttttaggatcacgtgcttagccttaactttactggaaaataaaaaaatacaaatcaacaccaagtgcataactaaaaggaaatgagaaacaagccattggaaactggagtaaaggccattcttgtcatacagttgctaagaacttggtggaaatgtatctatgtcttaggactttacggaaagcagaaattaagagcaataattcaggatatctggtggaagaaatatctaagccgcaaagcatttaggctgctgtgtggctacttttaactgcatacagtaagaggcaggagggaaaaaaatgacttaaaaatggaatttataattaaaagagaagcagaatagaaagatttggaaaattcactgcctagccatataaaaagtgaaaaggcatgaatgggagaaaatactaagggtgtggcctagtgaccattgttaaagagattaatatggatagaagggagtgaagtactattcaagaagttgagaaaaaggccctgaaggcatttcaaagcctttgaggctgcccctcccatcataggctcagagctcagagggcaaattgatttcaggggaaactagaatgccctttacaggcttgctgcccagatctgcctcaggtttctgttctctgaattccagcacagtgctccttagctgctccagccatggctcaagtgagcccaggtgcagttcaacccaccactccataaggtgcaattggtaagccttggtggcacccacttgctaagtgtgcaggctagcagaatgcaagaggtgtggaacacaacttcctccatgtagatttcaaaggatgttgtggacagcctgagggcccaggaagagtccactcccatgtcagtgcctagtagagccatgggagtggactgccactgagaccccagaactgtggagctattagcctgaagcattagcctgggagagctgcaggtaggagtctccaacttgtgagtgctgaagcatcaaccaagcccagcaatgccattttatttctctgttgggttttggacttacttaggaactgttactttctcatttttgcctatttctcccttttggaatgggaatatctatcttatatctgtcctaccactatattttggaagtagataacttgttttgatttacatgatcatagttggagggaatttgcttcataatgaatcgtgccttgaatcttacccatatctggtttagataagactctgaatttagtgttttgaattgattctgcaataaattaaaacttttggggctattgagatggaatgaatgtattttgtatgtgaaaagaacatgagttttgggggaccaggggcagaatgctatggtttgaatgccccctccaaaattcatgttgaaattttattgctattgtaacagttttgtgaggtggaacctttaagagatcagaggttatgaatgtattaatgcccttattgtaggaatggattcgttatcacgggagtaggcacctgataaaaggataaattttggcccccatttttctctgtcttgtgtgctcccttccactttctgctttctgccatgagataatgcagcacaaaggcctttgctagatgctggcaccatgctcttggacttcccagcctacagagccatgagccaaataaaacttctgtgattcaaaaattatccaatctcaggtattctgttatactagcagaaaacagactaagacagtgtctcatgtgtccgtgtgtagagaccaccaaacaggctttgtgtgagcaacaaggctgtttatttcaccttgcaggcgggctgagtccaaaaagagagtcagcaaatgatggtgagattatcattagtacttataggttttgggataggcagtggagttaagagcaatgttttgggggcagggggtggatctcacaaaatacattctcaagggtggggagaattacaaagaaacttcttaagggtgggggagattacaaagtacattgatcagttagggtggggaagaaacaaatcacaatggtggaatgtcatcagttaaggctattttcacttcttttgtggatcttcagttgcttcaggccatctggatgtatacgtgcaggtcacagggtatatgatggcttagcttgggctcaaaggcctgacagacagaggattaaatgatttatttcattttttaaacatatttattatatgcctaatatgtatgagacattctgctagtaaggcttaattactagaaattggggggttgtttttgaaaattaccaaataatgcttgagaactattgaagtcacatatatatggtacttccagaagaacatatttgattttagttttgtttttatcttttagggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacaggtgagttctcaacacctagaccatctgatatttttcttataatgtttccaggaagaggggggttcagtttctcaagtgattatgttagaaagccaactcctatagcacatctgaaatctgctacacctcacagattgttatgtgccagtgtgtacatatgtgtgtgtatgtgtgcgtttgaggtgagtgagatagaggagagtagagaaatagatagtaaaagttattgtttttgactttagggattataaaatttatttgataagtccaaaagtagaccactgaaatattgaaaaaattataaagtgaatacctatagttgcgaatagctctgtgattgcttgtccttctttgttgttttttttttctctttttcccatttttctcttctttacttttgttcattacaatttcttgaagttatgtttgtggtgcttaggcaattaaacacttcttaatagttcacagtttgtttagaggaaaaacagcaaacaactaactgacttcctagtgattttctgggaatattcagagcttcatctctcttccctgttccccgaaagaggcctttaatatgctttgacaactgaggaaggacagatagaagttaagcttggggaaaccaagctgaataaaacatgaaaaaatacatagggggggagtaggtaagagtaaaaaatacttggtttataaaaattttatagccaacatcatattcaatggtgaaaggcttagagctttccccctaagaacaggaacaagacatggatccttgcttttgccatttccatttaacattaaactgaaaattctagccagagcaaacaggcaagaacaagaaataaaagatatctaacttagaaaaaaagaagtaaaactttattcacagatggcatgaacttatgtgtagaaaaattcttaaaaatttgtttaaaactattaaagctaatacatgaatttagcaattccacatgatacaggatcaacacacaaaaatcagtgatatttctatacactagcaataaacaatccacaaagaaaattaaggaaacagttccatttacaatagcatcaaaatgaataaaatatttaagtacaaatttaaccaaagaggtataagagttgtacactgaacaaagaaagcatggctgaaagaaattcaagaatatgtaaataaatgcaaagacattctgtattcatggactgaaagatgtaatattgtaaagatagcaatattccccaaggtgatctacagattcaatgcagttccactaaaatcctaacagctttttgttgctattgcagaaataaaaaagctgatcctaaaattcacattgagttgcaacagacccagaattgccaaaacaatcttgaaaaagaacaaaactgaagctaagacttccctatttcaaaacttactacaaaatgacagttaaaaaaaaaaaaaaagaatagtattgtcatggatagacaaagagatcaatgtaaatagaattgagagtccagaataaactccatacatccgtagtcaattgatttttgataagggtaccaagattattcagtggggaaagaatagtctcaataaatggtgccaggataattggatattcatatgtaaaagaattaatttgaaccctcatctcactccatattttaagcaatcaaaataagtcagacatttaagtagaagagctaaaactataaaaactgcattatataaaacaataaaactctgatttcttaggagaaaacatagggataaatgtttctgatcttggatttagcagtgttttcttagctatgattacaaaagcataatcaacaataacaccaaaaatagataaattggacttcataaaaattaaacacttctgtgcatcaaaagatactaaaattcaacaacaaatagactggcaacctaattttaaaatgagcaaaggacttgaatagacatttcatcaaagaaaatatacaaatggccaataaacatatgaaaaaaatgctcaatgtcattagttactggagaaatgcaaatcaaagtcacagtgaaaacccacttcacacccatcgaatgactagaataaaaaaaaaaaacacagaaaataataagtgttagcaaggatgtgaagaaatagaaaccctatccattgctgaggagaatgtaaaatggtgcagtcactttagaaagtggtctaacagttcctcaaaatcaaaagataaaacctacttgtcacagtacccagtaattctattcctaggtaaatactcaaatgaaattaaaatatatgttcacacaaaaccttgttcctgaatgtttatcacagcactattcacaatagccaaaaggtagaaacaacctaaatgttcagctgatgaatggataaaggaaatgtagtttatccacacacggaatattattcagtcatgaaaaggaatgaagtactaatgtatgctacaacattgatgaacctcagaagcattacgctaagtaaaagaagaaaaaggttacatacaatgtgattctgattatatgaaatatccaaaataggcaaatccatagagacagaaagtagcttggtggttgccaggggctgaggaaataaagaatgtgacatgactactaaataggtagagggcttccttttggggtgataaatatgttctgaatctagatcgtagtcacgtttgcaaaacattgtgagtatcttacatgccatttaattgtacattttaaatgattaaattggtaacttttatgttatatgtattttaccacaataaaaatatatttggatcaaagaagagtgccctttaattataagaaataatgtggagtttcttttgttgctcataaattgacccttaaagttactgggaaggagaaatttcaaaagagggttattgcaatagcagcatggctgaactctggatgcaacctcgtacagtttagttcctttatggacatcattcacttgaatgcatacattttacaactgatctttttaaaattaatttgttactttatatgcttacttttgagtgtctttcaactcccttaaagtagcccagtgaaggaatccattgaaattcttttaaaatgctttaggttagtttaaaatttcttacagcagcaccatgaaaaaatgcatagcagtttagcagtagctacaaccctcaattatgaaatatagaagaaatcgatggcagagttagggactctgcttttgcaaatatagcgtgaagctcggtgctagttacttgtgaccatccatgcactggcttataaacctcttcaggatggaagctgtgtcttaaacatctttgctctgtatgatggatggcagggtacctggcacatggtaggggctcactaaatatttctttgtaaatgaattaaagaacatagtatatgcaaagcacaaaaattgtcttcatcaacctggagaaggctatattaaggatgtatggaatgaacactttctggaaagaattgcattattaattcacattaatgagacaaaatattgaatttttaacaaatactattttttaaacaggtaaaataaattacaaaaataaggaaaatctgcaaaatattaattctagaatgatatatactattgaataaataagtgctattaactaatttatataatatattaacataatgtataataaaattaaattttgaggcattgagtccaccttccttggaagagaagccttgtgtaattcagtctttctttatgggaactaatctacttctatacgagacatgaatttagccaaggtcagatgaaaggtcagaagttaataattaattgtgatacaaaagtctgttacacaaaagtagcattgcaatttctgctctatcccatatttgggtcattcatgatgactaaagataatctgtagtttgtaaagtgcataaaggtgcctgttctagggatcaagttggggctgagattaggatcaacaatctatctattttgtggaggaaagaacccaactttaggggaaagggaataacattccctcctaaatcctgtgccttggggggttttatggaacaaagtatgtgaagtatgaagtggtgaaagagaaagtctaagagctaaataggagacatgaagggccttgtcagtttctttttgaacatttctactctcttagtttcctactcacctatccttcctatcactcccttccttatcagtttgttaattaatgctcttgatcctcatggaaaatcccagagaattttctttggcttcctactcttgtctctccacaacattccactctgtgatgtgtttcctccaattgcttctataagcatctcgcaccatcattatcttccttctaaataattccaattaattctatgattggactctttgtctttagtatttccccattttggtcaatttcagccaaatacacttaaattacctcatacacttccttcataacaacactctcttgcatagcatccccagtggtcacaatattgggctcatctttgttaaccagcattcaaagtcttccacagtttgatcccaccacctttctagattgtttctggattccatatacagcctctcaattgcagcctgacggccttacttgccataaccacatctccatcattgccctgtgtatgctgctcttgccacttgtagagcacccattcatctgtctccacctatggaaattctacccctcctttcaatctcagctaattttccaagttcttaaggaagcttttcatgatcacctgaggggaagggatcactcctttttaccaatttttatgccatttaagtctgtgcctctcatttatcatttcctttcactgtagtaatgtgtggaaatgtcttttaggtcccatgaaagattataatgtcctggaaggctggaatttgtgtaatatttcttttttttttttcttttaacttccttcacaaaaggtaaattgtttaggaattaactttaatttaaactctgtgtggatttaaaactaatttaatctaggtgtgcatttttctttagtgaagtggtgaaaacaaaaataacagggagggtcaaagaaaaattccttttccttctgaacctgaaagtgctcagtgaactaagtataaggtgaggagaaaaatatattttggaaatatgtttaaggaccatgcttttcataaagaaattttggaggtctgataaaaaatattttattttttcctgtgaaatatatttccgaagtgattttggacattttcttgtttttataagtgactttcttttgctgtttatgttcaagttaaaagttcatgtaagaacaggactgtgacagagttggggcttggatgctcttgggaaagcactattctcccagaatgaagaaaagcaccttgcacaacaagccaaagtcctaggggaaaagttgacagagctggggaacagcccttgaaacatccattggcctgccacttcacccttcccaaacttcccttggtcagtttcagattaagaacttccccaaggctgggcgtggtggctcacatctgtaatcctagcactttgggaggccaagacgaacaaatcacttgaggtcaggagtttgagatcagcctggtcaacatggtgaaaccctatctctactaaaaatacaaaaaataaactgggcacggtgggaggcgcctgtaatcccaactactcaggaggctgaagcaggagaatcacttgaacccaggaggtggaggctgcagtgaaccgagattgcaccactgcactccagcctgggtgatagagcgagactccatctcaaaaaaaaaaaaaaaaaaaaagaagaagaaaaaaagaacttccccaaaatgtgatcattatctgtggcaggaaagtgggtgtggagtgagagggcaggaagtccttgtgggcttccaccctgatttggagcacctgctgaatgtgcctcttcttattccaggtgccagagatatcattgtgcagactatactgtgtccttatgcttaaggaatggggaagaggtgatcaaagcagacagacaaagattgcgttgtatttacagtctttcagtgagcttcaaaataagcccagatatttactttgtgtcaatgatcgtggggttgatgttccacaaattgtgcttactgatcttgagatagattgttggattctctggtagtgtgcaaacactggaatcctccccaaggctagctctggttttggacacgtgagagtacaccctcatcattttctcaatcaatttcagttatttaccttgtttctctatttcagaacaaactcaaaataagttagggggagttttgagtttgttctgaaatagagaaacagtttgttctgaattagttttatttgatcaaactaatcaagtaaaattaaggaaattaggtttttttggtggttaaagaaataacagaagttggatcttcttgatccagcagatctgtttgtattagggtatctgttgtagaaaccttagtccccattgctatccaagaccctcccccaggcagctgtttctggcactcctggcagtggtttggctgctcgctaacctaaacagcagctgcaacatcaatagacaacatttgttaccactctgaataaccaaaccactttttgtgcaacttcagttgcctctaatcatttttaccccaaacctaagcatctagccaaacaaaataacattataatataattaatagaattttttttttgtttgagatggagtcttactctgtcacccaggctgagtgcagtggtaccatctcggttcaccgaagtctccacctaccgagttcaagcgattctcctgtctcagcctcccatgtacctgggattacaggtgcataccacgcccagctaatttttgtatttttagtagagacggggtttcaccattttggccatgctggtctcgaactcctgatctcaagtgatccgcctacctcggcctcccaaagtgctgagattacaggtgtgagccaccaggccagaccttagaatatcttactccagtatttttcatactgtgttaactgtaacccaaaattaaaaaaaacaacaacaacaacaacaaccagatcttacatcacaacccataatgcacacaaatataaaaaagtttcataaggtcatacttaaccataagacagagtttctccattgacactttggtctggataatgttttgttgcactaagtgggggttgcatcctgtatagtgtagggtgtttagcagaatccccggcttctactcactggttgccagcctccctccccctaccttgttacagccaaaaatgtctccagacattgccacacatgttccctgcttgagaaccactgctctagtgtgtgtgatgcattctgatgatttctatcctcttctgtttcattttttaaaatgctatttgtgacatactaaattgtttcacaacctgctaatgagctgtgaacaactgcagacaaacagggcctcaatgcgtattaacattgatcaatagtaatgcgcattagctgtgtgccatgcagagcacttttaaggctatcaaaagtatttgatatttggagattctgataagttacgagacaaggaaaggacattgtgttgaagaaacttgaatttcctgttacaaacatgttggcttgagttcccattgccactcactagctatctgacttggagcaactcttgggacaaaataaagacaatggttttcctacttaagtgatgaatatgagagttagatactgtaaatagaaaggcttaatgaagtaccttctgacagttatcatgaagattgttctgtggaagattaactctatcagaataaagaatttctgcaaaagataaattatcgcagagccacgtctgctcagcaagaaagcaagaggtggctgagggcactgggattcttgaggaatgcctctgaaggggaaatggaggcattggcctgaaatctccttcactcaagttctgacaatgcagaggggtgccgctgatcccaatatatctcagatttcctaactctctttagcatttactaacattccagatgtaaaaagtgcctcagaacgaccctccaaggacgaaatggcaagcagaccctggctcctgtatcgtttacttcctttggggggattgcctctactcatcactacctgtttctgcctgttctgctgcctgagaaggcaccaaggtgggttctattttccctctgcccccagtaccacacatttggggccattcttatttctggggctaaaggatttttagtttcttcctgttgttttctttcccaatcctgtaaaccatggataatgatttcctagaagacaactcatatttgcgctaaaaagctaaataggttggttggggctcccttgagtcacgggagaggcatgctcaccacgcacagtattccagctagagttgtggcgagcatagcacattgctgagacttcatcattctctttgcatcaatcttaggtttgtgtgagaaagagctcttctaaaccttaacaggattggaagttgaaacaatctctcagatcaagatatctgctttattttgtattatcctcttttcacagccacaccacatcatgccaatcccacacacacccttatgtaactgaagaaccaatgtccccagagaaaattaatatgtctgtattttctattgccattataaacatatgcttgacctgaattcttacccaacaataatgcatatgaaaaatgtgggtttggctatgatgggaatggtgtgatattttgaaaataattcctttctacttttgcaagaactctctcaatgtcatgaccaaatatgttaagtaagagaggaaagcatagagaattctgatctagctttggcctgaactacttcagttttctctttcctttttcttctcctccatcctctcacattcctgttttcacaacaccagctacagtgtagctatagaaactgagctagatagagcaacacttattctgtgtgacacaggaataacctttgactgggcaaaagtgcttctggtattttggagtgagaacttctggagttcagaaccttctctggattctgaagaattctctcttaccccaattcttcatctgcaactccatggctctttctatggcctctctgtatctttcatcatctttcttgagactgctggaacctctctcagaacttcagaaaaggagtcagggataaatcttttgatttaccacatccaaagtgaactaggtagtaggagatcttggctacataggtgacaggacagcagcatttctggcattgagtatggaatgtccccagagcaaggacttccagtctcttccaagtgatatactagatccctccccttccttttagatatgccatggggctatgtggactgaaaagtgatgaaccagagagagagctggtcagtgtgaattatcacaaacaagtgtgtgctaggcaaagcaaattaacaagccaaaactaacaacactatccctggcattcaacaggataagcatgggtggcaaggtggtttacttctgctttctttactccttttgattacttctttttctttttgtcttccaggaaagcaaaatgaactctctgacacagcaggaagggaaattaacctggtaagcttgatgtagctgttgaaacaaatgcaatttgtgttatactgtgtttatttatttattcaatgaatttatataacaccatgtgccaggcattattctatgtactatatatatatatatatatatatatatatatatatatatatacatagacccatttttaaaaatgtgaattttgcattctgctctctatgcagcaaagactctttagggttaacaagtctcgtaataagtggttctttggaagttcatggaaggcagtctagatccaagacagaaaagtcagagactgaaccatacaaacttgactctgctcttgcctgttatgtggcttcaggctattcatttattttttatgtaaacaccttaaggtctttctggaagagagtagggagctgatgaaagaatgaacccacaaataacctcataaaatgattagatatcttcataaatagcaccagcaaaatagagacatgatctttggcttagttattacacagaggtccctggcaatgtgtatgggctcatcaaggaagggaccactcagactaaaggaagggaattttggagtcaatctttcctataaggtttggaatgtaaatgtaggcttttcttttgagttgaatgttgtggagatattagaactaaaaaagaatgcaagatgaggcaatatatttgtggaaaagcattctgaagctctctaattaaaactaaacagtcataaatgagatactgcaaaggaacttgatgtgtgtgtgtgtttcaataaggaggaatagtgataaagaagtagtaaccctcttaaaaattccacaaaagacaaaatcgatacagccaataattctatatataatattaaatggcattcaacattccccaccaagctgcttaattttaaaccagaccaaatacactcaacttgacaaacttctattaagttttcattagcatcagtaggcactgtgtagggtgctaaggctttgttccctcaaatagggaaattttcttaaatattattttctttctatagtaaataataataaaaatttcacttgattacaataaggccagggagctatgaaattatttaagataaaaatctaaataatttactgtgcaagtaaaacccaggttggttaagctgtggacattgttcttcctgggtaggctggataaattatgatttgaagcttaattcaaaagggtattttctgtatgtgcaattgtctgggaagtttgttttaaagcgtttttgctattaacaggaatttgaagatttttgccccatttcagttgtctagcatttcagaaaataatcaaaaggataccatattatacccttggggctaaatatttcttaacataaaactagtttgggaactgtggagaaatcaaagtacagaaaggaactggtataaacatgacaggaaaggaactggtacaaatgtaacaggtacatataaaagccaaagctctgatcttaatccaaaacggtcctttgagggtataaagtgcttgcctaataaaaaccactgaattgtacacttaaaagggtgaattttatggcatgtgaattacatctaaacatatactataaatacaaattttaaaatgctttgtatactgtaacctgccataggaatgtaaggtgggattgctgtttctggctttatcatctctatccaccacattgtggtgcattggccttgtggcacccagccactttgacggggtgccacagcaggggtgctgcagagcactatattttcttttgctccattcattttaacaaaatttttcatggaaatgagccatttcttgggatgagagacagggaacccaattgacaggcttaaacagattgaaaagtatcacaggatctttgttgatatattgaggactaaaggctatttttcagttcacttgacagtcttctttagtgtgccacctactgacctcaaccaggctcttttcagtggagttgggagtactttttatcttagccaagcagcctctgcctctttcagtcgctcagccttactgttatttttgggcagccaccacatcagagggtggcactgtatcaggaattcttacatagcttctcagggtaaagccagacatgcttgcatgatagagctctgccaaggaaatctgccatagacatcctactgcacacatcacaatgaggatgacaaaggaccagacaaagtatgttgactttcaaagacagtggacttgataccttaaaggagttaggccagatgtcaagaacggaaatcgatgggcaaaacttgaatttaaaaaactgaaatagcccctagaatgaacacatcttctttgtcaggtgaacctttgtataggtaggagcggctaataaataactgaagagtgagaaaacatcaggactaattttactttttgtttttacaaattcacctctttcttagaagctctaagatatttggctatatttgaaacggtaagaattttcttgccgggagtggtggctcacgtctataatcctcgcactttgggaggccgaggcgggcggatcacgaggtcaggagatcgagaccatcctggctaaaatggtgaaaccccgtctctactaaaaatacaaaaaaaaattagccgggcgaggtggcgggcgcctgtagtcccagctactcgggaggctgaggcaggagaatggcgtgaagccgggaggcggagcttgcggtgagccgagatcgcaccactgcactccagcctgggctataggcaagactccgtctcaaaaaaaaaaaaaaaaaagaagaattttcttttgataggaataacaactggaatactgttttggaactttttctaagctttatctttccaaaactgacatcaattttttaatttaaggtctcaaattataataatatatcttggctaactcataatatttattgtttctgccctcttagggggtatttgttctgctttatccttaatctttttattctaaactgcattaaatactattcatcatgttataaactgcctgaagttttcataggatattttttgctttttccatcaatttgggctatgctttttatcttgaagggggattaaaaaatgttctgtgacctcaaaagtgaccagtaataaagcacaaaataactatttaggggtgacatagtgattctcaagcctttcatcctttaataattgaaatttagctgaaagtgtagatgtcagcagagtatgtgaggaacagtagattatttctcacaatggacatgactccatttaagcttttcattcatagtttgctaatgaatatgcactaccatggccgtaagtgtcacttaaaaccatctttttttctattgtaggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaagtctgtttctgactccaacagggaccattgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaacttatttgggagctttttatattatagccttgaataacaaaatctctccaaaactggttgacatcatgagtagcagaatagtagaacgtttaaacttagctacattttacccaatatacaaactcgatcttgcctttgaagctattggaaagacttgtagggaaaagaggtttgtgttacctgcatcagttcactacacactcttgaaaacaaaatgtcccaatttgactaaccaaccataaatacagtaatgattgtatatttcaagtcagtcttccaaaataagaaatttttgctgtgtcagtctaagaatggtgtttcttaaatgcaaaggagaaatcattttaggcttgatgtaagaaaatgaaaataataaatggtgcaataaaaatatagaatataccaattggatatagggtagatgttccacatacctggcaaacaaatgcttatatctactctgttagattgataagcaaatataggtattaatggagcagtcaacgtatagcacatttatgaggaaagtagagactcactgggtcacatagactaatggataggaatgtgacataatgctgctgaattaatatacttatgggcatctgaatagtttaaaagttagtcagaataggtatcactgggcaagtgaagatagcttaaactgcttcatgcttgacttgatagcaagttaaagtgcaattaatggaatggaggaaaacccagaatatttaattggtctgtaggggtcaatttgctttcattcaccacatctgcatcttgctgttcttcttactaaggaatcagggcaaatcatctgtagtgacatattttagtttgctaatcatttattttaaaatactgaggttgcagccacttaagagtatagcaaaagatggattcagatttttggactttccaaagtacttgagttaaactatttcaaaaatagcctataattttattcaacagtttgaggctattcgaattctcaggtgctgctactgaataatgtaatagtcttcatacaaagtggatagcaaaggttaaaatccatttcaacaaatatgtgagctgagctgctgcacaaaggaatgtgatgtgtgtgtgtgtgtgtgtgtgtgtgtgtgttaggtggggtgggtgacaacagaaatggtgcacgagaaactgatcaaattgacattatattttcagtttgcttatgaagctcaaaatactagagtaaatgggtcattaaagaaaataatatgtgaaattatggagtttagaatacaagtggggtatatatacaaaaagacaaaactgaggttttgtggtggagagattttcttaagtaacactggcattaagttttagctccttagatttgggggtgcaaatattcttttgagtcactgttattttgccaattacacctagaatttcaagcaaccaattcgagataggctgttttagccaggctgcatttgtggacaacttatgtaagaaagacatgttagaatagctgcttgtggtattcttaaaaatagaaacaggaaatatggggaggatacatttagctgtcctcttatcagatgaacacacgaaattgaacagttccttcatgattctctcaaacttaaaagcaaaatatttctgtcttatttaaaatatccttagtatgtcttatagtaaagataatgctgataatgatttcatctctaagatgtattaatatatttgtactgtttgccaaaatcacaaatcatttatgtttttattccttttcaaaatggtgtcagagacatacatgcattttcccaaatgactctacttcactattatttacatggcttatttcattagtttatagagggtttgagaaaaagaatatgtagataatttaatggtttttcacaaattttaagcttgtgattgtgctcaatgagaaggtaaagttattaaaacttatttgaaatcaa

SEQ ID NO: 95 - DNA, 6173 bp, Homo sapiens
cttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaaggtgagtgagacttttggagcatgaagatggaggaggtgtttctcctacctgggtttcatttgtttcagcagtcaaaggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgcatgtgagttggtttagtagagagacacaggcaatttcagacccttctatgagactggaagtgatttaagagggaaaggatagccatagtcctgaatacatttgagctgggtttcaggatgagctcacaagttcctttaaaaaaaattgacttaagcaaatcctgggaagagtttttttgctatacaattcaaggttttaaggtcctcggattcatatactttataaatgaattagccagcttgtttaaaatgtagggaaattgtgggaagaatgccttctttacttaattcaaggttttaaggttctcttaatcaattctactagctaattagccaattatttaaaaataaaagtttgaaattgccaaaaaaaaaagacaaggaaaaggaaagaaagaaagccaccagtctgtttggcatacaatacttaattgttgcctgacctacgtgtgggtttcagatgcagatcctcagttttcagctcttcagagactgacaccaggtttgttacacggcttaaaatgatgagtatatccattgaatctcaaccttatctctctctagaccttcttggttaagaaaccatgtagtttgtatgaagtaggtactcaaaagatatttgatgatttaatttttactggagaagaaatattcatatatgttttcttatttttacatgttttaaatatgtaaagattaaataaacactcttagaagtatttaaatttcctaaagtaaatttatctcaaccagtaacaggaccctcccaatactggaaagttgagtgtgaccgcatttagtggtgatgagtgtgagcttgcttggggagagggcaggacatttaggatttcttaagcttagagtcaatacaataaagattattgagtgctcacttgggtgggctataatcactgctcacaggagttcatgaaccacaagtaaaagagtgaggagatatgattagctcacaaataactttaatacagagcagaaagtaatgaactactgcaatggagttatcacagtgctaaggatgctcagagggcatctctgataggcagaggtgagggttagggaaggaagctgtagtctagctagctagagctgctggaatagacatgacaatggctgctgccaaactgttttctcttctgaggacagatgtcccgtgcaagtggcttggtggaagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagcctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctcactaagtaggcagaagtttttgacatatactttgagagataaagcaagattctgtacctcaaccttcagaatttcccctaccactcattatagttccggagctatatagctcctatcattctatcataaccttagaataccagagaacatatcatctcatctaattatctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcagtaagaaaatatctttatggagagtagctggaaaacagttgagagatggaggggaggctgggggtgtggagaggggaaggggtaagtgatagattcgttgaaggggggagaaaaggccgtggggatgaagctagaaggcagaagggcttgcctgggcttggccatgaaggagcatgagttcactgagttccctttggcttttccatgctagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattggtgagcaaagccatttcactgagttgacacctgttgcattgcagtcttctatgcacaaaaacagttttgttccttaatttcaggaggtttacttttaggactgtggacattctctttaagagttctgtaccacatggtagccttgcttattgtgggtggcaaccttaatagcattctgactgtaaaataaaatgatttggggaagttggggctctcgctctggagtgctaaccatcatgacgtttgatctgtacttttgatatgatatgatgctcctggggaagtagtcccaaatagccaaacctattggtgggctacccatgcaatttaggggtggacctcaaggcctggaagctctaatgtccttttttcaccaatgttggggagtagagccctagagtttaaaactgtctcagggaggctctgctttgttttctgttgcagatccagaaccgtgcccagattctgacttcctcctctggatccttgcagcagttagttcggggttgtttttttatagctttctcctcacagctgtttctttgagcaaaatggtgagtgtggtgctgatggtgcaccatgtctgatggggatacctttagtggtatcaactggccaaaagatgatgttgagtttagtgttcttgagatgagatgaggcaataaatgaagaggaaggacagtggtaaagaacgcactagaaccgtaggcattggcatttgaggtttcagaatgactaatattttagatgaatttgtttgacattgaatgttcatgtgcttctgagcagggtttcaatttgagtaaccgttgcaataacatggggcagctgttttgctctttgtcttcatgacaactgtacttaagctaacagccctgaaacatgagattaggctgggcagaatgctgctagagaggaccacttggatggtctttattctccttctccatgtccctctccatcacctggaagtcacctctgggtgccactctggtgccttccttgtcgaagctgtagctgctcacatgacacctatccctgttatccagtttgcttgactgggacgttttgccttccccttcagccaggaagtgaaagtcccagtttttatttatcacaggtgttggtattggtggtagaagaggtagaattatggaatcaggcctcctgtcaggatttctttttgacagtccctctcagacacctctgcctaaggccagctttgccattacaaactctcccttctccctctctcccttcttctcttcctcttccttcttctcgctctttctctctctctctttctccctctctgtctcttatacacatacacaaagatatactctattccaacatcctctacccaacctgacagagatgtcctttgctgtaggttcagcagtggggatgagaaatacagctctcaaacaggataactaaagcttattatcttatcaagcttgttcccttgcagacaagattgatcaattatcataggctttctgggtgttctttctgaagctttctcaaagtctctttctcctatcttccattcaaggcaaatgattgccatttaacatcaaaatcacagttatttatctaaaataaattttaatagctgaatcaagaaaatctcctgaggtttataattctgtatgctgtgaacattcatttttaaccagctagggacccaatatgtgttgagttctattatggttagaagtggcttccgtattcctcagtagtaattactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 96 - DNA, 14982 bp, Homo sapiens
aatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggtaagagaaggcagtaaaatgtgggaaaatgcattcttcttctcattccttacctggccaagttaacttctactgaacaactgtggttcagtaacttctagtaaacaaacacataaagctgtgtaaaaattagagagctgtaataactgcatctcacttaatttgtcttacattttctccctagaaatggagtcatctatgcatttcttacttacctaacatggatacggagagtggtgagaaaggaaactatagaaagtgtatcagctttacataagaattatatagtaaaatacaaacaatgaggttattacagttgtattttgagaaaaggtgttttgcaaaagccagagttttaaatgagccatgagtcaaacagaaatccctttctcttagggatataacttaaattatgcaaaacatgtgtttctaatttgatggggtttatgagattgcacatcaagcaccttccatgttatattatcattgcttgttatttactgagcgtaagattcaagtgagagtctgaactaccttttttcttgtttgcaagtcttacctataaagtacaaggtatgtggaaaaaaggtttgccttaaaaactacattttctagtctgtcttctaacgaatgctatgtaaaccaatttatcatcaatattttaattatcaaatacagcatttttctaagcaatttacaaattaaccctttccattctcatagccatcccaaaagttatgtatgttatttatttattattattattattattttgagatggagtctcgctctgtcacctgggctggagtgcagtggcacgatctcagctcactgcaacctctgcctcctaggttcaagcgattctcctgcctcagcctcccaagtagctgggattataggcacctgccaccacacccagctacttttttgtatttttagtagagacggggtttcaccatgttggccaggctggtctcgaactcctgacctcaggtgatccaccgatcttggcctcccaaagtgctaggattacaggcgtgagccactgcacccggccagaaacgtatgttattatcctcatgttcctaatgagaagtataaggcatgcagaatgtaattatcaaactatgtagctagcaagtgccagaggccagtatgagcctaagcagcctgtctccagagtctatgatcttaaaaccattattccacactgcctctcttaagaagggataataagacattgcttattttctttctttcaatcttcagtttaacaaggtacatgggattccaggagaagatttctatgaacatgttataataattctgtagacgagtgtatttttgtttgtagctcaaacagttacagtccacatactagagagcacctttaaacacagcaaatgtttagtcagagatttcaacctaactgtgcttagaaatgaaatcctgtaaacaatttggtgatactggcaaatttaaagcatctacctccttccaatctaattttcctcttcagattgttaattaaagaaaatgaaaagtatactttaattttattgccaaaagcactagtttgctttattcatgcaaaacaataatactcaaacttgctatttgcccgcagatctacaaaaatgctgggactggatgatttcaaggatgtacttatcaatggtacaataaaaccatctttttcagaaactactaaactttgtatcatgggttttgtttctcagatattcgattctccttaaaaatgcaacaactgtgataattatgaatacctgtagaacagattccaaggagtaaagcaaaaccccaaaagaaaacaaacgaaactcttccttagctacttaaaaaaaagattctcggctggggacgggtggctcacgcctgtaatcccagcactttgggagacggaggcgggtggatcatgaggtcaggagttcgagaccagcctggccaatgtggtgaaaccccgtctctactaaaaaaatacaaaaattcgcagggcatagtggcatacacctgtaatcctcgctactcaggaggctgaggcaggagaatcgcttgaacctgggagtcggaggttgcagtgagctgagatcacgccaccgcactccagcctgggtgacagagcgagactccatctcaggaaataataataataatagtaattctgacaaggtgcagtggcttacacctgtaatcccagcactttgggaggctaaggtgggtggatcacttgaggtcaggagtttgagaccagcctggccaacatggtgaaacccctgactctactaaaaatgcaaaaaaaaattacccagcatgttggtgtgcccgtagtcccagctacttgagaggctaagacaggagaattgtttgaacctgggaggcggaggttacagtgaactgagattgcgccactgcactccagcctgggtgacagagtgaggccctgtctgaaaacaataacaataataacaattctgctagctgagatgctgcagaagctagattcactgtcccggaaacatgaaaaaaaattattggttacttttatttcttcactgaagatctttcctagaaattatgaaccaaaaaatgtctgttttatctctcataatctatctgcttcttagtccaaaggaaaataatatgttttctgattccatatagatagatacaaggcacaatctctaatctagcagaatttgaatgatcctcagtatgattcatttttaatttatattataccatttagggatcctctgaaccagagcatattactgattaaattttatacttgttgaaagtgctgtcaaataaaatgatcatcattgtgcagaacaaaaaagtattctgttatttggagaaaatcacaacaaccaaaaaaataagatgtactagatggtgaaacatagaataaaaacaacaaaaatacatttattacatttcttttgaaagttggaaacttcacaataaactcgatatacaaaaatcgttatgtaaactgtataagcctgggtttccttatttatgatacagagataacttcttgggccattacaataattaaatatgtatcttttatatatatgaaattatcgagcagagtgcctagtccactattgacatttaaaacatctcattttccttccattcaaagaacttaaaatctagccaagataaaccaaagtaggccaggcgcagtggctcatgcctgtaatcccagcactttgggaggccgaggcaggcagatcacctgaggttaggaggtcgagaccaacttggccaacatggcaaaaccccatctctactaaaaatacaaaaattagccaggcatggtggctcatgcctgtaatcccagctacttgggaggctgaggcaggagaattgcttgaacccaggagacagaagttgtagtgagccaagattgcgccactgcactccagcctgggcaacagagtgagactccaattcaaaaaagaaaagaaaagaaaaaccaaagcagcagataataattgtttaacaatttgaaaaggcataatccatagaatttatagtggaggagattggtttcaaatagagtagtcaggaggattttagtgaaacctttgaggtgaactttgaaaagctgcaaatggcagtgtttgaagagagaggaagaggtggaacacagagagggtcttcagccctgcgtgtgcagatgacaagacagaggctggtgtttccagacaggtaagccatatgccagggcaacattgcacagaatggatgtgaaggcaaggcatactatcagtgggaagccaaatctacaataactgctactactaaataaagatcttttttttttttcaaggaaaatctacctgatttttataatgactggatgttcattgctaaacatctgcctgatctcatagagtctggccagcttcgagaaagagttgagaaggtttgacatatgtattacatttgtcttcttgtatagcttcttaacattgttaacttggttttgaagcataaaacattactgagattgatttgagtcaattgctccatttgttttcagttaaacatgctcagcattgatcatctcacagaccacaagtcacagcgccttgcacgtctagttctgggatgcatcaccatggcatatgtgtggggcaaaggtcatggagatgtccgtaaggtttggagattttctcagatttcttatgctatgtgacagattttcatctaatttacatttaactttccaaaaattttctaaaagcattataactgcatcatgcaaagtttagataacacgacaaaatgataaagaaaatatgccctggcttgacatgtccactgttatcattattatatttttagtcttttacttcatttttcatcctgtattttatctggcaaccctaattacataaaactaatacagactgcaatatctaacctttaaaacacacatgggcctcccagcactttgagaggccaaggccggaggatcacctgaggtcaggagttcaagaccaacttggctaacatagtgaaaccccatctctactaaaaatacaaaaaatagccaggcatggtggcaggtgcctataatcccagctactcgggaggctgaggtgggagaatcacttgaacctgggaggcagaggttgcagtgagccgagatcctgccactgcgctccagcctgggggacaggagcaagactccatctcaaaaaaaaaaaaaaaaaaaaaaacaacaacaacaacaacaaaaaacctaactactgtattttaatcaggtcttgccaagaaatattgctgttccttactgccaactctccaagaaactggaactgcctcctattttggtttatgcagactgtgtcttggcaaactggaagaaaaaggatcctaataagtatgtaaacagtgataacaacaggaatttttggagtgtgtgccgattaaataaaacaggggttgttcattggcttaattttgggcagcgcagctttcctctcagctgggtatggttcctctcagttcctcggctgggtacggtttcttggactgctgtgtctaccactacaaatgtacacatatgtgacaggtgtatagttaacacagtaaaatgcacaaatcttaagtgttcagcttgaatttaactattatatacatacatacacccaccattctcagtaagatacagaattttttatcacctcagaaaatttctttgtgcctctttcaattccctttcctgccacagacaaatatatttttatttgccttatcaaaaattagatgatttttgttattgggtttcatatcaatgaaaccacagagtatagactcttgtgtctggcttcttttgatgagcatgtctttgagattctattaatttaattttttagcagccaattgtggttaagagtcaacacatctttaattacaggcagcaatgactggtttctcagagcagtctgctcaggatataggtgatttttacccatttaggcataagatctgctacaataaaggaaagggagaaccaaagcccacgtctctgggtgtgtgcctgtagaaaaatattctgcaaatgggaatatcataaaatgaaaggattcaatctagaaagtttcttcttattaaaaattagtttttttaaaaaaaaattcaccgggaatggtggcgtatgtctgtggtcccagctacacagggagttaaggcaggaggatcacttcagcccaagaagttgaggctgcagtgagccatgttcgtgccactgcacaccagcctgggtgacagaatgagaccctgtctcaaaaaaataaaaataaaacaactagttttgactgtccatgtgtgttccttgcatatttaattatttcattcatttgtaagttattaagttaaatgtaatgcctactgaagaaacattttaataagctttttctttttacctatgtcttacctctgatagtagcattcaatcaaatagcaacaactcatcattatttgatgttaaattggttttctttctctcttccaattggtccattgcttcatggctgctttcataaggcccctgacttatgagtaagtatctgattcttgtttgattctaagaattatttgttacttatagttgaatgtaggtttatcaatagactccaaatgcatttttaaatgattaattgaattcagccaaaaaataatttaagtgactatttagagaacaaataatctcagtctttaattgtatctatgattgtgttacaactatgtctatctgatattatagctatagatatatacaagaatactactcaaatacatctgtaggaaattaatatgcaaacatacaaaatgcacatacatctgtgtatctatgatttaataactcccatgtccataactagttaccggtgtcaataagtaaccatataccaacttgttctttttgacccaatccttactacttttgacctataatatatactaaacataggctaagagatggaaaacctgggctgggtgcatggctcacgcctgtaatccctgcactttgggatgccgaggcaggtggatcacctgaggtcaggagttcaagaccagcctgggcaacatggtgaaacctcgtctctactaaaaatacaaaaaattagccgggcctggtggcgggcgcctgtaatctcagctactcaggaggctgaggcaggagaatcaattgaacccaggaggtggaggttgcagtgagcggaaatcacgccactgcattccagcctgggtgacagaacaagactccatctcaaaaaaaaaaaaaagatggaaaaactaaggtaaatatcatcagtataaacccaccttggtgaagctagactaatgaagaggaaaggcagtatatgaaaattatgtaaattgcgatatgataaagataaggcataagaagttaaagtattgggatccctaaccaaataaaaggagtgatgggggaacccttgaagcaagttatttgaggaattagctagaggaaaaaggtaagagtattcatagcggaagaaacagcaaaagtgagaccttgaagtgacaaacatcttggtgcgttatcaaagctgaaggatggctaatgtcactgataataagtgataaaaataacagtgtgagaaaaagattaatttttttttttaaagatcgctgggaaaagtgggtgaatcacctgaggtcaggcattcgagaccagcctggccaacatagtgaaaaccctcctcttctgaaaatgcaaaaattagcggggcatggtggcacatgcctgtaatctcagctactcgggagactgaagcaggagaatagcttgaacccaggaggcagatgtggcagtgagacgagattgtgccattgcactccagcctgggcgacagagtaagaccccatctcaaaaaattaaaataaaaataaataaagattatgtaggattttattagctatgataaggagttaaaacagtatcttaagggagaaactggaaggtttttaaaaacgaggatgacatcagcagtcagtctcactttacagatgagaacaccaaggcagacggtgtcatatcttgctcaaggtcacacagcaagtaagttgcagagatggtctggcttcagataccatgaatttaaccaccacaaaactcatagatatacagatagtaagactatgtttgcaccaacgcccaaacttcaattaaaaagaaaaacagggtctaatcagttatttgaatttcgcagtcaattcctttgtaaagcatataaaccactgagaaattgaattaggctcacaaattaaaatgtgaatatgaatataattatttaaacaaaagactacctcttaaaactctacctcgcagatatcctgtgagaagttgacgggataatagaaacagaactagtttgggaatttctaattctgagtgttttttgttgttgttgttttgttttgtttatttgttttctgagacgagtctcgctcttgtcgcccaggctggagtgcaatggagtgatcttggctcactgcaacctccgcctcctgtgttcaagtgattctcctgcctcagcctcccgagtagctgggattacaggcgcccatcaccatgcccacctaatttttgtattcttagtagagacggggtttcaccacattggccaggctggtctcaaactcctgacctcaggtgatccacccgccttggcctcctaaagtgccggaattacagatacagatgtgaactaccatgcccggccctagttctgagttctaatatgaaactttaggtctcagtttaacctacttactattaattatatgatcttggacaatgggcctaaaaaaggagtcttaatattcccaactacataatggagatagtaaggcctgccacacctctctcataaaattatgttgaaactaaaatagcataaataaaaatgtcaaaaaatatcccataatttttgctaaacttcttgccttccttatccaatttcctcaggaacatggacgttttgttctcatttcgtgatggagactgcagtaaaggattcttcctggtctctctattggtggaaatagcagctgcttctgcaatcaaagtacgtctatcctcacttcaaaatttatatgtcaatttacgtaagcagagcaatcacttcggagcctaaactatactaagcatgagttaactttatccttaacaagtacaacatgggatcatttaattgggggtaaaggatcaattatttatttttgtgtattacctaaaatataaaatctcagagccatatacttaaaatccaacttgaaacctctgtaggagataaaaattttcaataaaatctggctttggaactatgatacagtgtcataaattcaatagttttgattatcaaaaatagaaatgaaacatatacaactatataaatatctttaaattaaatgctatgtgaataaaaacaaatccaagcttctataaatgtaaggaaattagtcaaatagagtgtccagcccaggaaagaaatgtaaaaatcccaaatttaatttatggattaagacgggggaatttggcagggcacagtggctcacacctgtaatcccagcactttgggaggctgaagtgggcggatcacttgaagtcaggagttcgagaccagcctggccaacatggcgaaaccccgtctctactaaaaatataaaaattagccgggcatggtggtgggcacctgtagtcccagctactcaggaggctgaggcaggagaatggcgtgaacccgggaggcagagcttgcagtgagctgagatcgcgccactgcaccccagcctggacaactgagcgagactccgtctcaaaaaaaaaaaaaaaaaagaaagaaagaaaaccttaaatgtttgtgttttgtttgtttgttttaggtaattcctactgtattcaaggcaatgcaaatgcaagaacgggacactttgctaaaggcgctgttggaaatagcttcttgcttggagaaagcccttcaagtgtttcaccaaatccacggcaagtgttgtgtgcagtgcaatagtctaggctgacaagtcaaatgttccaggtgtagaatagttgaaaaaagggaagcaaaaagcaactatcacttagtatgttttcactttaggtattttatcttactaaaccattccactttctatgtggtaggtttcattatctccattttataagtaaagtcatctaaattcagaaagacagggtaaatgacttcagattccacaggcggtgaagccagagttccaagctgggtctatttaacactaaggaacttccttgcctcccgctaaaaaccttagagaaactttccacatgggagggtggttttaagtcccgaaaaaaaaaaaatagcttctgcttgataagaactccttcctaattctgtttttttacaaattaagaaacaatacagaaaagtcattgaggtcaaaagttgttgcaaaattaacagctaaaaaactacccacaaaaaaacacacaaaaaagtgcataagcagtaatttgcaataggaaatctgccctactgaacagactcaacaaatacttgattgtttctctctgggttttgagttattgctgtttagtccttggcaagaagctagattttcaaatcaagtagggtaggagactgagtgcggtggctcatatgtgtagtttccagctacttgggaggctgaggtgggaagattgcttgagcccaggagttggggctgcagtgagctatgatcaatacattccagcctgagtgatgaagtgagaccctgtctccaaacaatttttaaaaattttaaaaatagagagggaaatctagtttctagggttttgttttggtttgttttgatttgtttttttttgtctttggtttgtttctttatgtaaacagtttacttgttacgtcagtaagcacgtaaagtaaagtagtgctaaataaatagatacagtttaatgggcttcctggaagagggtaggaaagtgaatgcttatctgcaggggctttgtttagcatagactgacctaatgccttttcctgcagcctgtgccaaaatccattatcagttgtacacaacaccttgatttccctgtatacctctgatgctgcttaattaaacatattccatctttttacagatcatgtgaacccaaaagcatttttcagtgttcttcgcatatatttgtctgggtatgtagtcttatgtttgaatttgtttgctctcacttaacaaagaacaccaccaaattctcttggttggtccctaatatccattgggtttggctaacaatttacatccaaaaattcacatggtagaaaaatactagactgttctgttatcacttggccaggaatgtactggagtgggggacaggaaagctagttattttaaaaagagtggtctgtgctagtacaaaggtaagattccattcctagaatagttatgccaaatctgctcaggattatattatttactattctcatgcttgaaaatgagcaggggcaagggggtatgaaaaaaggatcatgaaatccatctcttgtcaccttctgttcagcactagtgcaagatttggtacctgaaaattagcaattaacctaaagaatgatttttctttttttctttctttcctctgatagctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggtgagtggaaaataacaagaaataattatctcttatgtgaatacaatagtatttggatatctacaaagcaccttcccatcagcatcttatctgagcttatctgatagttttagcagaatcaggcaagtagggatttggttgccatgatcccattttaaaaatgaagatgcagaaacttaatgagagtcagtgacaggttccttgtgaaccagctagaaagtggcagagctggccaggtgcggtgactcaagcctgtaatcctagcacttcgggagacctaggcaggtggatcacctgaggtcaggagtttgagaccagcctgaccaacatggtgaaacccggtctctactaaaaatacaaaaactagctgagtgtggtggtgggtgcctctaatcccagctactcgggagactgaggcaggagaatcgcctgaaccccacaggcagaggttgcagtgagccaagatcgtgctactgtactccagcctgggcaaaagagcaaaactccatctcaaaataaaaataaaaaataaaaagccaggtgcagtcgctcacgcctgtaatcctagcactttgggaggccgaggcgggcggatcacaagatcaggagatcgagaccatcctggctaacacggtgaaaccctgtctctactaaaaatacaaaaaagtagctgggcatggtggcgggtgcctgtagtcccagctactcgggagactgaggcaggagaatggcgtgaacccaggaggcggagcttgcagtgaaccgatatggcgccactgcactccagcctaggcaagagtgcgagactccatctcaaaaaaaattaataaataaaaacaaaaagaaaaataaaataaaataaattggcagagctttcctcacacccaagttccatcttgaaatctgaacatgtctataaagactggttgactccggtgaagccaatatcacatgctctgaaaatgtatgatcagactcagaaagagacactcacctgcaaatgagacagggctgttagtggggagataaagacctcagtgacaagcagagtctgggccctgctcttgttcagctgtcccgtggccccagccacccagagcaatgcctgcaccaaagtttaaaggtgagccacattcattgtatgccttctaggggcttagctggaggggaggaataagctccaagaagaacttctttttaattttctctgttttgttaaacttctgtttaacagtcaaaggggaaagcatcgggctgggtaaaaacatgagtttttcttaatttgagcactcatttttaaaatttttttatcatatttaacttttttattttagattcaggggatacatgtgcaggcttattacacaggtataatgggtgatgctgatgtttgggcttctaatgatcccctcacccaagtatagaacatagtgcccaataggtagtttttcaacctttgctttccttcctccctccctcccctatttgaaatcctcactgtctattgttcctatctttgtgtccatgtgtactcaatatttaactcccacttatcggtgagaacatgtggtatttggttttctgtttctgcattatttcacttaggctaacttaagctaatggcctccagctgcatccatgttgctgtgaagcgcttgatttcattctttttcatggctgtgtagtattccatggtgtacatgtaccacattttctttgtcccatctaccattgatgggcacctgggttcattccatgtctttgctgttgttgaacactcatttaaacacaatctcttaaactctcttaagaatcagtcataatctgtcaaatgcagattatatatgccccttgtctataccatcagcttcttacagtagaaaagagagaaagaaagtgcaaacaaaggccaggcgcggtggctcatgcctgtaatcccagcactttgggaggctgaggcaggtggatcatctgaggtcaggagttcgagaccagcctgaccaacatggagaaaccctgtctctactaaaaatacaaaattagccgggcatggtggcgcatgcctgaaatcccagctactccggaggctgaggcaggagaattgcttgagcccgggaggcacaggttgcggcgagccgagatcgtgccactgcactccagcctggccgacagagcgagactctgtctcaaaaaaaaaaaaaaaaagcgcaaacaaaaatacttattgtgagaaaatgagtttagctcattcagttttcaaaattaataatattttacaataattacgattgctagtagcaagactaatagccaaacattagccttcaaatagaatgaccttgacctcagtgaatgctatattggtgatctcctgcccactctgacctcactctgcctttctctcctggattggggaatgctgtgacctccgtatttcctctttctctttttcctataggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaataaaaatgcataagatatattctgtcggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcacctgtagtcccagctactcgggaggctgaggcaggagaatggcgtgaacctgggaggcggagcttgcagtgagccaagattgtgccactgcaatccggcctgggctaaagagcgggactccgtctcaaaaaaaaaaaaaaaaagatatattctgtcataataaataaaaatgcataagatataa

SEQ ID NO: 97 - DNA, 14341 bp, Homo sapiens
ataacatcctgtgcgctgctgagctgagctggggcgcagccgcctgtctgcaccggcagcaccatgtcgctcatggtcgtcagcatggcgtgtgttggtgagtcctggaagggaatcgagggagggagtgcggggatggagatctggacctggaggtaaagatatgggcctagaggtggagttatgggcctagaggtggagttatgggcctgaagtggagatctgggcctggagtggagatctgggcctggagtggagataggggcctggggtggagatatgtgcctggagtggagatctgggcctggagtggagatatgggcctggggtggagatatgtgcctggggtggagagatgggcctggaggggagatatgggcctggaggggagatgtgggcctagaggtggagtgatgggcctagaagtggagcgatgggcctggagtggagatatgggcctggaggtggagttatgggcctgcagtagagatatgggcctgaagtggagatatgggcctggagtggagatatgggcctagaggtggagttatgggcccggaggtggagttaagggcatgaagtggagatctgggcctggagtggagatatgatcctggagtggagatatgggcctggggtggagatacgggcctggagcagacatacaagcctggaaaggagatatgggcctggagaggagatagaagcctggagtggaaatatgggcctggagtggagatatgagcctggagtggatatatgagcctggagttgagataggagcctggagtggagatatgggcctggagtggacttaccagcctggagaggagatatgggcctggagtggagatacggacctggagtggagatctgggcctgttgtgtagatctaggcctggaggtagagatctgggcctggaggctcagtctctgcacagccgagatccttgttcctgggggcaggtaggcagcgagggtgagtttaccttcagcccagcaagggcctggctgccaagacgcacagcccagtgggggcagcagggtgccctggtttgcctgcagagggatggtccatcatgatctttctttctagggttgttcttggtccagagggccggtccacacatgggtgagtccttccccaaaccttagggtgtcatctccccacataagaggattttcctgaaatgggagggaagtcctgtcggggagtctctcatacactaggaagaggggaccctcggatgctcggcccacatttctgaccttgccttccccggcctttcattccctttcctgagtcaagctctgtgaagactggggtgagactagggtgctccaagatgggtgtgcagggaggaagtggtgtcagcagcagagaaagagagggaagcagtgctaggaacagcaggtcctctgaggacaaaggtgtaactcacaccctccagcgtttccgtgatggtaggggctgcagtgtggctgcggtctttctaccagaaaaggtgaggaaaccacagccatggccctgacattccaaatcctctgatgggggctcagttcatcaattggctgatattccattcacataggacttgccctccatgccgtgtctactttgtgttgttttatatgagtaattttgcagtattaaaatctagtaagagttgcttctccagcaacttgctcaaagttctcagctgacacttgttgtagggagacgccaagtctatgcaggatgggtccttcctgtagccctgggcacccaggtgtggtaggagccttagaaagtggaaatggggagaatcttctgggcactgggagtgaggggcggctccacatcctcctctctaaggcagtgcctccttctcccccaggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggtcagaggctttccgtctgggcttctcactgtcccacctcctgaatcccagagcttctggtgggggtgtccgtcagggtcccatcacccaggccctgactgtatttggggtcaagggagattgaatacaggggaaatgggtgctgtggtgggaagaatcactgtccccaatgatggctacattgtaatccctggagcctgtgactatttatgttacagggcaggggactgaaggggaaggtggagctcaggttgttgatgagttgaccttgagatggggagacagcctggactgtcccactgggctcagtgtaatcacaagggtccacatgagaggtggaggaagaggggagtggggattagagcagtgtagtgggagggagacgctatcagccactgcgggctttgaaggtggaggaagaccactagtcacagaatgcaggtggcctctaagggctggagaagtcaagagaactgattcgctgattctccagagggaacgcagccctgtagacaccttgatttcagcacagggagaactggatccaatttctgtctccagaagtggaaggggtcagtgtgttctctcccgctgccatgtttgtggtaattttctgcagcagcaacaggaaaccaacacaggaacccaggtcaaggacaagttaggaaaccaaacaaggatagccagatgtggtggtgggcacgagtaatccaacgactggggaggctgaggcaagagaatcacttgaactggggatttgttcaaaagagattgattcaggctgctaagagcctggacatgcagcctgtcctcttccacccccacatagacagcaggaaagagattagtgggaaacagatacaacagcccaagagatgaggctgtcttcacagtggcaagggagtcaggggctactggagacagagggacagagaagagggaggaagacagatggaggcacctgcaccaggggatatgggcacagaaaagacacggagatgcagagagggaggagagagacagacacggggaggggaaccctcactcattccaggtgccatggatgggatgataaagagagatgccttctaaactcacaacttctctttctaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtgagagtgtctagacattgttctcattgtcactgggacacagagtgaatgatccaggacttggaacccccaggtggtcatgaggaagataagtgtgggattcttatggaaagagagtgacttggtgaggtctgtaccaacagagacagagaaacaggagacataagtacagaacaggtgtcataacagaggacagacacaggggccatacagggaggtagaaaagagagaaagaggtaaaggagacactcagacagacagacatgtcccagagagaggtgtccttccatgctgactttgctcagagacctggcacaggttagaagtttcatttctgttttacctccacaaagtgttcctaccagaagaacccaaggacacccatatttctgacctgagttgggccctgtggcctcaggccttgtgccacctacagatgccgtgtttattctgacacctctgccttccatgcaatggagagtaatcatcccaggatatcatggcccctgaacaccaacccctgtatgctgtgtgaacttggggtccccagactggattctgaggctcatattccaaataatcccacatatgataggatcgctgagagacacagagaaaaatcagggacaccaaaaagcaaagacataaacacacacaaaatgagccagaagaaggagattaagagattcacagacacataaaaagaaagaaaagagggcagaatggagagaatgatggaaaggaggagagaaaagccccaaaatcagaaccctgagggagggacacaaagacagagaaagataaatatgtggggatggattgcagagattccaaatagaactagagagactgagaggcagagaaagacaaggagacggagagagagagatgatagatggatagatagacgtagatagatgataaataggtagatgatagataatggattggttatagatacatagatgatgactgatagatgatacatagagatgacgatgatgatgatagacacatagatatatacatagatgatacataaatagagacagagaggcagacagagaggtaatagagagagagatagatgatacatatatagataatagatgattgatggatagatagacagacagacaattgatagagagatagataagtgatacataaatatagatgatagataatttgtagatagacacaaaatagataaatagatagaaatgtgcagaaagttatgaacaagacagaaagtgagagactcaaaattaaagaaaaaggaagatcaagtcaaccaatccaaggagggtcagagagaataaaacaatccaaaaagggaaaacatacctcagggtggggaagtgaggtcatagacctagagagacagaaaaggtagaaggaggaaacagatatgaagagagatggggtggagggtgagagagagagagagagcattaggtcatagagcaggggagtgagttctcagctcaggtatgaggggagctatgacaaggaagaacctccctgaggaaactgcctcttctccttccaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtgagaaaagcccatatctctctcatgtcctatgatcctaaatccttagctaaggagcttcctgctgatgatggagaaaagcatggacagatgcagagagaagacacagcaggtgtgagggcggagtcagggcgcaggatggcagacagggcacctccaaaccctccttcatggcctgcatggaggcctccgatcagggctccaggcacccaggcagatggagaaagcggtcaggacagacccagagaaggggagactgggcttagtttggggagatcagaggttccctcagcccctcaatcttatccatttcccagaagcccatcatggcctctcacccacacagagagatatcatcaccagcaacccctacacccttttcttttcattttcaaaaatatttattgaggttaaatgtaactatataatttaccacctttaccatttttaaaagtaaaatctagtggtcataaatacctttatatgctgggtgtggtggttcacggttgtaatctcggcgctttgagaggccaaggaaggtggatcatttaagatcaggaactcgagatcaccctggccaacatgtgggaaattcatctttactaaacagacaagaaaaattagccgagcatgctggcatgcacctgtagtcctagctacttgggaggctgaggcaggagaagcacttaaacccaggaggcagaggttgcactgagccgagatcatgccactgcactgcagcctgggagacagagagagactctgtttctaaataaataaatacatctatattcttttttttgttaccctccacccttcccttcctggcctctggtgtccaccattgtattctccaccttcatgagatccaccttttatctcctgcatgtgggtgagaaatgggaatctttgtaatgacctccagttccatccatgtggctgcaaatgacaggatgttattgtttctatggatgagtagtctccactgtgtgtgtgtaccacagttctctatccattcacccactgatgggcaggtaggttgactccacatcttggctactgtgaacagtgctggaacagtcatatgagtgcagatatcacttcgatacactgatgtcctttcctttggatataaacccagtagtgaaattgctggacactatgaaagttctctttttttttttttcttttttgagaaagagtttccctccttagtccaagctggagtctaagtggtgagatcttggctcattgcaacctgtgcctcctaggttcaaatgattgtcctgactcagcctccctagtagctgtgattacaggtgcacgccaccatgcctggctaatttttgtatttttttagcacagacgggatatcccaattttgggcaggctgctctcaaactcctgacctcaagtgaggtgcctgcctcggtttcccaaagtgctgaagttacaggcataagccactatgcccagcctccttttagttttttaaagaatttccatacttttctccataatagttgtactaatttacattcctaccaacagggtaccagggttctcctttctctaccatcttgccagcatttgttttgcctgtcttgcagtaaaagccattttactttactttattttatttatttatttatgttgagatggagtttcactcatagtctcccaggctggagtgcaagggtgtgatctcagctcactgcaacctccgcctcccgcgttcaactgattctcctgcctcagcctccaaagtagctgggattacaggcatgtgccaccacgcctagctaatttttgtatgtttagtagagagggagtttctccatgatggtcaggctggtctcccgacctcaggtgatccgcccacctccgcctcctgaagtgccggaattacaggcgtgagccaccggcctaaaaggcattttaatgggatgagatgaaaactcatcgcgattgtaatttacatttctctgatgatgagtgatgccgagtactttttcatatacgtgatcgccatttctatgttttgtttgtggagaaatgtctcctcatgtcttttgctcgttttttaattaaattgttttattgagttgtttgagcttcttatatttccagttattaatcccgtctcagatgaatagtttgcaaatatttgctcctattttgtcggttgtctcttcactttcttggtttatcttttgtggtgcagaagttgcttggtttgatgtaatcctaatggtctattttttgctttgattacttgtgttttgaaggttttaaacaaaatgtctttcgtcagacaaatgtcttccccattattttcttctacatgtttcataggttcaggccttagactcatgtttttaatccattttcatttgatttttgtgtatggtgacaggtatagatgcagttttattcctctgcatgtagatatccagttttccccacaccatttattgaaaagactgtcctttcctgattgtaagttctcggcacctttgtcaaagtccattaaatgggctgggtatggtggctcacacctgcaattccagcactttgggaggccgaggcgggtggatcacctgaagccaggagttcaagaccaggctggccaacagagtgaaacctcgtctctactaaaaatacaaaaattagctgagcatggtgaccagtgcctgtaataccactactcgggtgtttgaggcaagagaattgcttgaatccaggaagtggaggttgcattgagctgagattgcacctctgcactccagcctgcatgacagagcaagattctatcacacacacacacaaaaaaagccattggatgtaaatgcatggattatatctgtgttctccattctgtttcattttttatgtgcctttctttatgccaatgtcatgctgttttgcttactacagctctgtaacatatttctaagtcaggtagtgtgatgctcctgttttctctttataccttcaagtctcaagacagtgggcatcgcacacaaaaattatggagaagaggatcccaagactcccagggtccaacattagataacagagtgttggccatgaaccaacctcaaagatttccattgagtagaggacaagcaccctcatttcctcacatctctcctgtcccatgttctaggaaacccttcaagtagttggccttcacccacagaaccaagctccaaatctggtgagtaaaggacccctcttatctctgcttttggaaacctggggaggtggaagccttggatgcaagtgttggctcaaacctcccagctctgtgaatgagggcctgtcttccaccatctctgaactccagacactccaacagtgaaagggatctagggccaccaaagggctcagcgaagtctcttaacctttaatgtcctgcaggtgagacctcctacaagctagaagaatgattgccaatctgacatccttctcaggaaacatgcagtgttttttcttcctgcattcctaactggaggataaattcctggggacttgagagagggaagggaagggaacatctgatgagggcgaggtgttttagagaagttccacttgccaaggaatgaattactgttggtcatgaagcaaccctggctgactcagcagagcaagagccttgccgtaacagagaacagagctcatgcacgcacacttcgactcactgactcattcagccacggccccatgctcaggctgtgcagttggaatcctttcctattgttgccataacaaatttccacaagattcgtgggtgaaaacaaaacggttttttaattatcttacagtgctgtagctcaaagtaggaagtgcatcttactgggctaaaatcaaggtgacagcaaggctgccttccctctgaggattccaggcaagaatctgcttctcacttgtcccagcttctaaaggctcccagttccttggctcctggtccccttcctccttcctcaaagcccacaaagactggtcacatctcacatggcatcactcagacccttcttccttaccacacctctttctctgaatgctgctctcccttcttccttatcttttgaaaacttggggattctattgggttcaccaagatgaaaatccatcataatctcccggaaatcattcaggatacccttgttttaagttcagctgactagcaaccgtaattccatctgcaatcttcattccttctttccatgtaaaataagatattcacaagctatggaggccaggacagggacattttggggtgggacagcattctcctgccttccacgaacggtgaacaagatgcatttggcctctgctcttgggacactgatattgcagatggttaaatgggaggacagaaaatgaatgcacaagtggaccaataaatgaatgatccattgggaagcatctgtgcatgaaatctatttgtttgttcgttcatttatttattgagacagagtctccctctgtcttccaggctacagtgcagtgtcacgatcttggctcactgcaacctgcgtctcctggatccaagtgattctcctgcctcaccctctcgagtagctgggattacaggcaactgccaccatgcccggctaattctttttgtatattttttgtagagaggatgtttcaccatgttggccaagcttgtctgaaactcccaacctcaagtgatccgaccatctcagcaacccaaagtactgggattacaggcgtgagccactttgcccagccagaattcaaaataaataatagataatgctgagtgtataattttgggtgacagagaaggtctcactaatcagatatttgtgacattaatgaaaaacacggattgaacccctgaaagattggcggaaggattttccacacacagctgtcagccgtgaaggcagaaagctgaaaacaatctgatgtggaaggaagaggctctgcctgaaatgctgggaatgaggtggggagaatgacaagacgactgtggagagacggagagcacactgggtacacaggaaactaaggagcaacaaggagtgtgtgtttgacactcacagccattggattcacctcggggtagccaggaatccctacatgattaatagtgactgacatgaaaataagggaggcccaggtgcgtaactggaatctaggagacagtggaaaaggcaattgccgccccactggtgaaatgtggtgctgatttagaccctaagtggatgaagcagatggatataagctatgtttgggaggtagaatcatttgcagggagggcttgctgggtttgagtttcctagttgtttaatccttgctaaattaatttctttctgagatttattcctcctacacataaatcaatacctggcaaaggagtgacagatatatgaggggtggtggaaatgaagggacctattatagcatagtatacaagtctgtgaacggtggctcactcctgtaacccagcactgcaggaggctaaggccagtggattccaagaagtcaggagttcgagaccagcctggccaacatggagaaaccctatctctacatggtgaaaccctatctctcctaaaaatacaaaaattagccgagcatggtggtgcatccctgtaatcccagctcctgctctggaggatgaagcaggagaatgacttcaacccaggaggtggaggttgcagtgagtggagatcgcatcactgcactccagcctgggtgacacaaggagactccatctcaaaaaataaaaataagaaatgcataaatataataaaacacacacgaatgacaaaggcacctgaattcccatcatcatttttctatttctctataattacttctttgatcctttatcttatccattaggcaatcagcctaaaacctcttccgtatttggctttctgtgagcatgagatcatatagaaaatgtgaaagcccgctgaatcctccagcacaaatcctggaatagagaaagtgctctggtcatcacaaaaaaaacttgccccctcacccaaatcccccatctcacccctacttccaatcacctgtggaaatacagatagatcatggggaggtaaatgctaatactccttggagtgagtccagatcttggaatcagagatcagtgccagcactagctcctgctcccctttcctactaattcacaggaggacaggtggtattgaagcaatagatagtcgagggggtggtccttcccccagcctctgaggtagaacagcagcctaacatgtgtctcccgagatcacaaagagtagcacatttcacacgggcttcaacactattttctggctgtttgacataagagaattctacttcgctttttttatattgatttcacttttgtttccttttcttggagaatgcaagttgtttaactcaagaatgccgtggatgtagaaatcctaaagcacattcgctgtgtatcaatcccagtccagtcttcccagagaagactctaaacacctcctggactgcacctgggcctatgccaattcctatcactcaccgtcactccagggagacagaacacacagagaatacgttacataggcaggttcattactaacagataagcagcgagtgacaacagaagcctacatttcaatgtgagccagttccccaaggctcagaaaagctgctcgagacatgtggagtcaccccatttgcagtgtagctgggggaagccagaaagcagcccagcctgggttttgtaccctggagccacaggaagcactcagctaaagcactgcatgacgtcctcctccaggaagaacaggaagacagcccaggctgttctgggacaatcctcctgatctcaggactttgctgtcttagtccatttttgttgctctaaaggaacacttgagcctgggtaacttctaaagaagagattggtttgcctcaccgttctgcaggctgtactggaagcatggcaccagcatctatttcttatgatggcctcaggccgctcccactctggcagaagggaaggagggtctgtctgtgctgagaccacagagatcacacggcaagagagggagcaagggggagggggagcaatggagcttccaagctctttttaacaaccagctctccaggaactaatagagagggaacttgctaaccccgtctccttgggacagcattgatctgttcatgatggatccacctccatgacccaaacacctcccaagaggcccaacctcccacactgggggttaaatttcaatgtgaggtttgaaggggtcaaacatctcaactaaagtagttgtatcctcagcacgttccatggttactatgagagctataactgagaaagcaggaggaagctagatctcccgccatctgggtgcttgtccgaaagagatgctgtaagtggttacctgtcaatcaagaaatgcaagacaattcatatagagaaactgctatgattagcttcttactggtgtctcctcttcttccaggtaaccccagacacctgcacattctgattgggacctcagtggtcatcatcctcttcatcctcctcctcttctttctccttcatctctggtgctccaacaaaaaaagtaagtctcacggggcacaggccagagagctcagggccatgtggggaagcaggatgggagcacacagctgtgtgttcctcactggcaggatggtccctggcccaagacaggagccacagaggcaggactttctagagagagcaccagactccctgcccctgccttcagctcacagaccgttgcctgattctgaactgtatcctcatgtcccctgcagccactcacatccaggagaaggttccatgacaggcagaaagtgggagacagaatcaatgggatgggaactcagagctattcatgggatgggtccttgagctcagagagatagaatgtctgagtctgctgttggcaactgagggacctcaggcacctatggcctccccctgtttgttggtatctgcttatgaaatgaggacccagaagtgccctccgagctcttttgttgacttccgtctcctacagatgctgctgtaatggaccaagagcctgcagggaacagaacagccaacagcgaggtaggtgctcctcggcccagcctcgtggctagtgttattcccaaacagtcctggaaaacgtgagcaccctccctcactcagcatttccctccctcactcagcatttccctctctccaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 98 - DNA, 5973 bp, Homo sapiens
aaggtggagggaaggccgggcacaggggtgaaggcccagagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccaggtaaaacggggatggcgggagggttgacctccagccccacaggaggggaccagcagggatctctgtggccacaaaggtcctgaggtccttagctctgtggattcttctaatcccttttttgggcagtccttccaccccgaaagcctctctgggcagagaagaaacagaaacccaagttcttcctgcaccctgtttctccctcgggaaacacccaggctccttctctacccctgcctctcggctcacgccccctccccttggcctctcttttgctcacctagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacaggtatgcaccccaaacttgggcaacaggacctccgaatccagcactcaaccccacacccgtgccggtcctctgtcccctgccctgaggtgtcactccctctgaagccagtgacccagtctccctgccctcgcttgcaccgttcctgcccttgctctgcaatcagcgaccctcacgccagcatcccttctctccagaagtggatgcggccagtccaacagaggggtcgggcgtgaggggacggttggtggtcaagagaactcttggggcgggctttctcatcctcaacgggtggctgcctgcatcctcccgggcttcctacccctggagcttctcaactccattctctttcccgcccagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgagtatgtggggcgggacgatgggagaagggctgggaggtgggtccccatcccctgcctcccgggacgcaggaagggctggggcagaggctgcgccctaggccctgtcggagagctcccagaagagtagaggaagggggtgggcggcctgctggagtggaaggtgcccccgaagcacgtgtatggggggccctgtggagagattgtgtcacccccgagctccccttctcccacccacgcgggagtgcccagagggagggggagggggggagagcatggggctaaagtgattcatttcagatatctgtagctcagggggtgggcttcgcggggttccaggccaggaaaacggcaagggtggctgatgccaagtaaactccaggccagggacggggaaagtggtcctggggagtcttggggatccactttatgcacctccaggtgctggaagctgagatggggagagggtgatgtgggagaggagaagacaagtctaaagccaggtgcctgtttccaggagcttccggcttggcagccctgctgtgttgggaaattgtttccagtgggctgatgaagtcttctttatccttgcacagtgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtaactcccccactctgcttcacatttgaccacaactccttcctgccccccttgtcacctcccctaactatgggtccccaaaccaggttctcggcagcgagtggcctacgtcattgctgtgggtctcactgttcgacccctttatattgctggcagcctcacagctgccatcaccccttcttgcttctcccgtggccttccagcgtcattgccggccttccctctccttccggctaagcccacttgctgggtttctgagcctcctcagctcatcaccttattctgctccttagcactcttatgagccagaccatctcctgaattcttctgcctcccttccttgcagccccagcactccctccccactgcagcacccagctttaactttgggttttcttttctcttcaggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacaggtcagcctcaggtgggaaaggagtagctgccctcccagggtagaaaggacagggaggaagggctggcagggcaaagactaggcaaacccaccctgtgatgccaggccactgggcacaagttccagagcctgcccatctcggcccccacttttctcacccccataataaagaaacgaaactgaaaatctcctcttgagtcacaagataaaagttccaccgttctctatgggactcccctgctctcaattggcgggagggtctgggaagttagaaggaaaggtgacaaaaattctgaatggttcgaaagaggtagaatatatttctagaatccttgtctactttgcagccagggcttgggttagagttgcaggaagtggcctggatttgggaggagtgaataaatccgtcccttggtcagcaaatatttactgagcaagggttttccaagacagtataaaacaaacacagaaaaaagaatactcagagagtatgtgttgactggttgataactatcggccatgacagattagccatgtctgcagcacgcacctgcggccactcagtagtagcaccccacggcaggtgcttaataatgtatagagattgaatgaatacgtgaacatgctaatggataatacatctcctgaaggccaatcctgagttttcacttgctttctggatacctctaactagatgttataccacctctcagccgccttaccctgaaccccagctttttctcccaccaatccccttgctgactcagcctgtcagtaatccactggtatccatccacctcgaaacctggcctcctcctctctacatcccatcagtcatcaaagtccaccagttctttctgtccaatgccctcttgaaggtcaactgttttatgtagacggctcaatgagagagatactgttaccccgaagactttctcaaaacagctgggaagtgccagactctgggtctaaactcaggtgtctgcatcaccaaatcactctccaggacactactcagatgcccttcaccctttgtctcctcccacccacccatctctcactttacaacttggagaatgctctgtctctagatgaatgggtcagttccctgttctctataccttcagaaagggggatgatgttcattcagggggcaccacaaggcaggggacactgatgtgagccgcatcatggaagttccaaaattgtgaagtagatgggggtcagctcatctgactgattttgagggttctgagcatttgagtagaaagtaatgtaaaagaatctgtaatagtatttattctgtggtctgccagggccagtttgagtgtgaaggcagtagggagcctggaaatgttttgagcaggggagggagctgactagagcattgtctgaataagataaatgtggccggcagggcatgatggctcacacctgtaatcccagcactttgaaaggctgagacgagaggagcacttgagtccaggaattccagactagcctgggcaacatggtgaaaacgcatctgtatacaatttaataaaaaaataaatagaaagaaaaagatgaacgtggccatgacccatgatgtccttccccaacctcccctggccagaacccaagtgagtgcagggtgattgagacttggggttcaacctgtgatatcacgtaaggggggcagaatcccaaaagatctcttccttctactcttttcagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtccgaggccccagaatgccaggacccaaacgccacagcaataatctttatcctccttccagaacagcccctgccacccccatcccagcgcttttctttccagtcagggacctgatctctggcttttgcctagggttgacccgtttccgccactgatcagctgaatgaccctgggacaagtcccttaaactctctggatctcattgcatctgtaaagtctgagagaatgacaaagtgtcctttctagtcctgaccctatgcctcatcctgtactttctccataggtgcccaacgctctgggagagccccaggtgccctcccagcaggccacctcctgctgtttctcatccttggtgtcctttctctgctccttttggtgactggagcctttggctttcacctttggagaagacaggtgagccagggacatggcaaccccgccccccagcagctcccgctcttccatcctcagagtgctgatggcaccccttcctcaggaaggtgaccaaatgggaccctgaacttgccctcagagccccccttcttcataagcctctcactccagggatggcttgtgcctgggtaggctggaaggggggttgggagaaagccaggaccagatggggagggcaggggcgctgagaaaaaatagagggactcagtgtccctcctcatccgcttcccttcatccttctcctccttccgccctccgtctctctctccatctcttctcacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaa

SEQ ID NO: 99 - DNA, 9028 bp, Homo sapiens
acagtttcccttccgctcacctccgcctgagcagtggagaaggcggcactctggtggggctgctccaggcatgcagatcccacaggcgccctggccagtcgtctgggcggtgctacaactgggctggcggccaggatggttcttaggtaggtggggtcggcggtcaggtgtcccagagccaggggtctggagggaccttccaccctcagtccctggcaggtcggggggtgctgaggcgggcctggccctggcagcccaggggtcccggagcgaggggtctggagggacctttcactctcagtccctggcaggtcggggggtgctgtggcaggcccagccttggcccccagctctgccccttaccctgagctgtgtggctttgggcagctcgaactcctgggttcctctctgggccccaactcctcccctggcccaagtcccctctttgctcctgggcaggcaggacctctgtcccctctcagccggtccttggggctgcgtgtttctgtagaatgacgggtcaggctggccagaaccccaaaccttggccgtggggagtctgcgtggcggctctgccttgcccaggcatccttggtcctcactcgagttttcctaaggatgggatgagccccatgtgggactaaccttggctttacgacgtcaaagtttagatgagctggtgatatttttctcattatatccaaagtgtacctgttcgagtgaggacagttcttctgtctccaggatccctcctgggtggggattgtgcccgcctgggtctctgcccagattccagggctctccccgagccctgttcagaccatccgtgggggaggccttggcctcactctcccggatcgaggagagagggagcctcttcctgggctgcccgtgaccctgggccctctgtgtacactgtgaccacagcccgctcctggaccctctgtgcccggctggccctctgtgcccagccagcctgcacctggggatgccaaggcctggggagggtggtttcacccaggccaagcctaagacagtccctctgggccctgctgggtaccggggtgtgacaccactgggaggacaagatgaggggcacccctggggccgccctgacaccccctcgaggctcctgccccgggggtcctggtgccccttcactgtggcaggcgactgggggttccccacctcggcccctctcccggggcctgctccccggcacctgaggcagcatccttgtcagggccgtgccttcctgcctcagcgccacctcttaaggttggcccgtgggtcactcaggactcagaactggagattctgggcaaaaggcaaagagcaaagggccaaaaggcatcccagggagacgactgcgggggaaccagagggcagaggggcgctcgtcacaggggagggggagctgagcgaggcaggaggggagccgagcctctccccccgtgtcccggctcttcaggcacgccctcgggacgccaccctccccgacccaggcgggaaagataagagcaaggtgtccgcagcctgacactcgtgcctcaggtgcccgcgcttgtgccggacaagactctcacaggtggcatgcctcggtttccccactggtaacagcacagggcactcagcaaggcgcagtgggcatgactggggtcctgtgggtcctgacccagatgtggccaccccggccgcagtggtcttcattccaggatgcctcttttccctcctgatctattcactgcgttcgccattcggtcattcccggggccaccactcccacctcaggtgtgtgcttcccttgtgttttatgagatatccccaacccggctgcttattggccccgtccgagggcaggagcataaataagagcctctgctttggcgtgggaccactgtgagctccagtcagcgctgccactgctgagctctgggccttcgacaggacttggccccttactgacttctccgtgtgctttgggtcatgggtgaggacgcctcctggcaaggctgcgtcctgaggattaaatcgggtcatctgtgaaaactacccagcccagcccctgacacttttttgtttgtttcttttagtgacagggtcttgctctgtcacccaggctggagtgcagtggtgtgatctcggctcactcgacctccggggctcaagcaattctcccacctctgcctccagagtagctgggactataggcacgtgccaccctgccaggctaatttcttccattttttttagagacagggtctcgctatgttccccaggctgggctcaaatggtcctcccacctcagcctccccaagtactgggattacaggcataagccactgcatctggcctccatgacacatatttttaaagtctgatttttaaagtcaaacttttgaagtcagattttaaacggactattttgaaaaatatacaaaaacgtttaaaaacaatgaatatccctcacctagaatcaataactaagaatattgacacatttgctttggggactgggcggctggagctgccatgacaaagctccgccgaccgagtggcttttaaacagagcctgccctctcgccgactgagggctggacgtgcaggatggagctccgcagggtcggctcccctgtgctctgaggggctctgctcagcctctcccggctgtggcttaaaaacagagcctgtcctcccgccgtggggggctggacatgcaggaccgaggggccacagggtcggctccctgtgctccgagagggctctgctcagcttctcctggctggggggttttgtggccaccctctgtgttcctgggttcagaagcatcccccaggctctgccttcatctctgcacgggtgactctgtacaggaagccaggcctgctggtcaatggccacccagccctgtgccctcatcttacctagtcccagctgccgtcaccctattcctaataaggccgccttctgaggtcatggggttaggacttccacataggaatctgtggggacacggttcggcccacagcccttcccacctccacacacacacacgactgtgaggagttggaagacctcactcctcacccctgccaggtcctctagggacaagctcgctgtcctcatcccagcacagcccgtgggacggtttccttgtccctaatgggaccacggtcagagatgccgggtctggtctgggccagcaggttcctccgcccggggcaggcagccttcttctgtgcgcttctggaaagcaatgtcctgtaatgcggtctctctgcgggagcacccccaccgccacctcacaggcctgttccacagccccgggatgggctctgtctccctcctgaccctgcatagggcacagccctctctcatcaacccacgatcctacgtggatccgagagggagcacctggggaaacaatggaatcccatagaaacaccccaaatctaacttgatccaggaccagccagtggtcacttctgaatattcaccttcctagtagacactaccagccaagggaggccaggaagccttcctggaggaggtggcctgaggactggggtgaggcaggccctgcgtgggggtcgccacccagcacccccacactgggtgggagccagtctctgagactggctgggggaggtgggagagggggctgcttgaactgcagacaccgaggtctagcccccaccccacccagccagttggtggaggcaggggaggccgaggggcccagctggacctgctccccggggtggattccaaaataggggggttggggggggcggaacaggagcccagggtcctggcttgaggcccagtggctgagggctggtgcaagccagacaggaaaagggttgagcctgtcagcgccagcacagatcaagtcaggagcaggtccctccaccaatgtgtgcaaataaatagcagctaagtttccagttacaagaacaatgcacagatggtcccagggacattgcggtgtggacacacagcggccattgtcctgtcgccagcacctcgccctacagctggggggtcccttagcacttcctagccatgcagggtccctgctcacagtacccgtgatgacttctgttcctcacctgcctgtctgtcccgacagctgcatggcagccctggcctgggagatggagaccccgaggggctgcctgcggtggtggggcccctgggtccccactgcattcccagaaacccagagggcagggcatttcccctgctctgtgccgagtccacccagccccagcctaggcccagtaagggctgcagcccaccctgtcccaggctgcctcccaggagccctcttggccctgatgccagaagcccatcttcctccattcaggcaggtctctgagtgccctggcctggctgcctgctggccctgagagtcacactaccccacagccctccttggtcaaaatccactctggagtggctggaagattccccgggcccacgccgcacacgcctatgcagggagcttcccctggccggccggcagacaagggcggtctcagagagggggctcacctcagcagccccttgtgtagctggccctcgcccctgccacctctgggaacaccaccaggaagctgggggacaggcacgcaggtgaaggaggcgagcgcttgtcagccgggaggccatgggcacagagggaacagggacaccctgggtggcctcaaggtcacttcaaacccctcactcgtcccctgggagggtgcccagtgaggttggcactaggagttggtcctggtcacatgacagacccacccacctctggtgtccagccagcacgccgtgggccagcctggctgcagggacacgagggcagcagccccctcctcctctgagctggttgctccttgagtcatcaccaccgcctgccacggaggccgcctgtcccaggaagcagagggaccgcagctgtggcaaccagggcctggtctctgtgtcacctcgctggggggccgtgcccaggcctgagacggaactgagtgacagtgcactgggtctgacagtgtggggctggcgccatgtttggggaaccctgtggcatgggacctgtgggtgagccgggaaaatcaccccgttgcatggcatctcgggcctggatcttaagcgcctgtgttggtgcctccgcctggcggaagagccgcgacccccacgttgccatgcgggtatcccaagccctgaccctggcaggcatatgtttcaggaggtccttgtcttgggagcccagggtcgggggccccgtgtctgtccacatccgagtcaatggcccatctcgtctctgaagcatctttgctgtgagctctagtccccactgtcttgctggaaaatgtggaggccccactgcccactgcccagggcagcaatgcccataccacgtggtcccagctccgagcttgtcctgaaaagggggcaaagactggaccctgagcctgccaaggggccacactcctcccagggctggggtctccatgggcagccccccacccacccagaccagttacactcccctgtgccagagcagtgcagacaggaccaggccaggatgcccaagggtcaggggctggggatgggtagcccccaaacagccctttctgggggaactggcctcaacggggaagggggtgaaggctcttagtaggaaatcagggagacccaagtcagagccaggtgctgtgcagaagctgcagcctcacgtagaaggaagaggctctgcagtggaggccagtgcccatccccgggtggcagaggccccagcagagacttctcaatgacattccagctggggtggcccttccagagcccttgctgcccgagggatgtgagcaggtggccggggaggctttgtggggccacccagccccttcctcacctctctccatctctcagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacaggtgcggcctcggaggccccggggcaggggtgagctgagccggtcctggggtgggtgtcccctcctgcacaggatcaggagctccagggtcgtagggcagggaccccccagctccagtccagggctctgtcctgcacctggggaatggtgaccggcatctctgtcctctagctctggaagcaccccagcccctctagtctgccctcacccctgaccctgaccctccaccctgaccccgtcctaacccctgacctttgtgcccttccagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgaggtaacgtcatcccagcccctcggcctgccctgccctaaccctgctggcggccctcactcccgcctccccttcctccacccttccctcaccccaccccacctccccccatctccccgccaggctaagtccctgatgaaggcccctggactaagaccccccacctaggagcacggctcagggtcggcctggtgaccccaagtgtgtttctctgcagggacaataggagccaggcgcaccggccagcccctggtgagtctcactcttttcctgcatgatccactgtgccttccttcctgggtgggcagaggtggaaggacaggctgggaccacacggcctgcaggactcacattctattatagccaggaccccacctccccagcccccaggcagcaacctcaatccctaaagccatgatctggggccccagcccacctgcggtctccgggggtgcccggcccatgtgtgtgcctgcctgcggtctccaggggtgcctggcccacgcgtgtgcccgcctgcggtctctgggggtgcccggcccacatatgtgcctgcctgcggtctccaggtgtgcccggcccatgcgtgtgcccacctgcgagggcgtggggtgggcttggtcatttcttatcttacattggagacaggagagcttgaaaagtcacattttggaatcctaaatctgcaagaatgccagggacatttcagagggggacattgagccagagaggaggggtggtgtccccagatcacacagagggcagtggtgggacagctcagggtaagcagctcatagtggggggcccaggttcggtgccggtactgcagccaggctgtggagccgcgggcctccttcctgcggtgggccgtggggctgactccctctccctttctcctcaaagaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaagga

SEQ ID NO: 100 - DNA, 23406 bp, Homo sapiens
agaacacttacaggatgtgtgtagtgtggcatgacagagaactttggtttcctttaatgtgactgtagacctggcagtgttactataagaatcactggcaatcagacacccgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaagtaagtctcggcatggatatttacaatgacataatggtgctgtacagaggacaagggagagatacaaggatggccattgtaatgttgtttgtaatagcaaaagcttggaagcaacctaaatgtccgtcgatgagggagtgggtaaataaatgtgatataatcatgatacaaacagtgagtctgacaaaacatactggtatagaatgtctcaaaattataatgttattaaagaaaaaaagttgcagaataatgcatatattaggcttctatttgtgtgtgtgcattgtcggggagcaggaatatgtggacatttcttaatgtataagctctaggaaaaggaaccagggaatggtaaagagttgggagagtaaggcatatttttcttttcttttctttcctttttttctttttcttttctttctttttctttttttcaattgagatggagtctcactctattgcccaggctggagtgcagtggtggcaccattttggctcactgcaatctccgcctcccaggttcaagtgattctcctgccttaggcaccggagtagctgggatcacaggcgtgcaccaccacacccagctaatgtttttaatttttagtagagacagggttttaccatgttggtcaggctggtctcaaactcatggcctcaagtaatctgcccatctcagcctcccaaagtgctgggattacaggcgtgacccaccgtgtgcccggccactttttcatacacctttgatagtgtttgaatgtttttactgtagttgagtcatatgaaaacaaaggggacataaaaaatcaaaagaaaatatataatgaatgttttatcatatataaaatatatatagtttttttttaatggaattaactttgtcatttgaggaaaatgaggagacaagtctcaatcattttaggagatttgtttgccaaagttaaggaggcacctgagagacaggtctatgactttctcagaagatgattttgagggctccagatttaaaggggacaaggtgggatattgagaagcactcagttttcacataaaaaaggggggggggcagaggaaaaatatggggaatctgcattttacattagataacacagacaaaatggggtagggaaacaatcagataacgcatttgtgtctggccagggtgaccgcaccggtaaagatgagctatcaatctgcattgcacagctgaccaggaatttccttgtgggcaaaatatgggggaggtatgcagcctttcatcctgtagccatcttattcaggaatcaaaaagaggaggcaggtttctgtgacccagttcccagcttgacttttccctttgactgaatgagtttggggtcccaaaatttaatttcttttcacaactttaaaccttaaaacaactccatgagtagtttcaaatacacaagatccttatttaaccaagggtttgtatttactgtgcacttgctgcttaaaaagagaagtatgttaggagagcctccctttgttgatgaacaagcaagtagcccagatgggcgggccgtttcctggctgaccatgactaattttctgattgtctgtttccatcagccctgttctcccgtgttcacagaattgggccacaattctctcctagggcagtgtttctgaaagtgaggttctgagaccagccacttcagcaacacttgagaacttgttagaaataaaagttctcaggctctaccacaggccaactgagtcaggaactctagcagttgagcccagcaatctgtgttttcgcaaggcttcccagtgattctgatggccttcacatctgagaagcattgtcacagcgaatcatcctccaaacaggactgcagcagtagcttcctctttattctgtaagacatggcttgcagttttcctgaaatggagtaacctcactcaccgcttgagtcttggctctccttctctctctatgcagggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccaggtgagtggacatttgcatgccatctttatgaataagatttatctgtggatcatattaaaggtactgattgttctcatctctgacttccctaattatagccctggaggagggccactaagacctaaagtttaacaggccccattggtgatgctcagtgatatttaacaccttctctctgttttaaaactcatgggtgtgcctgggcgtggtggctcacacctctaatcccagcactttgggaggctgaggccggtggatcatgaggtcaggaattcgagaccagcctggccaacatagtaaaaccttgtctccactaaaaatacaaaaaattagccaggcatggttacgggagcctgtaattctagctacttggggggctgaagcaggagaatcacttgaacctgggagtcggaggttgtggtaagccaagatctcgccattgtactccagcctggctgacaagggtgaaactctgtctcaaaaaaaaaaaaagaaaagaaaagaaaagccaaaactcatgggtggaatgtatagatgggatgaaaggcctagatcagtggttagagaccctgactctcattagaatcacatagagagtttttaaacaactatagatgccaggtacagtggctcatgcctataatcccaatactttgagaggctgaagcaggaggatcacttgaggtcaggagtttgagaccagcctggctgatatactgtggctacccctatctcttaaaaagcagaagaaaaaaccccactaccaaaaaccagagaaatcagcatctctggaggtagatgctaagcattagctttttacagagtctacctcaggtgattttaccccaggtgcagccagcatggtgaactgctgggttatgcatgtatgctgggaggtgaacagacttaagatttctataacatgtactttgtgcccagatagagctgagtttacatctaactctgcctcttactagctatataatcctgagcaagttattgaaacgctgtgagctcctcttctataaaatatgacaataataccgatcatgtgggccattagaaggattttatgtgataatattttattaaaagcctttataggttgggcatcccaaatctgaaaatctaaaacctaaaatgcaccaaaatctgaaatgctctaaaatccaaaactttttggacactgacatgacattcaaaggaaaagctcattggaacataagtataggcagatactaaaaaataaaaaaataaaaacatggctgggcgtggtggctcatgcctataatcccagcactttgggaggctgaggtgggtggatcacctgaggtcgggagttcgagaccagtctgaccaacatggagaaaccctgtctctactaaaaatacaaaattagccaggtgtggttgcacatgcctgtagtcccagctactcaggagtctgaggcaggagaattgcttgaacccaggaggcggaggttgcagtgagccgagattatgccattgcactccagcctgggcaacaagagcaaaactccgtttcaaaaaaaaaaaaaaaattcaaaatctaaaacatttctgatctcaagcatttcagataaggagtcttcaacctgtaattatggccatttgtgtggctgttagttccgctattaataatcagaatgtaacaatgatgactgcatcttacctttgtcaaacatttgaagtgtgtgatacactctcaacgtaggtatccaggcaggtttggaagctgagggtgtatttctctttcttaattgtctttcgcatttttttcttgctgcccctttgattccctgaaataagctttctgctctcagataattttcatccttatgttgtttctgacattagccaaggtcacccctgcaccgactcggcagagagacttcactgcagcctttccaaggatgcttaccaccaggggacatggcccaggtaactatgcatggggcagaggagggaatctttagctggctctgaattcagaggattttgaatgtgggaaaaaaagatgagaaaacagtgtgagagtggaggcatggatatctccgtgcacctgaaatagtgtttgaaaagagggaagtggtggagacacacctgtgctgggaaaaagatggtctggcttaggattattttacttaaattttaactggaaaaaagttaataaactttatagtctttaattttacttaaatattaactaaattgaatgaaatgctcattactttgtccacattttctgactgaccctggactggtgatgtttggtcatgaactggtgtcagtctgtgtttgggaactgacacattggattaggtgatttctaggatgccttctagctagaataaagcccatcaccttccctggattccagccacagaaagaatagttaaattcttcatgtaattcagcaaggacgtactcagggtgctccagaagagaacactgggcataaagcagaagtcaagtcacattgatcatgaaggttaattttaaggtatttcttgtcagtgtcctggtctcttctaaactctctggagctccattttttttttcttctgtaaaatgaggttaataggtgagtcccacctcataatgtcataaatctcataaatcacaccttatgggctttaaataagaaaatgtctaaaacgtttatcccaatgtctgaccacaatttgtacatgttagctgttgtcgttaatattataagatcaggaggcacagtgagattgtggttaaagtacttcagtgacaggtggaatgggttctaatttcagctgttcttgatagctctgtgacctcagtcaagttgctcaaattctctgaagctcagtttgctcatctctacaatgaggataattccagtgcccatgtcatgaggtggttgtaatgtataaacatgataatgtatgtaaaatgctcagcatagtacctggcccataaaaagcactcaactgtttattattactatagttactggttttagctctccaaagtttcagtctttggttagtctttagtgattggtagccaacatcttttatgcaattagagaggaaactaaatatggtggggacagaaaataataaagttataccagatacttattgtatgccattgttatattttaaagaatcttacaaccatagtgctagaagggacttcaagggtcatttagtctcactttcccatcctgtgcttcagtacttttttttttttttttaattgagacggagtcttgctctgtcacccagactagagtgcagtggcgcaatctcggctcactgcaagttccgcctcctgggttcacgccattctcctgcctcagcctcccaagtagctgggactacaggcgcccaccatcaagcccagctaatttttttcttttttgtatttttagtagagacagagtttcaccgtgttagccaggatggtctccatctcctgaccttgtgatcctcccgcctcggcctcccaaagtgctgggattacacgcgtgagccaccgcgcccggccagtactttttactacatcaccactgaatgggcatttgctgtagacggagttcactccctgtcgaggtggtgcatttccttatacttgtctctaccacagacagaagtcttctttcctttagtttttctttcctttttttttttttttgagacggagtctcactctctcacccaggctggagtgcaatgacacgatcttggctcactgcaaactctgcctcccaggttcatgccattctcctgcctcagcctcccaagtagctgggattacagacgcgcgccaccacgccccgctaatttttgtatttttattagagacggggtttcaccatggtggccatgctggtctcgaactcctaacctcaggtgatccctctgcctcggcctcccaaagcgctgggattacaggtgtaagccaccacgcccagccttccctttagtttttgtttgttagttccttccctctagggcaacaaaaatgggaatataggaataatacctcgaacctctgagcttctcaagggcctgactgagaaaaaatattgaaacaaccaaaaataggtcagtagctcctaaataggaaaataaaataaaaaattgaaatgaatgaatatttaatggtttgtctataatatgtaacattatgtaaattggctgctggcaaaccaactctaaatgtgggatgtgggagcatttaatataaaaatggggctgggcacagtggctcacatgtgtaatcccagcactatgggaggccaaggcaggcagatcactggagctcaggagttcaagaccagcctgggcaacatggcaaaaccccatctctactaagaatacaaaaaattaggctgagtgcagtggctcacacctgtaatcccagcactttgggaggccaaggcagatggatcacctgaggtcaggagtttaagccagcctggccaagatggtgaaacccctgtctctactaaaaatacaaaaattagctggtcatggtggtgcatgcctataattccagctactcaggaggctgaggcaggagaattgtctgagcctgggaggagtgaaccgagatctcaccactgtcctgaagcctggaaaacagagcgagattccatcccaaaaaaaaaaaaaaaaaaaaaaatagccgggcatggtggcatgtgcctgtagtcccagctacttggcagggctgaggcaggaagattgcttgaactcaggaggttgaggattcactgagccgagttggtgccactgtactccaaacctgggcaacagagcgagaccctttctcagaaaaaaaaaaaaaaaaaatggagtagagcctttaaaagtaagagatccaagggcctggaatttgaacacagaacaaatgcaacttgtcttctacctgaaggagtaaggactgggtcacaggtgagtcctcagctctagagtagatctgctttaaatcctagctttcccaattaatagctgtgtgatcttgggcaaagtggctctctcagactcagtatcttcatctgaaaaatggggaaaatagtagtacctacttattgtggttgaggattaaatgagattgtatgtatatggtgctaagcaccatgtctggcacctaataagtaccaaatagatggtaactactaaatttatacactgttaaggccatcacatctcacctccgctgctacctgccccaccaggcaaatcttggtttctccagaaagaacattgccactcccttcaactgtcccatccatcttggttggtggccaaatctgtgtgaaaaaaagctgtaatgacacaacagtgcttgattttactgatcattttcatagcaaaatgaagtttttaaaaagttagttttaccatttttatcaagaaaaataattataaggagtctgaaactggatttacatttaaaatcttatgtgcacttaagattcatgtttacttagcagttgtactgatgagggtcttttttttatttttttgatatggagtcttgctctgtcaccaggctggagtgcaatggtgtgatctcggctcactgcaacctccacctcctgggttcaagcgattccactgcctcagcctcctgagtagctgggactacaggcgtacaccaccacgcccggctaattttttgtattttagtagagatggggtttcaccatattggccaggatggtctcgatctcctgacctcgtgatctgcctgccctcggcctcccaaagtgctgggattacaggtgtgagccactgcaccaggcctgtggtttttatattttaaatttttttctggtaattagggcaaaagtaattggaacataatctttttttcttcaataattttaggctgaggctatgcctttataatatttaaactatagtttgctaaaccagcatttagtcaaaccctttatacacattaaggcttccagaaggtgacagtgacatttaagaagtttcaacatctctgactcagccataaaaatgagtaagcatgcttagttttccaaaagctggcaatgtacttatttttagaattcagtgttcatgaggtcagggcctgtgcccctcttgtttcctgctctgtcccctgtgcctagagtaagggcatagtgcatattcatggaatggatcagcagatgaagaaataaacaaatgaacaggaaggaaagatggtgagtgggtggctgggcaacgtgaccctcttcataatgacagcactgaggtaagggctggtgaaggcagtataattaagaatgtgcatttaaggctatgcagacctaaattggaaggccattttgtcatttgctaagtcatgtgaccttgggttagtcacttcacttccctaattttcagtttcttcatctgtgcaatgggactaacagtctctactttagaagcgtagttctaaagtaagtgcttctaagtatctctaaaatgagcttcttcactgaaagagtttatttagcacaaggcctggctcctattacattgtgaccacagtgattattttcatttgttggcaaccctgtctcccttctcatgagtaaatgcaaaacttatttaagaaaatggaggctgggcacggcacggtggctcacgcctgtaatcccagcactttgggaggccgaggcgggtggatcacttgaggtcaggagttcgagactagcctggccaacatggcgaaaccccgtctctactaaaaatacaaaaattagctgtgtgtggtggtgtgcccctgtagtcccagctaccagggaggctgaggcaggagaatcgcttgaactcaggagatggaggttgcagtgagcagagatcatgctactgcactccagcctgggtgatagagtgagattctgtctcgcaaaaagaaaaaaaagaaaaagaacatggaggttgcagtgagttgagattgtgccactgcactccagcctgggcaacagagtgagactgtctcaaaaaaacaaaaaagaaggaaatgaatttttgttgtcttttaaaatctaattagaatataatgcctgaggccaagcctggtcgttcacacctgtaatcccagcattttgggaggctgaggtgggcagatcacctgaggtcaggagttcacaaccagcctggtcaacatggcctcgtctctactaaaaatacaaaaattagctgggcgtggtggtgcatgcatgtagtcccagctacttgggaggatgagggatgagaattgcttgaaccagggaggccgaggttgcggtgagctgagattatgccactgcactccagcctgggtgacagagtgaaattctgtgtctaaataaataaataaataaataatgcctgagtcttatcaatattgctagatgtttgtagaactcattagggtcctgtgaaaaaaacaaagcacatatttaatgtaggacttcctggcagaagtctctatttcataaaacagtacggttcattatctagatgaaaaaatgtggccatcctaaagttgattcctgggtgttcagtaaattttgtctgtctctccattaattattgtgacaagtacggagtagaattcatttcaaataggattataggcatcattaagattttttaaaaacttagataaaagaaaacgttcttaactatactattggctatttttcctctctctctctctctctctctttttatagcagagacacagacactggggagcctccctgatataaatctaacagtaagtaactttttttgtgagctatgttgtactcaacttggaggggaaatcatggctttagacttccttcatgcccaccttgtccttggggtaaaaagccttaagttcccttagcttcagattcctgggctgtaacatgttgatgatgacagttctaacctcataggcctgctgtaatgaaggactgacatgatgtgtgtaaagtgcctggcatatagtaagagcttgaaaaccacaaagaagaaacattagcattttgtccctcttattcttcaatttcacaactgtctaccctgtggaaggttcaaagattcttcatctccctagaataccattcttcttgcttccattgcaatcctaatgggaaagagtatttaaatttatctctttaaatatggcaagacaccagtcaggaatattcaaagtgaagaggttttttttttttttttttagacagaatttcgctcttgttgcccaggctggagtgcaagggtgtgatcctggctcacctcaacctccgcctcccgggttcaagcgattctcctgcctcagccttccgagtagctgggattacaggcatgagccaccacacccggctaatttttttatttttagtagagacggagtttcaccacattggccaggctgatcttgaactcctgacctcaggtgatccacctgcctcggcctcccaaagtgctgagattgcaggcgtgagccatggcacctggcctaattttgtatttttagtagagacagggtttctccatgttggtcaggctggtcttgaactcctgacctcaggtgatccgcccaacttggcctcccaaagtgctgggattacaggcatgagccatggtgcccagccagttttatgtatttaactataaataaagccataccttaataaacctcaattttactgtccctgctaccttctcagaataaaagaaaaactggctgggcgcagtgactcacgtctgtaatcccagcactttgggaggctaagtagggtggatcacctgtcaggggtttgagaccagcctggtcaacatggtgaaaccccatctctactaaaaatacaaaaaattagccaggtatggtggtgtgtgcctgtgtagtctcagctactcaggaggctgagacaggagaatcgcttgaatccaggaggtggaggttgcagtgagctgaggtcgcgccactgcacaccagcctgggcaacaagagcgaaattccctcataaaagaaaaaccactagaaggcaagcttgcagcaatgacttaaaaattctttgaggaggccgggcacagtgtctcatgcctgtaatcccagcactttaggaggccaaggtggaaggaatgcttgagaccaggagtttgagactagcctgggccacatagtgacaccctgtctctacaaaaaatattttttaaaatttggccaggcatggtgctgcaaacctgtagttccagctacttgggaggctgaggcaggaggatcacttgagcccagtaggttgaggctgcattgagctgtgatcatgcccctgcactccatcctaggtgacagggcaaggccttgtctcaaaaaaaaaaaaaaaaaaaaaattacttgagggcatatccaggagcccacatttatttgactcagtttcttgcttgtgtattcacaactgatgctcagcatcttgtatttgctccttctctctttgcaatcaaacagtgctttttaaggacctgtatgtgcccacaatgcttaatgcacaatatcttgcatataggactcctgttattgcaggagtaatgtgtattgaatcaatttgtaaatgtatattgaataaatggaagatttaacttccttaaattcattgttttaaaaatgcttataattatatgtgtgtgtgtgtgtgtgtgtgtgtgtgtgtgtgtgttttgtataaatggggtctcaatattattaggctggtccctaactcctggtctcaagtgatcctcccatctcagcttcccaaagtgctgggattataggtgtgagcctggcctataattattatttatttattaatttattatttatttttgagatggagttttgctcttgtcgcccaggctggagtacaatggcacaaccttggctcactgcaacctctgcctcctgggttcaagcgattgtcctgcctcagcctcccaaatagctgggactataggtgcccgccaccacacctggctaatttttgtatttttagtagagatggggtttcaccatgttggccaggctggtcttgaactcctgacctcgtgatctgcctgccttggcctcccaaagtgctgggactacaggcgtgagccaccgcacctggcctaatcattgtttttaaagagagaaaaagagagaacccatagactgaaattttagaaacaggatttattttgtgtggctctcagttatcagaaaatcaagttaactagagcaatagcaataatagctacgattgattgaacatttattatgtaccaggccctgtactaagcattttatattttctctcacttagttttcctgataactctacaggattactcagcccttagtggcagagctgggaattttttttttttttttttttttgagatggagtctcgctctgttgcccaggttggcgtgcagtggcatgatctcaactcgagtactccagtctttgcctcctgggtttaagtgattctcctgcctcagcctccccactagctaggattacaggcatgtgttaccacgcctggctaagttttgtatttttagtagagacggggtttcaccatgttgtccaggctggtctcaaactcctgatgtcaggtgatccgcctgcctaggcctcccaaagtgctgggattacaggcattagccaccgcgcccggcctcagagctgggatttgaatccacgaccgtctggctgtaaagtcttggctattgaatcactgtctttttgtgaaaaatagacgtttcatagcaagacactaaatgtaaactactctaaaactctctggggaatcttaggggatcttgaaccaacaagactccactctaaagccaatttttgcaggggcagggaaagggtcttaagagctccttctctctttttttttttttttttttaagagctccttctctacccacaacacagaagggcacattttgtttccttgctaactccaaaggttaagggagaccctttcttgggttggcttgagtgttggctacaaggtgacagatcaaaggtgatttgaaggactcagccatcctgtgatgttgtaaaagggatggtccaattcacaaatcttgaagctgattacacaagcgatttctagctgttttctgcttaaatcctgtttgtgtttccatagcaaatatccacattggccaatgagttacgggactctagattggccaatgacttacgggactctggagcaaccatcagaataggcatctacatcggagcagggatctgtgctgggctggctctggctcttatcttcggcgctttaattttcaaatgtaagtgtttttgtttctctctccctctgataacaaattcttcagtgagaaccagtaaaaacctagatagaaatgcaaattcatgtttatacccaaagatgattagactaaatacccttttgtccatccaaatcctaacaataatggctaatttttatttaatatttattgtgtgtcaggcagccactgcgttaaatgttttacatacattttatcatcattactgtcttatgagataaggaatagtaccatccccattttacagtgaagggaagtcaagcttagagtaagctgccttcccgaggtttcaacatcagtacctggcagaaccggaaatcaaatccaggcaggctgattccagtaaactaatttctttaattcatgaatatgtctaggtttgttacgaaacacaacaacaaaaaacacttccttctgtgcacttttctgttattggtttctcaggcatacctctctggcagtagactgcaagtccctttaacactgggtcgtgactggggttagagaatgttttcctccatcatggtacttagcacatagctttttctaagttacttatcccttttttttttttaaactagcaaacaaacaaaaacaaaaaaacaggcccggcgcagtggctcacgcctgtaatcccagcactttgggaggctgaggggggtggatcatttgaggtcaggagttcgagaccagcttggccaacatggtgagaccccatctctactaaaaatacaaaattagccgggtgtggtggcgcatgcctgtaatcccagctactcaggaggctgaggcagaggaatcactcaaacctggtaggtggaggttacagtgagctcagatcatgccactgcactccagcctgggtgacagagtgagactgtcttaaaaaaaaaagtaataaaatataaataaataagcaaataaataaataaataaatacaatggccaggtgcagtggctcatgcctgtattttcaacactttcggaagctgaggtgagaggatcagttgagcccaggagtttgagaccaagatcagcctgggcagcaaagcaggatcctgcctctacaacgtaataataataataatgagctgggcatggtggcacacacctgtagtcccatctactcaggaggctgaggtgggaggatcacttgagctcaggaggctgcagtgagcggtgattgcatcattgcactccaccctgggcaacagaataagacagtctccaaaaaaaaaaaaaaaaagaagtgtgttgaagttgatgaattttgatggagaattacagtaggaagccatcatcacaatcaagatctaaatacttccagtacccccaaaacctcgcacacttttgtttttttggagatggacgctggagtgcagtggcacgatctcagctcactgtaacctctgcctcccgggttcaagtgtttctcctgactcagcttccagagtagctgggactacaggcatgtaccaccacgcctggctaatttttatatttttagtagagacagggtttcaccatgttgggcaagatgttcttgatctcctgaccttgtgatccgtccacctcgacctcccaatgttttgggattacaggcgtgagccactgtgcctggccactcacacacttttataattgtgtctattttattttcttttagggcagaaaccaagtccttatgccccagagcgtaatatgacatagcagcctttcttactaatacacaaacagggactgtgtgtgtagagtgagcaatcacctcagattagctcaagactaaagggtgttcctaagatatatgggacttctagggctaaaactggaacagtccaagaaaaacatgagttggtccccccactaactgtggactgaagctgccaagtgctttacgtgcattaaattctcgtaactaccctatgagataggtactaatatgtttctaatggagaatcagcatgctaaaaggttaggtcacttgcctgcatttacacagttaattgatagatactggatttgaaaccaggactgtcctgctcctcatctttatggtttctgcgattatggttaaatggattattcagaaaaagaaactaccccacccacacttacctgggtttattcagagatagccatggaatttttgaattgatcacatgaatatatatatatgtatatatatgtatacacatatatatatatatttattattattgggacagagtcttactctgtcacctgggagctggactacagtggtgtgatcttggctcacttcaacctctgcctcctgggttcaagcaattcttgtgcctcagcctcccaagtagctgagattacaggcatatgccaccacacctggctagttttttttttttttttttttttttttttttttttttttttggtagagacagggttttgccatgttgcccagaaaattggtctcaatctcctgagctcaggtgatcctcctacttcagcctcccaaagtgctgggattacaggcgtgatgaatatatacatatttaaaaatagaggctgagcacggtggcttacgcctgtaatcctagcactttgggaggccgaggtgagtggataacctgaggctgggagtttgagaccagcctgaccaacgtggagaaacctcatctctactaaaaatacaaaattagccgggcatgggggcacatgcctataattccagctactcgggaagctgaggtgggagaatcacttgagcccaggaggcggaggttgcagtgagctgagatcgtgccattgcactccagcctgggcaacaagagtgaaactccatctcaaaaaataaataaaataaaataaaataaaaatagaaatgagatcttgctatgttgctcaagctggtctcaaactcctgggcttaaataatcctcccacctcagcctcccaaaatgttgggattataggcatgagtcattgcacttagcctcacttgagtatttccaaaacagactagggattgttaaggagcactgataacactcactacttttttgacttctgccatggctcaaagtaaaactttgagctttactattatatatattagagaccactttatatatatatgtgtgtgtgtatatatatatatatatatatatataatatgaccataatttatacatattagcacttattctagtttgtataaagagtgatgggatctagaggaaatctgatgctttgtacacacacatatatgccactccaaaaaaacatggctactgagaagtacagataagaaaggcctgtttcatttccaatcttttccctggaagttgctggagaaaatattaaaatcaaggtgacagctttttaagtcatgacctcacaaaaacaaactgacactcaataatgccccacaatcttccatctttctagtgtactctctgagatgaccatccatacctcactgctgctcaaaacttctttgcccctctcctaactgatgaaatatgaaagggctttttaatctccattgcctaggccaagacttcatccttctttttatccctttcttctgagtcatctctctccttttctgtttatgctattttcattagcagaatatatgttctagtccatgcattcctctccagctagtcccatttctcaactcgttctcacagccatatttttcaaaggagttgtctctacttttcacccatctacactccttgacccaccatcatctagtttctgctccaaagcacaacggaaatggtcaagctcaccactgaccttcagttttctaaattaaatattaacagatacctttatctttttttttttttttgagacagagtttcactcttgttgcttaggctggagtgcaatggtgcaatcttggctcactgcaacctctgcctccccgggttcaagtgattctcccccctcagcctcctgagtagctgggatttcatgcatgtgccgccatgcctggctaattttgtatttttagtagagacgggggtttcaccatgttggccaggctggtctcaaactcttgacctcagatgatctgcccgccttggcctcccaaagtgctgggattataggcgtgagccaccgttcccagcctgatacctttatctttattatagtcaaccttttaaattgatcactcattctagaaagtcctccttctcttggcttctgaaatgacattcttctctttgatccattgcttttcagatcttcttctgcctgatccttagatgttgagattccttagggctgggtatggtggtgcacgcctatcgtcccagctactcaggagaatgaagcaggaagatcacttgagcccaggagtttgaggctatgaactatgatcttgctgctgcattctagcctgggtgacacagcacagggagaccctgtctcagagaaaaacaacaacagaagattcctgcagtcttcctccaacatacatctaaagtgttttcattattctgcatctcttttggccattccttactccaagacaccattatttctacttaatttatcttctcatttctttattcctccttcgaatccaatattaaaacccaaatcaatgtctgagcacaatggctcatgcctataatcctaacacttcgggaggccaagacaggagagtcacttgaggccaggagtttgagactagcctgggcaacatattgagattcacccaggctggagtgcagtggtgtgatcatggctcactgcaacctctacctcccgagttcaagcaactctcctgcctcagcctccaagtagctaggaccacgggcatgtgccagcatacctggctagtttttgtatttttagtagagatgaggttttaccatgttgcccaggctggtctcgaactcccaagctcaagaaatccacctgccttgcctcccaaagtgctaggattacaggcgtgagccactgcatccagcccaaaaacattaaaaaaaattatccagctgtggtagtgtgcacctatagttctagctactcagaagctgagatgggtagatcccttgagcccaggagttcaaagttgcaatcagatatgatcttactactgcattccagcctggccaacagagcaagaccctgtctcaaaaaaaaaaaaaaaaaaaaaaaaagaaaagaaaagaaaggaaaattttaagtttcaaatttttgaaactgcatccccagaagacaccttgaaagaccttgatccagaggtacccagtaagccacacctggattcctgacccacaacacagaaatgatgagataacgtagttgttttcagcgggtaaaagaaacccaaaacaaataaggatcacatctctgcccttcaaggaaatctaaggtttcctacaggtcttagaataaaatccagactcctgattatggctggaaaggtcttattggacctagccccagcctacctttcagaccttatcttgggccgctcccttaatccagccacgttttcagtttcaggtactcagcaagatctttacaaggggctccctcatcctggaatgctccttctggctctttacttggctgactcatttcagaaacgagcttaaagttcatctctgagggtccttccctgaccaccctctctattatctgtttcactatgatgttggtttcctttataatacatcataatttgaaattattttgttttcctatttactatttcctttttgttgttgtttttttttttttgagacggagtttcgctctcgttgcccaggctggagtgcaatggcgcaatcttggctcaccgcaacctccgtctcccgggttcatgtgattctcctgcctcagcctcccgagtagctgggattacaggcatgggccaccacatccagctaattttgtatttttagtagagacggggtttctccatgttggtcaggctggtcttgggtctggggtactgttttcttttatttctttggtctcccacaggagagcgtgagcttcgtgaaattagggctcacaattcacttttatgttcctgtgttccttgtgccaggcaaactgccagacacatagtagaggtctcataatatttgttaaataagaaaaatgcatctttattattattttctaacacagtccatataactatctaaggcacacgttgagagtttcatttaactcaatctgagatgagaccagatttccctaaactatgcgtgcttccagtgaacctatttgatttcttgtctcatttattttatgaatgcatttttattggcttttgtttcccccttactagggtattctcatagcaaagagaagatacagaatttaaggtaagaataatggaatggggttgggaaaaggtgagaatcttggaagtccctactctaacatgtctgatcttttctctgagaaatcctgtcctggggctttgagatctgagtttatacttccttctttctctaggtctagttatgaagtgaaaatgtaacatgctactgtgtgtacttcctgacacctctagcttctttagttctaaagttaaggtatagaatttatcaccctaataatacaacatgcttattcatctcgatattaatggtttttccactgaactgaaacatcaacggattgagctcctattatatccagggtctgggctgcacttaggcgttacagaagtgagcaagaaacccagtatctgttctcagcatttctgtaaacagcccaggcattttcaactttagtttcctattagaatcacccaggcactgaagtgtactaatgcagggccaaccccagagcaactgaatcagaatctctggggatgaagcctaagcatagaaattgttctaaaagctctccaggtgattctagtgaacagtcagggctgagaactgctagtctgttatagactcctgtcttgaccttcgttcctgattatacacacccacacatccatttcaaataggtatggcttacataacttactagattttagacttttagtgatgtttggcacatgaatggaatacaatatatttggattacaaaaatgattctgggctaggtgctgtggcttacgcctataagcccagcactttgggaggctgaggtgggaggatcacatgagcccaggagttcaagaccagcctgggcaacatgatgagacctcttctctacaaaaaaatggaaacattaggtggaaggattgctggagcacaggagatgaaggctgcaatgagccatgattgtgccactgcattcccacctgggtgacagagaaagacccagcatcaaacaaaacaaaacaaaaacctctgtccattgaatgctatctaaagcattaataattttttttttttttttttgagacggagtctggctctgtcacccaggctggagtgcagtggcacaacctcggctcactataacctctgcttctcgggttcaagcgattctctgcattagcctcccaagtagctgggattacaggtgcatgccaccacgctggctaattttttgtatgtttagtagagacggggtttcactatgttggccaggctggtctcgaactcctgacctcgtgatctgccaggctcagcctcccaaagtgctgggattacaggcgtgagccacggcgcccggcccattttttgaaaatctaaatgtgtacataattgcagacatcttgatacttcacctaaacttcagcctgcacctccgagaaataaaaatattctcttagctatcacaatgctgttgttatacctaagaaaattaaaattaatggacattttctcaattgtttccccatagtattttattgctatttcttggcttttccacttgttcagcatctgatcaaagatcatgcactatatttagttgctgtctctttgggaaagcctattctcttaactctattccgtgttacctgggaaatgcttaactcaaccgcaacactttatttccacagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgtt

SEQ ID NO: 101 - DNA, 26025 bp, Homo sapiens
gggggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtaaggtcgggggaggcggggcgctgggaaaaagctgggagaagacagcagactggagtgggaactgtgggatgggggcgtcctgggggccctctcagcctgtgtgaccgtgcaccccactccacccaccgcccagaggctgctgggacccctaggcagggtgcagtggcaactgtgccaagtgccccagctaggcatcgggcacatctgcatgctctgacagctgcccaagtggcaggcagggctgtcccctgagggctgcctgtccagcccttccctgcccagagaacccagggcacaggtagcttctgcaaagaaggagaggcacagggtgggggcggtcagtgtgttctggtggatatcactggcttttgacagctggcatctttctgcccctctagtctcagggctctagtgttgcagaggacacagagggcgtggtatgctcagccagtgccccatgccctggtgaaacccctggctgagccttggtgggcactgggcactggtcacggtgggtccactttcagacacagaggcagcactgcccacctggtccctattctaagggtctgatggcccaggaataagtggtcagctgattcctgccatcctagcaaggctgccactcagggaccagtgtggagtactggggaggatgtgggacactcttcagctcagctatgagccccttctgggtccctggataaattacggcatctctctggcctcagtttcctcagctcaaacacagaagcccacacagggaagcaccattttccccttccaaagtccagactgtcagcatgttcagatagtatcctggccccaacacaggggctcccgggctgggggcagaggccctggtacccatggcctggttgcctagttcttgcctgcccagagctgaagaggctggatctcttcaaagagcctgtggaaccaaactttatagggagggcccagggaaagtatgagtcatgcagggactcggagggaggcaggagggaggtggagggcttggcacagggacccagtgggcaggatggaatagaaggagagggtgataggataagagggagaggaggaggctgaacctggaagataccttagcaacctgggtgcccacaggcagctggctatctcagcacttggaggctggcctgggcctctgaggaggaggagggctccacatgtcacagacacagctgccctaagccccagggtggatgcttctcaaggtgacagtcagagggaggaggagaatgggaggtggaatggacagtctcagcaccaaggccatggctcatggcagggcatggcttccagaaggaacagaggatggtggcaggcaggcaagccagcatcccacctgtcatgggccacctgccctgcactgccctccctggtggccctgtgagacccttcctgctttcttgcccacttcctgccctcacttggctgggctgccctctgttcagcagccccaatttgagaaacatttctagagatccagggcacagggacccagcttgcagagcacccagtagcagagaggccccaagaggagctcaggacgccttcccctatattgcttatatggccaggggcctttactcccagaggtcttggctactcaaacaacatggtatactaaagggtcatctcttcctgggcccagcacagggagatgatttaggctggctgcagctttccactgaaaggagccagaagcatttgaattgctctgggacctcaggattctgaactgtgacatggacacactataatagatattcacccaactccctaggacagtgtgcactgagggagatagcagatgggaggcctggttgcaggcatggtcagcaggatctgtaagttgagaagattgatcaccagcctgccgaggtgctgggttgccctgggtatgttgcccaaggtcaaagcctttatgccagggaaagtgagatagagtggccggggccagcctgttctccagctcttggggttgggccagcactgaggagaatggtagtgatgaatgtggtgttcagaagcccaggaaacaccaaagatacccctttcctgggcctgactcagggtgagatgggtggagaggtacacttagggaccaggacccagcagatctcaagggtagcagagcctcttcttccccacagacattcccaggacccgaggcagttactgtccttgccctgtcctcacaggctgactcaggactcccaacctctgggactagcacatttaagtgcactggggctagggacgagagaccccatcttctccttcatagcaaaccaggctgcagggccttgttgagtaacccagtgctgcaagcctctgacgcagcaatggtcagctcttaggaaatccacaacccactgcccagaggctctggagtagagaggaacagccttgaggccagtccctggcatgaggggtcatctacccaatgccagggacacccaagggccagcaatactgggagtcccttgctgagctgtactagttgttcatgcttccacccaagcagggcaaaggttccgctggggtctgaccttcctgggagagggtggtccaggcaggagtgtgctgctgagacgctaaaggggtcacctccctatccgcacacagtgtatggggtgttaggcctgagcagatgaaaggaagaaagggatcctcaaggagaacccgttggcagtgagcgagccccacataccaaacttgaggccccaggctttagccaaccaatgacccagggtcagtctggtctcccaggggagggtgggccagggatcagcactgtggcttccagtggccccacagatgcccttagctgcagtcccagcatgcctgtatatggcaaagccagggacatgcatgccagggcttccgtacagccccttgcttaactcttgggctttgtgagtcactcagacctaggcttaaatcccaagatggccatttactgctctgtgatattggacaagttattcagtctccctgagcaagttcccctccctctaaagtgggaagatgataccacctcccttggagggcaactgtgaagagccaatgaacgaacacttaacacagcacccggctcctcgtgaatactgtgtaatattatggtatttcttggcttctgcaggccacatgccattggctttctatctaagctgcttgctctctacagggcctaatggagtgcccagggcctgggaaggcattggtgagcttcactgggactagattctccaaagcctggagtatgaagggtgcatgggctgcgtccagctacctgtgagcccctgtaggccctcacagtctgaaatgcccatggaggtgcctacaggttctcttcttaaagttgtcaggagatggggacattgcaacttgaaggcaagcctggccctgggtttgcttatcttggtggatctttcttacatctgatctttttacattcggtccattcactttggctggccatcaccaaagacaaagacagtggccaccatctttctcatcagtaatccaataatgaggttgctctgctacttaccaagccaagcaagcccattcctttagcctttctgcgtaggatcttatttcccatggggacctggggtcaaaccctgcctctgctgttcactcatcatgggaacacaaacacacacttcccctttgtctgtgcaatggacaggttgggtgacgtggtctcagtgaggctgaccaccctcctctgaaggttaattccatgatggtgtttccctagcttcagtcatttgcttatcacctttgtgatctctgcagtgtctgcctttcataatatttacttatttttttctttaaatctactcattcttttatttgagtatgtagatctttaaaaggaaactttttatcgctgtcattagtggaaagccagtatcacttgtcataaatagaacaaaaccataaaagaacgtaacaggaaaaccatataagggtattgaattctagttggaaactttagcctgggaaggctcggagtctgaaaactgctgctttcccttgcaaaaaattaaaataaaataaaatttaaaaagaaaaggagattagcaaatgttttagagacatattagcatcaaactgagactttctctttgatgtaatcaggactgaaataattgtaaagggaataacctcttctatatatgattcaatgttatttaatgtaaaaccaaaagtaaaactatgtggtagacgtggccaggcaagctgggctttcattggtcatgacatttgtccgtcttcaagaaggaggtggggcctccagtcagtccccagctacctctattctctagagagtagtcagatggcaccagacctccagaggctgactacctgggttcagatcctgacaccatcacttattagttgtgaggctgtgggcaagatactaatctctctgtgcttccgttttctcatctgtaaaatggagatgatactagtacctacctcatagggtggaaggattacataaactaatctatgtaaaagtgtttagaatgaggccgagcacagtggctcatgcctgtaatcccagcactttgggaggctgaggtgggaggatctcttgaagccaggagtttcaagccaggggaccagcctggacaacataacgagaccccatcactatgaaaaatttaaaaattagctgggcatagtggcatgtgtctgtagtcctagttgggaggcaggggtgggaggataacttgagcccatgagttcgaggttacagtgggctatgatctcattgtcactgcattccagcctgagtgaagagcaagaccctagctcactaaagaaaaccaaccaaacggccaggcacagtggctcactcctgtaatcccagcacttggggaggacgaggcgggtggatcacatgaggtcaggagttcaagaccagcctggccaacgtggtgaaaccccgtctctactaaaaatacaaaaattagccaggcgtggtggcgggtgcctgtagtcccagctactcgggaggctgaggcaggagagttgcttcaacctgggaggcggaggttgcagtgagctgagattgcaccactgaactccagcctgggcaacagagcgagactccatctcaaacaacaacaacaacaacaacagcaacaaagccaaccaaacaaacaagcacttagaatgatgcctggcacagagtagtagggggcaaaaagacttgagctggaccctgaggacgtcttcacagcatagaagcgtgagggtggctggctggagccgggagcctgagctgcacacagtcctcctccaaaagggcctggggagtctgggaggggttcatccacagaagcatccacgggccgggacctctggccagctgcctaggccctccctggggaggcatgctagcctccagctccagccccggatgcacggaggctttcccaaggtgctggaagtgccgcttccttcaatagagcctggcttccccttcccagcccccttggtctgatgtgaatggacacttcctgcgggggcaggtatcaataaacacatctgagatgccctttgtcctcactggccagaaagccccagggcagacttgctggcttcaggccctgagcctatgccttgtgacgcttcctttcttagccttggcagccccagtcctgattgatccatgcctctgtttccctctgcatcttgataaagacagaacatagtcttttcctacagccccagccccagcctgtggaccatcctgggggatggggcctggcggggagctggaaccaggtcccattctctttgggatgtcctgtgagaccaaggacgggaccttttgcatctagtgcagggccagccacagcaggcaattaataactgtttacttgacaacctctagcagctggtcagagttcagctgtttgggtggggcttcctaggcccgactaaccaagcttgggtcccacctccaaaggctagggcgttgccttggcgactgtgggctaagctcacgccctgtcatgaaaaatacacaggcctgtccacacccacacacacccatcccgtgcacactcacaggggtcacccggggcctgctgggtggagagaggtgaaggtcacaaaaactggcattctgagaagatgccaacaagagctcctttcccttgtactgggacagaaacatctgagggtgccacagctagaaatctcaggcacaggtccaggcccaagttctgagcagatgcccctgatggaactctgcatccccacagcctccctgcctgggcctggcccatgttaggaccttggtaaatatttgtggaatgaaagaatgatgttttcagcttgggtctgaggcagagcaggaatgttgcacggagggcgtggaggtcaatgcacggtcagttcattttttctaaatagctgaaggatgaggcatcagccccgcctgcccactggagggttctggagaggtgggtggctcttcctgtctgcagtgctggcctgtccaaggtgtgaatctcagctcagtcacacagcactgtgtggccttgggcaagtcacttctctgagtctgtttcctcatctttaaaatagggatgataccacccatgttgggggtgttatgagaactaaatgtgacaggtataagatgctcagcaagagcctagcacataatacatggtcataagacagctcttccctcctgcccacaggattttagagctggcagccctcaggttaagatgaagaaacggaggctcagagaagggtgggatctgcccaagggcacacaatgagggcacaactaagtggacactgaggccccaggacgttgcaatccaagcgagagttttactcctgagactcaggctttcccaggttcacggcactcttcctctaggtggccctgcctccttacctggtggcaggtggcgggtggcgggcggggggcctgggtcttgacagcagcacggcaactggacggttcccgcctggcacatgctcaggcccaggccccgggtcattttcctgtcccacatgcttttggccaccctggagccaggggctttcctccccacccacttttcccggtctccgacaatgacccaggtgtccaaaaggatctgctcctgacaataagcaacatcctctcgccaaagaattgtaattttagccgggctgcacagcttccctgacaacacacaggcatgtgcacagatgtggagtccgcggggcacgtgcaggcccctctgcgtgctgtgcgctgcccctctcccccatgccatgccttcgagtgtcctcctaacgacaggctgctgtgggccttgtcccagctggagtctcagacacagtaaatggggtgttttctggccttccctccctccccaggacaaacccctgtggacccttggtttgtcctgtccctctggcttgtcctggaccctctcctgtctggccctcttgcttgaaaactgaacatcctcccctgctccccaaacttgaatcctaagacagcttttttctaaaaggggaacaactcctttgggacctgtgggatgggtggccagtgtgtgaggggtggggaggtgtgggggattgagcaatgccccctctcccgtactccctgaactctgctttctctctgatgcacccacccgccgtgcatctcaaggaagttgcctccaggggagaacatcccttccctactgctgcgggtgctatgggtacaatcctggggtcattaaccccattgcttagaccctgagggctcccagcctggtgccctgccccaccttgttcacagggacactcaggccaacaaccacgctagccccacttgtccacacctctgtccacttgagggcccccaaccccacccagctcagctttgcgcatcttgctttggctgccagctctactctgcctgccctgccataccctcctctggcctgcagccccgtgtctgctgagccagccctttggccagcccccaaggtatgtgtgctggtggtaaatactaccgtagctgaagctggagctgaattcagctcccagccctggggtggctctggggtaggaggtgatgtcaggcaaagggagaaaggggcagaagctgggagaggtgctggtgggacctgccacatggcctgctggggaagggggcagcacagggcccccttggggcaggttttgtttcttcctgggagtacgtgggagagccctttccctaggtcctcctcacttctgtttcccggcagagccatagttttgcagctacacccaccccactcaggtgtgaaggggaagtccaggccagcacggacaaaaccaggggcacagccaagcttcctggggctccttttccactgagcctgctgcaggggtaagggcagtgggttagcagaggagagttggctagtccctgcactgccaggctttccctggggaccctgggtggatcatctcctctcttgagtctgtgggtcagatttgtagcataatgggtttgggcagtagagtcccatgccagctagcccaagaagccacactcattcatcacaaactcaaatgtccacaggaccaagaaaccacggtgagagagtgaagcaggccaggtggaattattagggagtagtacggacggactctggcgaactggagtgccggtgccccccaaaagctgctactgagccccagctgacagttgccctgtgggaaagctggtttagcattatcttctgattttctaaggagagctggaagtcagaattttcatgtcaaattcctggtttttaaatgttgccatctcaagaaaattaaaaagattttgaggatccaatgaaatatgtgtgaaggctggatgtggcctgtgggctcccagtttctggccttttttttcatcagtatagtgtctatgtgtctgagtttaattctagctctagcacttgcttgctgtgtgatcatcagtgagttacgtaagttctctgtgccttagtttcttcatcagtgcaatgggaataaaaacaataccttatggcattgttagatatgcccatgaaacccttagcgtagtgcacaacacatgctgtgtcttcttattacggttctgcctagatcctgcgttacctgaagtcccccatgctccaggctttgagatcataccctctggaactttggaacttcagtccaaccactttccctttctgggtctctgtgtttctgcctgaaaaggagacctgtatcttgccaaagaagttctgaaatctctgctcaccctgacaatgactccaaaaatctggggctcccagacttggctctctgcctaaaactccactcttgcagacatgccgtttggggctttggtgcctttggagactctcctttaaacacaagcgccccaggatcggatcacaagttgttatcagtcattcacaccttagcaggaaagactttaaagctggcttctccatcccactgtgcttctcactcctaggaggcacttcttgacttgctgaatgaattagagacctgtctagctcccaagtaccaagcgccgactactcgcatggcacttacagaacacttcatgtgaattattactaaccgttgcctcaactctgccagggagatgttttcatttctgggaaaaacatctgtgagtgaggagtcggggctcagcgtctaagtggctcacagctactggtccagtacaggctggccagctccagaagccccaccaggctgcctccctcctggctgggcaaggctttcagctcttccagtgggtcccagcctgccgccgagggtcctgggctctaagggcagggaaggggcatctgaaggaggatgtggcattatattggttctgggcaatgcccctggctggggcaatgaaaaggatgtatcagtttggattctgtacatagttctaaccctccttccctctctgctagacccacaacagcctgacatgccatttaaaataaaaataccactggccgggcgtagtgggtcacacttgtaatcccaagactttgagaggccaaggcaggagaattgcttgaagccaggagttcaaggtcagcctgggcaacagagggagactccgtctcaaaaacaaataaataaataaaaataacaccaacgcataataattatagctatccctcagatgtctgcagagggcattagagctcacatcttgtgttctcatctttccctcatctagtccttttgcaaccctgcattgtagccaatagttttctcactgcacagaggaggaaactgaggctcatacagttagatagaaacgcggcctctatccaatattctgttttcaaaagctcatggttttgagggtcaacccaattaaatgctggaggattgggataaggcaaagtggaccagggaattgcttcatttgcttggtgaaaaaaaccaaacagaactagacagttttctaagtttggctggaaggacgtgcatggatgagatgacctttcatatactctctgtcccggtccctcagacactgggttttcccattttcacactatcttgcctaggacaccctttctactggctgaaatcctatctatgcaccaagtccaaagactctccctccttcaggaagtccctgactgtccccagaaggctgtttcctccctcctccaagtgccctgagggctggcattggattgcctttgccatggggttctgctgtcgggaatgcaggcctcgtctgctcaaggggaggccatgcattcagcatgcaggtgagatgcagcacctggcccaggccttgcacacgcaggtgctctcttagtgctccctggcaaggatgggaaggcatgttcagtcctaggagtaggaaggggcagaggtgttgatggcccctacagagcggccaaggacaaggagctgctgttcgaaacagccttcctgctccccaacctgcctcccacccaacaggttttgcatatactctactgggaagagggacacacccgactgcatcactgccctccaagtctctccctgccctgtccagcatccaggagcacccctagttggggaagcttctgtgactccccctacaacagcctaggatggagtggggtttgtgaacaaatgcagaaggcagtcttagggaggtcagctgacatgcccctggcctgtggctgggaagtagcagaggctaaggttcttccccgctctggggttgccaggagtagcactggatcagtcaggtgacagggctctcctctctctgagcaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggtgagggcatcctgcacgtgacagcctggcgtgtgtggagggctgcctgtctgatggtgtgaccattcatgacactgtgctgggcagagtgtgaggctgcatgggtaacactggcactccagggagtgtgtgggtgagatggggtggtcaagggtgtgtggagtgtgggtttgtagttagctggagtgatggagagggagggtgtacctggctccatttgtgacagtgagactttttaatgtgtgaggctgtaggtacctgggctgggagtgtgactgctcatgatgacatcatggctgctgtgggtataggcatcagtgggactgattggtgccctggggcatgactcagtggatggctgaatggctgttggagaatatatgcgtgtgtgtgtctgtctgttcaggtgagagtgcaagggcccatggttcggatagaggtgtgggcaccagcgggtattcacatgcccctgggagtggcatgaaaatgggcagggtgagaacatgccagggtgtgtgtgggtgcacacgtgtgcaggctgccactgggccaacactgccgagtaggcactagcgtgagaacctggggcaggagggggacactggcctggacaagcctccctggcctcctgggcctgacacccacctaatggcccttctgtttgttcccacaggcaaagatgcaccatccaactgtgtggtgtacccatcctcctcccaggatagtgaaagtaagggaccaacctcttgccccttttgggttctctgttttcttctgtcctcatcctgcacccagaccctgtttggaactctggcctcatcaccccaagccctcagaaccccccggtcctcctccttttctgctgctgcacatcccttctgcttcctccttggtgcaatccccagaagcccactctccttccatctgctctggagtctctgctcctcttgactctctggagtggctgtgccttggcagtgacctttggccagggcaagtgcctcatgacaggtactgggtgccccaggcagctaagtgccgccctgcccaccagccccctatggcttgggaaggctgggggtcctcttggcctagaattaaactacttcagatttctgtgttctgtgtttctatgttcttcagatgttctctgttgcaggggagggaggaggaagaggttcaggaaggggaacagaactacctttcctgagttcccactgtgctgggcactggactaagtctttttaagtattattatctcagggatatatatatatatatatgtgtgtgtatatacatatatatacacatatatacatacatatatatgtatatacatatatatacatacatatatatgtatatacatatatatacacatatatacacacatatatatgtatatacatatatatacacacatatatatgtatatacatatatatacacacatatatatgtatatacatatatatacacacatatatgtatgtatgtgtgtgtgtatatgtgtgtgtatatatatgtgtgtgtgtatatatatgtgtgtgtgtatatatgtgtgtgtgtgtatatatgtgtgtgtgtatatatatgtatgtgtgtgtgtatatatatgtgtgtgtgtatatatatgtgtgtgtatatatatgtgtgtgtgtatatatgtgtgtgtgtatatatgtgtgtgtgtatatatgtgtgtgtgtatatgtgtgtgtgtgtatatatatgtgtgtgtgtgtgtatatgtgtgtgtgtgtgtgtgtgtgtgtgtatattttctgaaacacggtttcactctgttacccaggctggagtgcagtggcgcgatctgggctcactgcaacctccgcctcccggattcaagcgattcttctgcctcagcctcccgagtagctaggatgagattacaggcgtgcaccacaatgcctggctaatttttgtatttttagtggagctggggtttcaccatgttggccaggctggtctcaaactactgacaaatgatctaactgcctcggcctcccaaagtgctgggattacaggtgtgagtcaccacgcctggcctcaggaattttttttttttttgagaaagactctctctctgtcactcaggctggaatgcagtggtgcaatcacagctcactgaagcctcaaacttccagatgcaagtgatcttcctgcttcattctcccaagtagctgggactacaggcacgcatcaccatgtctggtgaatttttaaaaattatttttggggttaggtgcggtggctcacgcctgtaatcccagcactttaggaggtcaaggcaggcagatcgcttgaggccaggagttcgagaccagcctggccaacagggtgaaaccccatctctactaaaaacacaaaaattagccaggcatggtggtgcacgcctgtagtcccagctactcaagaggctgaggcaagagaatcgcttgaacccgggagtcagaggttacagtgagccgagatcgcgccactgcactccagcctgctgatagagcaagactccatctcaaaaaaaaaacaacccaaaatttgcctggcatggtggcaggcatctgtaatcccagctactcgggaggctgagacatgagagctgcttgaacctgggaggcagaagttgcagtgagccgagatcacaccactgcactccagcctgggtgacagagcgagactctgtcccaaaaaatcaaaaaaatcacttttggtagagatgcactctcgctatgttgcccaggctggtcttgaactcctgggctcaattgatcttcccaccttgacctccaaagtgctgggattacaggtgtgagccaccatgcctagcctcagggaattcttataagaactctatgaagtaggcatcaccatcttctctgtatccatggaaagagaggcctagagatgtatgctaacttgcccaagctcacatagcccagggtagcatagctgggatctggctgcaggcctgcttagctctgcatactcaccttcttcccagcttggggcagtgcagtgggtagcagttagccccccggtgcttgccagagaggtgccctacagggtaagagggcactgccctaagggtgcctggcgctgagaggttgggtgagaatacccagcagcttggagacaaaatgcaagggcacctccctcttctgagaagaggtcttggcttccacacccctctataccctgtatgtgtcagacatccagtggggaccagcccctgctaggccctggagatacaaaggcatccaggaggacatgcacgaggacctaagccggaatggggatcagctaaaccacggacccaacaaaacccaactcaaaggctacagtgactttttactcagctacccttttttcaaaccaacaaacaggccaagagcaaaattagaacatgcattttggtcagagccatgttggtcaggctggtctcgaactcctgggctcaagtgatctacccgccttggctccccaaagtgctgggattacaggattgagccactatgcccagccccagtgccagcctcttaatgttatccttgggaagtaagagtgtagcttgactatgaaataacatgaaagtacaagttaacctgaggtaggggaatgagactagagaagttggtgcccaaggagctcctgcattgctgaggggctgtggtttctcagtgagctcagagaaggggtctaggcagctcatctccctttgaacttcttcccaccccccagcgcagcagaatgtgctgtctgctttcacccagcttcctccctgggaaaccaggcagcccaaccctcagcagccgaactccctcctccatatatccccgtgggctaccaggcaggccctggacaaaggccgcctgagcaggccaggcccctcccatcccaccctgctgtgtcagggcctggcacactccttagtgcggtgtcggcagctacctctgccagcgcctgatcaccttcccaggataagcctggctctggatggtgagtgagtatgcctgccttcccctgtgagtgccagcccaggcactggccacgcttgggggaaggggtggggaactgtggcgaggctgagctctgcagagatgcctacggcttcagaaagcagctggatccacagacttgtccccaaacctctgcgcccctctgccccagcctcaactcagcccagatcgtaaggaagcctcaggctctcaaagtgaaattaagtcctgatctgatagagggtccacataggggaaatctctacctggggatagaagttaggcagggatatctggccaagctcaccctccaaaggcagatagggaacaggtatcaatgagcacctggcaaagctcacaaaatgttgcttactagccgtccagaggagacctgctttgatcactagaagagagtgctttgcaactggcttctcaaatattgcccacaataaggtcctttgatgggggttttgaaatactgaggtgtctgggttatagaatgtctttactttcaatattccacgtcaaaatgcagccttgctaagatctgcagggaacctgctgtaatgtggagcggaacttgctttgtaattagcatagcaactgttcctgtaccagtgggtacttctaaagtgactgaaaacagtttgttctcatttgcagtatgaacaaacctcctgaaagcttgtttacgctgtcggattgtagagcaaaacaaaaacagcctttattcccaaacaaatagcggaaaggcaacatttagaccacagccatttacctctcagagctctttggggcgaagttgacactgtgacaaggtatcccagcccatcttttggccctgggaaaggctaaaattgggaaggaaatgcgtttatgttggttgtggttctgagggcacgtctgttcccagctaaactcctgcagtcagcagatgccctgaaataaatcaaacctcctcatgctgttgggacagcgaagcttcgtgtacacctttttggagggcaatttagcaatagcctaaaagaaaatgcacatactctttggctcagcactttgaccgctaggaatttactacagatttccttgctgagtgagccaggctgcgtgcacaagttcattgctacattattagttatgctgaaaatggaaacaacatgtctaccaacaggggactgcttcaataaatttagtgggagccatgtgataaaactctaagcagaatgaggcaggggagacagagagatgtccaagctgtgctcagtgggaaaagcattgtcatatgatgctgcgtctgctgtatttgcagggaatataactaggaccataacacaaaaaccggcacacagggatgatctcttcagagggggtcttggtacaaggggaggaggagattcgaatattttttaaacttgtactttttttggtagtttaataagtttaaaattgaaaaacattgtacaaggattcacgtttttctagttctcaccccgggtgtttctcctgtgacttgtgtggtgagatcaaggggttctagaggccccatcccagagctaaggagtctctgggatgagttggggctttttatctattatgataaaacatatataatgtaaaatttgccatttcaaccattttaagcctacagtttggtggcattaattacattcacaatgtgcaaccgtcaccactgtctattttcaaaactttcatcacttaggcttcttttgaccttgagctctgtggcatggggtctgcgaaggccctgctctcccttttcagagaacaacctgtagccaagggtgttccagctgtaccttgtgggctgggatgaggactctgttccctctcttgcctggagctgcctgagctgtaggtgacaggtcttgtttctgagtgctccaggggcatagggcggcaggcacagggctctctttgaaaggagaaccgccttatcttccatgcctctgtaggttgctgggggtctagctgtgggactctggggaaaggcgggtctcctgcttcctggccttccctctctgagcctcagtttatgctcaggaggagcaatgggaatggggcttcaccttggctacctctctgccctttcagacatcacggctgcagccctggctacgggtgcctgcatcgtaggaatcctctgcctccccctcatcctgctcctggtctacaagcaaaggcaggcagcctccaaccgccgtgagtattcctccctgcctggggtgggtggacggtgcgagtgacctgctccagcccccagttcagcccctgggattcgcaaaggcacgatgcaggcacaattccttttcatttgagagttgggagcagctgcacttcccgccaggagctgggcgaaatggccgagagaaaggaggcatgccatttccgggggccaagtgcccaccagcccctttggctcccaggcagtgctggctcggcactcaatacatgtcttctgaatgaatgatcatatgcagtagctcaagttgctttataaaagcaagttgctgccactcagagatccttgggggacctgtttaaggtatgggcgtgcttgttttgtaattagtagcaattgttgggacaaaaaatgatctttggaatatcagaagtggaaggggtcttacagacaacttagctcaaccctttctttttccagatgagaaggctaagatcagtggggttacataactgactgaatgttacgtaacttagtaagtggcagagctaggactcaatctcagagctttcaacgcatgctctttccagggaatagaagtccaccatataataaaaatgctctcacttactcctcattgcaagtccaagaatttggtcctaccattgtccccattttactgatgggcaaacggaggcacagaggggttaagtaacttgcctaaggaaccacacagcaaataagtggtggggctgggctttaagtcatgggcacaaacatctttcacctcccaccctggccaggtgacagtgccccttgcctagttcctgaccctgcccttgagtcttggttagtctgagtcctccaagaaggggctagggagttttttacccttgcctcccctccctggcctcttcccgtctgcctggctacagaggtaactgagaaaggattgctctggtgccaggtggcttttggctcgcaacttatttcctgtggccggcccttaacaacttgtcatccctccctcccctcattcccgggggcccccacgtgaagccccatagtgggtcactcgggggctgtggccacctcacccttgctttcagaactcccctattcctctcctagaacacaccacaacctacctgcaggaatacccatggctgggggtgggtgggggcaggtaaagggcttggaacagaagagcaacgctgggcagcagggcagggggagcaggtgttgctgtgccctccctggtggaaggctggcccagagagcctgctcaggaatgaggcactctcaggaaaaaaagaaaaggaaagggctgggagccttgaggacggcagtttgctggagaggccaacaggtgtggatttccatcctgctttggactgagcctcagtttccccagctctaaaatgggaccaacaaccctcaccccaaagggtggcacagaggatgagatgagggaatacccgtgtgcacctgcacgaagcctgacccatgagtcggctgtaagcaatagccatggtttgaatagatttcaggaacttttgggtaacttccctgtgtttgttctgttgttgtgcccctcccccaccatctgtttccccatcgtaatcagcagtaaatctccttaaaacgagaagcatctgtgggaggacatggggtgctgcatgaaagagggaagttggggtcactgcatctaattggtggccagtttggggggtggggtgtcccaaggctgaggcaagcggcagcaacttggatgagaagcagaaagtgagtgaagtggctgggaagtgatcggggacttgcaccttgtaaggtttccctgagagatgtcccctagaatgccaccctattaggcaatgtaggggataggacagagaggaccaggagccctctaattaggaactgaccttaaacactcccacccagtaagtcatggctaaagaccagaacctggcaaatgttcaaacaagagacaccagttagcaaattcaagagttgacctttgctcgatacttaaatcctgaaggtctgacactgtgtaagtcaagccataggagaaagcgctggctgcctttggtctcctgatggcagatagcgttcttacactcctggaaaatgcagatagagtttcatttatcagtcgtcaaaatgggcccctcatggaggccccatctgctggacagacacgcagatcgcttgctggacagcacccatgtgaaaagaaatggagtccggagctgtgcagggccctcctgggctcgctcctgttccctgcagggcatctgccagcaggggcagggatgttgtatggggaagccttcccttccatgaccagcttctctgtctgtctgtccctaggtgcccaggagctggtgcggatggacaggtaaggcccatggagaccttcttgagaaaacttcctgggccggctatccaggaagagatacttctgtgcagtaggggccctgtttagctgcctagagcagctggtcagaagagcctctgccatctgctgctgaagcctgcacatctgtgcagattggctgttctcctgccaccccgactcagcaggctgagctctgattctgctcagatgtgtcatgcacccaccttcgggtctcagtggtcagcctgggccaggatggggacagggaggaagcactgtctggggcagacagtgagacatgcaaaggaggccagcgggcccagccccagccacagcccttgagctgtgcctcctgcccgcagagaactccaaggagaaagctgttaggccgctgcaggccacaagggcagaggctgaggggtcccagagtggtgcagtgggctgggtctaggggcagaggggatggggactgtgtattggtgtgctctgggcaggaagctgccatgcagcctggcctggagggtgtgttcagggaacccaagttcctgccccggtacctgcaacaccaaacacaaagctcctctaggtgtttgaaagggatgatcttcaagacaggttgaaggaagtcctgcttgcaactcatctagaatctaagagttgcaggggtcttcagaagttatcccactcccaactgggaagagaagagaacccctcccctcagctcaagacaggctttggggatgttcgatcctaatgccatcaactctattgaccaaagagaaacttgtccccaaattcctgaggctgaagttctagaagtgtctgtgatttttggcttcctggctgtgcccggggttgatggtcagaccacagggaggagctggggtctgttctggtgggccctgatgccctcagctcaggacaggtgggcaggtgcagcccatggcctttgctctgtgggcctggctcctgccttcttgcttggagatgctgctgaggcttggggatggggatgtaggtgagagaaagggaggagagaaaaactgggggcagggagggcagagttcacgctccggacagcacagatgaccttccattctggttctgtggcagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctgggtaagtgtttcctgaccttcacagcacgatgacctgtaaggtcatgacctcatggcctgcagggcatcggcctcactccctgccctccctgaagagttccacggcctcacggggtggggttgagggtgagggacagaggggcccccattcacctccctgaagagttccacggcctcacggggtggggttgagggtgagggacagaggggcccccattcacctccctgaagagttccacggcctcacggggtggggttgagggtgagggacagaggggcccccattcacctccctgaagagttccacggcctcacggggtggggttgagggtgaggggcagaggggccccgttcactttgcttctccttttcttgcagaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggactgctcagcactccctaaaaacacaccatggaggccactggtgactgctggtgggcaggctggccctgcctgggggagtccgtggcgatgggcgctggggtggaggtgcaggagccccaggacctgcttttcaaaagacttctgcctgaccagagctcccactacatgcagtggcccagggcagaggggctgatacatggcctttttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccatggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgactaaa

SEQ ID NO: 102 - DNA, 32743 bp, Homo sapiens
cttgtgggaactgtcagaccagctccaggcgctggggctttctcagtggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggtaaggaggtcctacctggcgtggggcgagggagggactaggagctgtgcccctcagggagatcagagccagagcctctgcttgtgccacatacacagtcatctggaacttgactccgagcagctcctgacagctctgacagtctaaatcagacaggacaggctggcagtgcactgggaggtctgtgagaggggtatctggccctgccaccagcaatccaggaagtcttgggtgaggagattccttcccactggcttcaatttacccttccgtgtagtggagagagaagcctccttccagccgcctgtaaagatgatgaaaattgcatcctccaattgtggcatgagagaagagaagcagtcccaaggaagtgggtggttctcgagctcagagacagatggatggacccctgaggcaggaaagctgagcccagggaggggagggcgaggccagcagccaggaagaagctggaaggcatggtccctcatctccccggcttcttcagccatccagatgccacaggagcctggaaattattagggacatgcagggttggggcagaagaaggagacaatatgaggaagctccacagcaaacctaaagctgtcagccaggcatggagccatctaacatttactcctggggatcccagctgagggctgctcccctctttctccagttctggggtccaggatgctctgaaacctggatcccgcatttaatttaattgaattaatttatttatttcatttttaatttttatttatttatttattttttgagacagagtctccttctgtcacccaggctggagtgcagtggcgtgatcttggctcactacaaactctgcctcccgggttcaagtgattctcatgcctcagcctcccgagtaggtgaaattacagacgtgcgccaccatgcttggctaatttttgtatttttagtagagaccaggtttcaccatgttggccaggctggtcttgaactcctgacctcaggtgatctgcccaccttggtctcccccatccaaagtgctgggattacaggtgtgagccaccatgcccagccagggttctgcattttagatcagtgactctgcaggggcttcacggaggtggagagcgtggaattagaggagggtacactctgggcacaaagaggggaaactgaggcatagtgttgtgtgggttcagggccaggtagaagccccatatgcaataaagtcccatgcccaggtactcaattcagttaccgagtccctgagcattcttgtgtccttcaggaagacacagtcaaggctcaggtggactcaacatttgtaaggatgcaggcagcctagggcagagcatgatgaggaacagggagcagggagggaggagtggagcctgcagctcttgtgggtgggttggggggcctagtggcccaggattctaggcaggagagctaggttggaacctggtctaaggatccttgaatgcagctcagacagccgaaggaggactgatgggattggtgcctggctgtggggatgagagtaacagagaagctgaggttatgaccctgaggtcatgagcctgtgtgacagagggcaatgctccctccacccccattcccagggcttcagcaccatagctgggcttggctatgccggcccttgcacggtgaagctggtgagtgacttgttaggcacagggagggatggacttgggtcttcctgagctgcttcctcctccatcctgtgtctatagggcaggcctggcataagttgactgaagctgctctatttctttaatttttaagctttttagtttgaaataattgtgaagttccagggaagctgcaagaatagttcaaacgattcttgaatttctttcatctagattcaccaattaacattttatcacatttactttatttctctttctctagctgtatgtatatgtgtgtataaatgtacaataatttttgctgaaccacttgagaacaagttgtgacattatgtccccttactcctaaatattttagcacttatatcctatgaacaaagacattctcatgttactacagcacaattgtcaaattcagtaaatttaacattaataccatcaaatatgctttccatattcacatattaccaattgtcccaagaatatgctttattttttttttttgctgacccaagatgcaatcaagatcatgtattacattcagttgttatgtttctcatgttcagtctatgaccatactttaacctttcttcatctttcatgatattgcattcttgaagaagacaagccagttgttttgtagagggttccttaatctgggtttgtctgatgttccctcatatgattcaggttatcatatgcatttttatttattttatatcatcattattattattttttagagatggagtctcgctctgtggcctgggctggagtacagtggtccaatctcggctcactgcaacttctgctcccccgggttcaagtgattgtcctgcctcagcctcccgagtagctgggactacagatgcatgccaccaagcctggctaatttttgtatttttggtggagacagggtttcaccatgttggccaggctggtcttaaactcctgacctcaagtgatccacccacctccgcctctcaaaagtgctgggataccaggtgtgagccactgtgcccggcctattattatttttcaagagaggatctggttctttcacccagactggagtgcagtggcatgctcacggctcactgtagcctcgacctcgcaggctcaagccatcctcccacctcagcctccctggtagctggaactagaggtctgtgccaccatgcctggctaatttttttttttttttttgtagatacagggtttccccatgttgcccagggtggtcttgaactcccgggctcaggcgatccacctgcctcagtctcccaaagtggtgggactacaagtgtgagccatcatgcctagccatcatatgcatttttaaaattattttttctttaaaaaaatttttttctgtgcccattgacagcagatattatatgcatttttgacaggaataccacaaaagtgatactgtgtctttttcagcgcatcccatcaggagtcatatgatgacagtgaaatttaaaaaaccactttgtttactgaataatttaacaggagtactatttatgtaagatgtgcatataactcttgagcattgcgaaattcttccaaagacttcttctttcatgcagagtaaaagccatgcattttacaatggtgcgtgacctggcgtccaagacccactcctctttgtctctcctcttgctcacagcatttcagccatgttgcctgctggtcctggacctcgctctctgttgtatccacagttttctctgcctgggatgctgctcctttgctggctacatggcctcttccctcaacccctcagagttttgctcaaatacctccttttcagtgatgccttccccactgaaaatgtcagcctgccattctgcaaactcttagctctctctccacttaatttttctccatagtcctcatctccatttatgttccatcctgtttacttatgtttttcattttctgtctcccagtctcctcttcagccccctagactgtaagatccttgaggccagggcttttgtctgttttgctcaccgttgtctcctcaacatctagagcagtacctgccacaagtcaaccctcagtagatacttattttcacaatagcagccccctctctgttcccattctttctctggatatattttgaatagctctgaaccagggctattgaggattcagtggcaagtaagtccagggcccgtttgttcagagagcttgcgctagattgcctgagtcactgttactacagttgtgattagtgcctggtgcagtgccaatgcagtaggtgttcaaaacatgtttgttgagtgaataagtgaattattttcaggcatcttaacgggcagcctgggatgttttttgggttagacatattgggaaggagggatcttcaaatcattgcccagggaataggcctgggccctaaaattcattttagacccaaaattcaggtttcagttgtccgttctgaggaaaccccaaaggacacacaggctggaggctatgaatccccagatgctttacagcctgagttgagatctgctggacaataaaagggcacaggtgacaccttatagattagctccaagggttgccagctgtttgcgtagattgtgttggaactgtcacttctcagggagtggtgtctaactgcgactgctttggctgggatccaggcaagctgtagaagggctggagtcgtttttgctcttctcttcctcattgcacctcccctccaacaaagggtgaatggcaaagtagctggacacagaaaagagattggaattcaatgtaccctgggctacagcaccatccagaaaggaatccactgaaatcacttcaaggagagacagggcatgtcttgtttttttttttaattttttatttttatttatttatttttatttttttgtgagacagggtcttgctctatcacccaggctggagtgcagtgatgtgatcacagctcactgtagccttgacctcctgggctcaagcaatccttctgcctcagcctccttagtagctgggactacaggcatgtatcaccacacttggcttatttttaatttttgtgtagagatggggttttgctatgctgcctgggctggtcttgacctcctgggctcaagcaatcctcttgccttggcctcccaaattactgggattacagatgtgggccactgtgcccagccaggccattgtcttcacagacaaacctctcttattgaagtgcaacatacagaaaagtacacaaaattacaaatgtacatctcaatgagctattgttaaatgaacacactcttgtgtctaccacatgttctctcccattcattacttcctctgtcttccataaatatagccacaattctgacttctaacatcacagatttgttttgtccgtatatatggaatcaaacggtatgcactcttgtgtctgactacttttgctcaacatcttatgagatttatgtatgttattatttgtagcagatcattttcatggctgtatagtattttatcgcatgactatatcatagtttattcaccttttctattattgatgaacctttgggttgctttcaattttgtttttgctattataataatgctgtgatgagccttttgtgcatgcatgtctgttgggtatatctctaggggcagaaccatggagtatgtgtacgtaactctagcagatgctgtcaaactgttttccaaagtggttgaaccaaatagtgcatgagagttccatgctgctttggggccactggcttttggttctgaaggtctgcagatggaaaattaaattgtggaaatgtggagcttggcaagaggccaaaggcaagggaattacagctctgtgatttctctggtatcctgcatgaaattctgacaatagagtcatttttaggagttatgtgagatgcattgttgaattaattaatttaaacggattcatgaagcccttgcttgggttgttcattttgctgttgtgacgtttgaatttcttgtctattctgcatattagttgcctgtaggattcatagtttgcaattttttttcctattctattggttgccttttcactctgtgaattgtttcctttactgtacatgatttttttttagtttgctgtaataccatttgtttattttgcttctgttgcctgtgcttttgaggtcttattcataaactctttccccagcccttattatgctccaagaactatgcaaggttttgtgggggaaacaaagatgaaacagatgtctattctacccttaagaatctttcagacagaggaaaatgggtatgtataattacaactataagggaagatggaaatgctatgtgtcattaacaggcaagatacatttagaataaaaaaggagctaagaagatgaagattccttctaggtaggaacactggggaactggccttgaagaataaataagagtttaggaggtaggtacaaagtagaaggacaattgaagcagaggaaacagctcagaaaagccagggttgcatggggtttggatgggaaacaggaaagggagatgcacttgttatcatggagaaacaatatcacatatgagatgatttggttaactgatgcaaagagtgggacttgggctaggtgagttttgacagaggtaagggagttgcattgcctgaggaagagagttaatatggtcagtatgaagctaaatagagaggaagaaagaaatgggatgtgggccctataggatactttatctatcttatgattttgccctgactagagctggattgccccagtacttttggaatctcactggactctgttcacttagtccccagcaggtacatcttttgatgccttcaccccaagcctggtagcacaagccctagctgagaaaaccttaacatctatttgttggctggtggaaattccacttgctctgagaccctcccgtgctccttctcccaggtgctcaggccccacaccttcctccgactggcaggtccaggttggaggaagctgagctgactcagagctctgcacatgggctcagggctgagcgggactcactgctggatcagattgtctccttcaccatcctctgtacttgtctccttgaccatcctctgttcttcctgaggctgcagtggagttaatcatctgccctctgccctccctttcagagttactagttcacctcatccgttcttaaccacaggaaggtggcccccaaagctgctgagcagtagcaacagcagtggcaggggcccgggggccttcctggactgtggcctctttcctctaaacaattttcacttgttgggtcctcctctatgcctcactaaatgtgtgagaacttgtgttgaagttatgttttcgtagtagcatttcatctcccctatctggtgtgtgtacccctctgggacagaaactgaggtctttctgtatcagtcacaataccctggacatagtgacttgtctacttgccttttcaccgtatctgctttgcacccctgccctggcacccaccccttccaggccgtccatggaaactcattccaaccatcttcctccttcccacactggactgttgggggctgcaggagaaaattcagcaacaaagagcagctacagattcgtaatctccaaccccagctggactctcagtgtcctgggaatcctcatttctggcccacagcttctcctgttccccaaaaggtgggagaattccacaccttcgtcatctctttcaaggccctgttccactatctcagcctccacaaaccaacaacctccttctttaagaaaacagaagcacaagttagggattccaccaaccttgccaacaagtctccagtgtcaatgtacttcatctactcctgtaaatggccacatttgcctctgctgagggcaagagtgttcttgccctgtccttgaccaatactcccctgtgtgctcagggcaccagagcttctttcagaagtcacctgggacctgctgtctgtgaagacatccctcatctttcttcagctgctccttttctgtgggcttcctacctttagtacagtttccttccagttgaaaaatcaaaacaacacctggtgttctctctagctcctttttatttgcagacaaaccagtcttaaatgtataaactaatataatattacataaaaataaaatataacggcctaatttttaaaaagaccccaaaggcagtatagcatgaggactgtagatcacacatttcattctttaagtatttagaagtctatggctgggagtggtggctcacgccagaactttgggaggctgagacgggtggattacttgaggtcaggagttcaagaccagcctggccaatatggcgaaaccctgtctctactaaaaatacaaaaaaaaaaaaaagaatagctgggggtggtggcaggcacctgtagtcccagttactcatgaggctgagacaggagaatcacttgaacctgggaggcagagattgcagtgagccgagatcatgccactgcacaccagtctgggtgacagagcgagactctgtcttaaaacaaacaaacaaacaaagaagtctagacaataacttaaccattttcctgtgtgattcctattcagttttataatagcagagaacaaccttcttctacatagcgctctacattctgatctactggtggattatatgggagtttacgttatttttcattacaccgtatatttatatttaagtaccttttaatacttgtgctacctctcacaattttataaaagataaaaataaagtgaaaccaccactaaacacctgaaaattaaactcatgttccatcaccccattctccaaacctgctccatctttaccagacccataagccacacgtgtgttttgtgttcccttaaccatgctactgctgggtccataatacccaccttccctgttcctttctgcatacaccaggcaggccttggctttttctttcaatggcagctcccacccaccgcctctgggcagccactcctaactctgcagggcagaggaaaacatgctttccttatgcttgcctcacaccctgggcacacctccatagcacattccatattgcatttcagttggctgttttaggtctatcttcctttttcacttttttttttttttttttttttttttaggcagggtcttgctctgtcacccaggctggggtgcagtggtgcagtcatggctcactgcaacccctgcctcccaggcttttctgatatttagctaagagttgggtttagctgagatgagtgaggaaatctacaaattcacttgctatggtaatgtttccacaatgggcaagtcatattttgcttttatcaaagtacatcttagttaatagtcagaacagttgagtgagaggtagtcattactctttttctgcttttttaccaagatacaactcacagctgtgtgcacaaaatttaaatcaacagcttgatgaacttttatatgtgtaagtacatatcaaaactacccacatcaagatgtaacacatttctagcacccagtcattcctttttggcccttcaagttgataacccccctcctgcaagggtaatcacattctaacctctctcaccatatattagtttttccagattttaaactttatatcagtgaaataattcactatgtactttttggagtctagcttcattaatactcatcattgtggtgagatccatccacattattgccaggaaaagtagcttttctttttcattgctgtgtaatattccttataagactataacacgatttatttgctcatctaatcgtgatagacatttgggttttttctcattttgagttattatgactaaagccattattaacactcttgtacatatttttagtggatataaacaccagattttctttttttttgagacggagtttcactcttgttgcccaggctggagtgcaatggcatgatcttggctcactgcaacctccgcctctcagatttaagtgattctcctgcttcagtcttccaagtagctgggattacaggtgtgcactgccacgcccagctaattttttttcttttttttgagatggggtttcaccatgttggccaggctggtctcaaactcctgacctcaggtgatccgcctgcctcgacctcccaaagtgctgggattacaggcatgagccaccatgcctggcccagattttcttgtgtacaaattcttctggatcaaagggtatatgtaagtttagttttagaagataccgtaaaatagttttccaaagtgctggtaccaatttacactctcactagcaataaatgagaatctcagttgctcccatctctgtcaacccttggaattttcacatttatttatttacatttattttcgagaccaagtctcagtctgtcacccaggctggagtacagtggcgtgatcttggctcactgcaacctctgcctcctgggttcaagcaattctcctgcctcagactcccaagaagctggtattacaggcgccaccaccgtgctctgctaatttttgcatttttagtagagatggggtttcaccatgttggccaggctggcctcgaactcctggcctcaagcgatccacccgcctcggcctcccaaagtgctgggattacaggcttgagccgcttcgcccagccttcagacctttaaatgttagctattttggtgggaatgtgaaatctcattattctctgataactaatgttgttgggcacccttatgcatgcctattggctattggatattctctttcctaaagtgcctgcccaagtctgttgctttttttgtcattattgtcatcagtgtattattgatttccagtctattattgtcatcagtctattattgatggaattctttatatactctggatatgagccctttttcaaatgtatgtattgcaaacattttctcccagtctttggcttgctttttcactctctcaatgttgtctttcaccaaacagaagttctaagttttagtgaagtccaatttatcaatattcttttatggttagtgatttatttttgtgtgtgtgtgtcctgttaaagaaacatttgttgtctgggtgcagtggctcatgcctgtaatctcagcgctttgggaggccaaggcgggtggatcacttgagcccaggagttcaagacaagccttggcaacatggtgaaactctatctctaccaaaaatgcaaaaattagccagtctcataatctggtctcaaaataaacataaaaatagattaaaatgtaaaaataaaaaaggaaacatttgtctatctcaagatgtagaagatattctcttgtgctttttcctggaagctttataggtttagctttcatatttaaatttatgatttgttttaaattaatttttgtatatgatatgagggagatatcaaggttttttttccttatagatatcaatttgaccaagcaccatttattgaaaagatcaagtatgtgttggtttgtgtgatattgtgaaatatatatttggttttcaacctcctttcctggcatacaattcctaaaatttttagaaattccgaagtgatgtctttttgtaggctaatgaggtgaccgatggctggcagcctgtaggcagcttcgggataggggccggtcaccagaaagaccaaggcagggttggaatattggactctgagcccgtccccaaccttcaggaaaaggagagggattgaaggttaagttgatcaccgatggccagtggtcaatcattcccatttattgaggcctccataaaaacccaaagaacaaggttcagagagctaaacatgcggaggttcctggagggtggcacgccctgggaaggcatggaaactctgtatcccttcccctacaccttgtcctatgcatctcttcataggtaccctttgtaataacctttataataatccagtgaatgtgtttccctgagttctgtgagccatctagcaaattaattgaacccaaggagggaataacgggaaacccagtttatagctagttggtcagaagcgcaggtaaaacaatctggagcttgcagttggcatctggtggatatctacaggtagatagtgtcagaattgaactgaattagaggacatccagttggtgtccactgaagagctgattgcttgcttggcacgtgggaaactccccacacgttggtcacagaagtcttctgtgttgattgttgtggtgtgaaaccagaggaaaaacagttagtgtttttcccacacacagggtctatttctagactattatattccatcgactacttttcaatccttgcaatactggaatgctatcttaatttctgaagttttacaatatatcttgatattaggtagtgaaaaccttctagctttgttcttcatcaagattgccttggctattctatgtcttttacattttcatataagttttagaatcaacttgttaatttctataaaaataacctgcaataatttttattggaattctattgaatctataaattaatttaggaagaattgacatcttagcaatattaagtcttccaataaaaaccatggtatagtctcctgtttatttagctctttaattttttctcagcaatcttttgttgcaataggtgtataggtcttaaatatttcttcttgaaattatttctatatattttatcttttttgtgctgctgtaaatagtattgttttcaaaatttcatttttatctgtttgtactaatatatagaaataaaaatgatttttgtatattgaccttatatctagcaattttgcaaaactgacttctacactcaaataatttttcatatagtcctcttggtttcctatatacacaggtatatagtttgtgaataatgacagtttcacatattcattttttttttgagatggagttttgctcttgttgcccaggctggagtgcaatggtgccatcttggctcactgcagcctccgcttcccgggttcaagtgattctcctgcctcagcctcccgagtagctgggatttcaggtgactgccacccgcctggctaatttttgtatttttagtagagatggagtttcactgtgttggccaggctggtctcgaactcctgacctcaggtgagctgcccaaagtgctgggattacaggcgtgagccactgcgcccagcctcacatattcatttctaatttttattccctttgactattttccttgttttgttgaactagccatgacctccagtacaatgttgattaaaagaggtaattatggaatcctttttctgttcctgagtttgcagggacatggatgaagctggaagccatcgttctcagcaaactaacacaggaacagaaaaccaaacaccacgtgttctcactcaaagtgggagttgaacaatgagaacatatgggcacagggacgggaatatcacacaccagggcctgttagtgggtgaggggcaaggggagggaggcattaggacaaatacctaatgcatgtggggcttaaaacctagatgatgggttgataggtgcagcaaaccaccatggcacacgtatacctacgtaacaaatctgcatgttctgcatacgtatcccagaacttaaagtaaaacaaaaaaaaaaaaaagaaagagatgggtacaaatgtgaatgtttgttgttttgaacaaacctctccaaccatgtttttcctctgctcccacatcaaaataataacaatcatcaacatagaagacttctgtgaccaaatgcagggaggtggatttctcctcacagcaaactgaataatgtattctgcagtggacaccagctgggtgttctccaattcagttcagacactaactggagagagtgtcagaccacagaggctgggggctcagtccccaacaccacccctccaccacaccagttctaagtctgggcctccagaacttcggaccaaccagcttccagttggggttctcacaaccccctccttgggttcaattaatttgctggagtggctcacataaaccagggaaacatttatgtttgctggtctattataagagatattacaaaggatacagatgaagagatggcatagggcaaggtatgggggaagggacacgaagcttccatgccttccctgggcacactgcatgccaggaatctccagctatctggaggctctccaagcccagtcctcttgggtttttatggagacttcacttcataggcatgaccaacaaccttgtagaaatgtgactggatgaaaagggtatgattccatactaacaggctgagtggagaaacccagcaaggcctgtctgttcagattcttcttggtctctctgtgtagcatttctttctctagaatctgaggcaggaacttctctgaaatgagggtcttttgatttatatcagattagagttgtctacactcagcaatggtgatcttcttgctggtcttgccattcctggacccaaagggctccatgctgtctgcaatattcatgccccctttcaacttgccaaataccacacgcttgccatccatccattcagtctcggcaatgtagatgaaaaactgggaactatttgtgttgggtccagcatttgccatggacaagatgccaagacctgtatgcttcaggatgaagttctcaccatcaaatttcaccccatagatgaacttgccaccagtgccattatggtgtgtgatgtcaacatcctggcacataaattctgcaataatcctgtgagagcaggagctcttgtaaccaaatcatttctctctagtgctcagaacacaaatgttttctgctgtctttggaactttatgtgcaaacagctccaaggagacacggtccaagggttcatggtcaactgctatattaatgaacatggtggggttgactacggttgatagcaagagactctaggtggtgaaggcacctccaaagcaccaggtatatacattttaacacttttatttaatgaatttacttttggctttgctaattttctctattgtgtatttgctttttattttattgaagttagctcttacatttactttctcctttctcctttctctggattatcatcatcatcatcattatttgaattactatttctttttctttggtttcttgagattgaatcttgcattattgacttgcaaactttctttcttttccaatatacaaatttaaagctataaatttccctctaaacactgccttagctatattgcacatttgatactcattatcactttgctctaaatatttcccaaatttcatttgatttattctttgactcatgggtttttagaaatatgtttcttatgttttaaacattcagagattttctggttatttttctgttattgattttttgtttaattctactgtgcttagagggcataattggtatgatttcaatactttgaactttgttgacacttgttttaatgcacagcatatgataatactttggtaactattgcatgtgcacttgaaaagaatatgtattctgcaattgttaggagaattgttttatatataatttatatatatattggtttaatgatcttcaaattcttatagccttattgatttttttgtgtgcttcttgtagcagctagagagacagatgtaataaaactctccaactatagttgtggatttacttctccttttagttctatcaaattttattttatatattttaaacttgttatatgcatagaaactgaagatgattgtttattcctacttaattggttcttttataatgatgacatttccttctatttctgtatattttttatacatcttatgtctttttttgttcattttctccgttattgccttcttttgtatttaattgatatttttgtgctgcatctttttgattcccttctcatttctttttctgtacattttgttattttctcaatggttaccacaggtattacaatgaatacctccaacaatatagtttgaattgatgccaattcagcctcaatactatagaaaactcctatacagctctatccccccacttttattgtcacaaattacatctgtttctattgtttttcacttcttgtgcctgagtttccattttctttatatctaaagaacatcctttggtatttcctttactgcaggcctttttgtgacaaattctttccgtttttaattttttctaaaaatgtctttatttcagcttcatttaaaaaattattactattttttgagacagtctcactttgtcacccaggcaggaggggagtggcaccatcttggctcgctgcagccttgacttcctgggttcaagtgattctcgtgcctcagcctcctgagtagccgggattatgggcgcgtgccaccacgctcagctaacttttgtatttttagtcgagatggggtttgccatgttggccagcctggtctccaactcccgacctcaactgattcacctgcttcagcctcccaaagtgcggggattacaggcatgagccactgcatctgctttcatctttgaagtaccgaaattctagataggcagttattttctttcagcactttaaatatatcattccttggaaaaccaaacaacgtatgttctcactgatacgtgggagttaagctacgaggatgcaaaggcataagaatgatacagtggactttggtgacttgggaggaaaagtgggaggggagtgagggataaaagactataaatagagtgcagtgtatactgctcgggtgatgggtgcaccgactcacaaatcacctctaatgaactttctcttgtaaccaaacaccacctgtaccccaataacctatggaaaaataaaaaaaaaagataccattccatcatctgctttttattatttttgctgaaatgtcagctaagttgtttgttttgtgaagggaatttagttttcccccactctggctattttacgatttttctatttatctttggtttccataatttttttgatgtattgagaggttgtcttttgttcattggtttgttttttttctttttttttttttgagacagagtttcactcttgttgcccaggttggagtgcagtggcgtgatctcggctcactgcaacctccacctcctggattcaagtgattctcctgcctcagcctcccaagtagctgggattacaggtgtgcaccaccatacttggctaatttttgcatttttagcagagatgggattttgtcatattggccaggctggtctcaaactcctgacgtcaggtgatccatccacctgggcctcccaaagtgctgggattacaggcgtgagccaccgtgcccagcttgtcggtttgttttgatcttgcttggggtttgtaacacattttacaaatctatcttgatggcttttgtcagttttgggaaattcttatcttttatctcttttgcttagttcctctttcctctctcgtctccttgctttccaattacacttagtttaggggttttgttttgtttttgctatatctcaaatatcttttacactccttcttgtgtatttttatccttttgtttttctttacttcactctggatattttataacagttttctaattctcttttcaatggcatctaaatggcctttttaacctttcaattgagtttgttttacagttattttacattttatttctgtaattttcattgaattctttaaaaaaaatccaatttcaggtaactattgctgcataatgacctactccaaaatccagtagtttaaaacaactacctatttagttagtgattctgctagttggcaatttgggctgggctcagctaggtggttcttttggtttcctcttgcatcagtcatgcatgtgtggtcagctgccagactggccacgggtggctgattcatttatttattttttattgttttttgagattaggtcttgctctgtcatgcaggctagagtgcagtggcatgatatctcggctcactgcaagctccatctcccgggttcaagcagttctcgtgcctcagactcccaagtagctggggttacaagtgtgtgccaccatgtctggctaatttttgtatcgttagtagagacgaggttttaccatgttggccagggtggtctcgaactcccgaccttgagtgatctgccggccttggcctcccaaagtgctggaattacgggcatgagccaccgcaccaggccagggctagctgatttagaatggccttagctgtgttggcttatctctgtatcatgtgatatcttattctccagcaggctattttaggcttgttcacaggtcagccagatgaggttccaagagaacaagtagaaatgtgcaatgccttttcagatctaggcttagaactagcagaacatcatttttgctgcgtttcatcatgaagaccagcccagttccaagagacagggaaatgaaccccatttcttgataacagaaggagctgtaaagtcacattgcaaggacatggtatttttgcattctatcacgctagttctctgctgaaattcttaaacttatgttttatttccttgaacatattagacatgattactttaaagtttatgactgacaactctattatgtagatgccctgtttgttggtttctgttgtctctattcttctgttggtttttggagatgtttccttttcttatacttcactttggatattgtgtatgaaacattctaggaataatttaatgctctggttgatgttattttcctctagtcataacttatatttgcctctagttggcagccaggttagggctaccagagattccagatcattagttcaatccagggttgtgatgattcaaaattgagcttcagttcctgtgagggctgttcatttctcgttcactcttactctttgggtatagccctctgtggtaccaacctcaacactgatggattttatgtatacccgctttctaataggagggacgtgaacttcatgttctcttagttccttgagttttattgtgagctctgctcagcttctcagccttttagctgccatttatggaatcagaagatgcctccagggaacaacagtcagaaatgctgatctcacctctctgaatttccttcttccagatattggccccataatttttcactgctttataaactctctgataactttaacaatgtgcttttacatgttgttcatttttcttctagctatttttagtgggaggattggttagcatgtcttaacctggattttcattacataattagaattccttcgatgattttttatctcaacaattaaggggatgctgtagaatgaaagtgttctgtttccagatcacaaactctctggagtcaggaatcatgccttatacatgaagaggccctgcctcttcaggggctggattgcagtgggactcagtaaggactgaataattgatgaagacagtatatgtcctccttgtaggtttagtaatgattttttccattcacctttgttctcagggtctttgtgcaatatttggtaggttgacttgttcttataaatagtgctaggatcgtaggagacagagacacagagatgcacagcacagtctctgcttttgagaagcttttggtttgctaatgggcagagccagtacaagtcatataaatataaatgggaacctatgtgttttagtcttaggagcatcaagatcaaagaaacatatttcatcaaacaaatagtattacaagtcctttaattatttacttagtctcttgagaaaatgccagggtgaagctgtggcttggagagactgcattcataatgcactggacatataaaaacccctctgtctcaattgctctcttcttaatagcctccattttaacggagccacttgtaaaactctccccatctcttattttctcttccaaatcctccctgagcctccccaactcacccagagagactttttaatttcctgcacctgctgggccatgccacatagctttattactaaaaatggctgtaggaacttccagttttgtacactgactgcacagaattgctctaggttgtcacacccccatattcattaggtttcatcttgattctttgagaggcaagtgctgggatctgcctgggaagtgtagttttatttttaaaattgttttctagggagaaatttttgtggagactttctgatcactgaaaaactggcaaacatcaataagtaatgaccaaaatccaatgaaccaagtgccacgagagaggattatgtattcagctctgtgagaggatggttgaggggccatgagttcagcttggacggttagtcttcctgggcctgaccattcagaatttccaacagtcactacttgccattagtagttgcctcagcactgcttggagggagtcaccttagatgtggtatttatagcatcatggttaagaatttatcctctcaagccaaactgctgtctttacaaagagtaaacaaataagctccctagcacctgtgctcccagctactagggaggttgagatgggaggatcacctcaagcccaggagttcaaggctgcagtgagctgtgattgcgccactgcactccagcctgggtgacagagtgagaccctgtctctagaaaacaaaacaaaagaaaacaaaaacataacaccaaactgactaggtttcaggctcatcattcttttaactcatcataccttttaacttaaatagttaaaatgtataaagtgtgaaacctgcctgtcacatagtaagtactcaagattttagctattggtctatgggatccctcagactagggacacagagcttggggacaaggggaggcagatggaggggatatgctttaaggtgctcctaggttctgggctcctcatactcatccccacccaattggcttaagggaagtcacatccagctgcccacattgctcaggcctgacactcttcccgctactttcagcttgggttctctttcctaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttggtaagtctccaggactgttcatactgccctctctgattcctataggcctctaagttctgtatttccaatgcctttctgatcagaatctctgcttccagataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcagggtaagtggaacacactgggctataacaagcgctgaaggtttggaccccgcaaccaggctcatgtgcaagacagatgtggtatgagataaaatcccttggcctcctctcccagtgccttgtagcccttcccagggtagccctggcctccaggcacacagttcctgtaaagctaggcctatcctactctggaaaaaaatgttatccctatttccttctgggagatgcaagcttttcttctgcagagggagggcatagttgtttggtgagtgacagtcctgaaatggctcctgaacattattttcttcctgggagaggctgatggagaactgtcctctcctcttgagtgataactttctccaagccacatagttcaagaggtaactacactgtgcagcagtagcctggagcaggagcatcaggatgaccccagggatacctagatgagttcttgggctgttgcttatgctcatcctaagagttacctgagttaccgttccacaactttttattacataaacagggacttaatgtaccagcagcatgggcattataggaaaaaaaaaccatacagctctcattcataaggaacttatagccaaatggggcaacaaaaataactacttgtggacaaaaaagaaacaagactgaggcaggccgggcgcagtggctccctgtaatcccagcactttgggaggctgaggtgggtggatcacaaggtcaggagtttgagaccagcctggccaacatggtgaaaccctgtctctactaaaaatacaaaaaattagctgggcgtgttggcgggcacctgtaatctcagctactcaggaggctgaggcaggagaattgcttgaacccaggaggcggaggttgcagtgagtcaagatcatgccactgaactaggacactggcttcatcattcagaagctctgtgatctcttagaggtcaggtgtggtggctcacacatgtaatcctagcactttgggaggctgaggcaggtggatcacttgagtccaggtgtttgagaccagcctggacaatatggtgtaatcccatctctatttaaaaaaaaaaaaaaaagaagctctgtgatctctggcagattcattaacctctctgagcctcaattttcttccccccttgagtaaaatgggggtgataataagtacctcacaggattgctgttaagagtaaatgagataatgtttgcaaagagccttgtcagcccttggaacacttaattccttttccttcctcttgttggctggattatatatcaggctacatgtgtgacacaaatcttttaagtagaagttcaaatgaggaagagccatgaaggaaggaatagtggaaaagtgagacggaaaacttgcctgtacaatgagtattttttgagttaaaaacaaaggaatggataaatgtaacatttgttgtgctacatgtccctcagtatccatgacgaattagttccaggacccacctcgcaaccacagatgccaagatccacgaatgtttaagtccctggcataaacaggtgcagtttttgcatataacctatgcacacatccttctgtataccttacttaagtcacctctaaattagttataatgcctgatacaatgtaaatgctatttaaatagttgttatactgtattgtttagggaataatgacaaggaaaaaggcctctacatattcaatacacatgcattttttttccctgaatattctggatccacaattcattgaatccacattgtggaactcaaaactttggagggcaactgtattagatcatgtaattaacccctataggtagataacgttatccccttttacaggtgagaaaatctaagaggctctgaggcatcttccaaaaataagatgacttgagaggcccagagaggttaaataaatagtgcagagctcacagggttagaatttgagccaggcctgtctgatatatctatgctcttggcatcactcagaggaggttaaccaaatgagcaaagagaaaaccttgaccgtgagttctcagagcacgaggcaatcagccacaacacagagaaaagtgggttttgaggcagcccctgcagcaggcaggtgggaaggaagaagagagcgagctgacagctcagttctcacgccttctgtattcctcagaattcagattttggccgtttttggtgatcatcgtgattctaagcgcactgttccttggcacccttgcctgcttctgtgtgtggaggagaaagaggaaggagaagcagtcaggtgagtggaaggtccttagggtggtgctcctgcctgaggccttggatcctgtgactttgtcctgcgtccagtgggatgtgtctgggagcacagcatctccttttcctcaacgagctttggtatgtttgtgtgcgtggtggcggggggcaagcaggttgctaggctctctctcccagttcatgccttctgatcccaatgcgcagatttccctgtagacagctggtttgggaggaggtgtgggaggggcagttcggttgctgcctctgtgctctttggggttcctgggaagagcattaacttgcctcctttctagaaccttttttaaggtttggccatttggggtagaggtgggacctgttagaagcaaaagcccttctggaggtttctgcagctctgctctttgttttcttcctccctcagagaccagtcccaaggaatttttgacaatttacgaagatgtcaaggatctgaaaaccaggagaaatcacgtatgtcatcccggaggctggggtctctctcagctggcttggaaaatgctctttcaatgatggttattcagagcagagggacaaaaaggactgaacgactgtccttttgatgtgaccctcagcccttccccatctatcttttctccacctgcttcctagttctggtgatggaggaaaagaggaaacaaaaggagcagaggagatgaaagggaggctgaaggggcatcttggtgcagaattgcacctgctgagaagggatggagcacaacagaaatcaatgacagaggcagagtgctgctgtggtatttgttgtctgaccacaaattctttttcctaatgagtcagggcttacattcatgagtcccttaatggtgacacaggctgggaagtgtgaccagccaaagcataatagttttgtagctggctcaataggctgcattcacagccttttggaagaagaggcctgagtgtggctgaggtactagagagagtaaccagcctggcacaaagcccaccagcctgagtaggctcctccaggagcctctcgcctgctcttcgcagcaggcaggggccaactctgcctgtcatccaagaattagaagaggaggaaattgcagagggcctgcagatgcccccactgctgtgtctcgcttagggcagatgtggtgacaggcccaggggaaaagctctgatggagcctaccaaactgctggcaggaagtggggcagggtgggtgaagtggggcggaagtgccttctttccactgccccctggcgctttgctgtggagacccagcagcacgcaggaagcacatgtggtggggctcttccgtgctggccacatacgtgaggccctgtgcagcctcgcagagcaggcaagcatcctctcccagatgcctctgggttcagaggctgttagagcagctccccatgcctgtttttttatttttatctttatttatttatttatttttgccccagcagtggctatgggaatgtgaaaaataaagcagtggctattggaatgtgaataataaaaggggactttgtttctctcactgctaccagactctggtacaaattcctgaaagcatgtgaatctacccacagccagtgatgcccgggtgcttgctaaaaataatctatttttccaaaaagaagatgacttgagattaggagaccacaggaggaaaaacaacttagagcaaaggaaacctctttgggattcaggcctattagcttacttcttccgactcaagagctcctccctgcctggcctcagccctctctggcctctccctattgtctcagggctccaatttgaaggcctaaatctcaagtttcatgtggtctcactttgagacccagctctaatctttctagaaacacttcacacgggtctggacgggagagaaaagcaacaaactcctgcagtattttaaaacacaaatgaagttattgacattgtcagatgcccatgactccccagcctctaaggacagctgacagttctctgcttctcttagcttcttcttgcttccaggaattttgcttgcaccttgcctaatgaaccctgctgcctccactggctcccagtagaacccaaactggcaatatgctttcagtggccggcagcatgaaatacctccaccaccgatttcctaaggggtaggaacaagaaaagggaagcaggaagctctgcttcctgctttggcccttgggttcagggctgcacccagcactatagctgcccagggcgctgacttgaggtcaagggcaaggtggcctcaaagatgatctagagagggcttaactgtgtttggtctttgaaatgtttaaactttctgaatttcagtgctctgaggtaaggctcagataacagccctactcagagctctgcaaggaagggtttctaagttactaaaggaaagaaagtgacagcattctctttgagcagggttgctggaacccctcacacctaggtggttccttgctcctgatactaatggttccactccaaactgctcttcttcctgtctcttcccatcttgggaggatcaatgactctccccagtcctgccacctccctcccagtctcctgaaaagccctcttctttgtgctgtttttccccactcaatctaaatctggacagaccgaactgtcgctcatgttaccccatctccatttcttgtgcaggagcaggagcagacttttcctggaggggggagcaccatctactctatgatccagtcccaggtacctctccagtttctctagtccattccatacctatctctggggtttcctaatgcccccctgaaactcacaccattgaatggcagaataagatcttggtgcttctagaatccagaagatagcttggcttcagttgcattaacacattatttgaaaagatccgtgtgatactagagcatcttaacacagctgggaagcctgatgtggacattccttcttcttccgtgtctggcagaaggtctggcccagataaagtctataggagcagaaacctggttaggggactcaacttctgctttcttgccctgctgctgcttctaatacttggggcccttgcactttttatccctattccctattatattcgttttcaggaaagaatgaatctgcattgatctcttttattttattatgacttagcaataatgtccattttcttttcttttaaaacaattttattgtttagagacagggtctctttatttattttttatttccataggtttttttgggaacaggtggcatttggtgtcatgagtcagttctttagtggtgatttgtgagatttttggtatacccgttatgagacaggatctcattctgtctaccaggctgagtgcaatggtagaatcatagcttactgaagccttgaattcccggcctcaagtgatcctcccacctcagcctcctgggtagctaggtctgcaggtgtgtaccactgcacccagctgtattttcttactaaatctcacataacagcctcatgaaaatagttctaatactttagatgtggtctacattccatatcacaatgaggaaaccgagactcaggtcaactgatatctcaaggctacatagctaggtagtggcagagctgagccaaagggtttctgagtctccattgcacctcctcatactccacctcttatattctgggattacagaaattcactcataaactggagaagcatcctttaatactgatggctaaaatgacattgataacccaggctgggacatctctcccaagggaaacactgcctcctggtggccagtaataaaagactttctgataaaaatggctttaaaaaaaagaaaaaaaaaattgagcaccatcttcagtttggtggctgagctgtggggcaaagaaaatctgattataagagcggttgatatctgccagttctctagtttcagccacattgaactccaatgagaggaatttctatcagtgcaagaaagaggtcccctcaaactatggtgttgggtgagaatgacagtcctcctctggagcatcttaaaaggagaatgtttacctgatttagaggacacctggttccagtccagggaagggaggcaagttgccaaagggaggcattgaggtgttgaggaaagagccctggagagtcttgggtttgaattctgcttctactgtgtacgcactgcctgacttgggctatttatccttttggagcctcatttgtggcatggggcaaattatgatcattcttattttataggagtgttaaaagagttagagaagaggccaggcgcggtggctcatgcctgtaatcccaacactttgggaggccgaggcgggcggatcacgaggtcaggggtttgagaccagcctggcccacatggtgaaaccctgtctctaaaaatacaaaaattagctgggcatgatggcaggcacctgtaatcccagctactcaggaggctggggcaggagaattgcctgaacccaggaggcagaggttgcggtgagccaagatcgagacattgcactccagcccaggcaatagagcgaaactcttgtctcaaaaacaaataaacaaaaaaacagttagaggagaatacatgtataagataaatgctcaacaaatagaagctttcattaatgacagagcgagactagcactcaggttgtctgacctcctggctagtccagggctcttttcactaacacttgaagcttccatctgggcagggttgaggaggagaaacggaagagataacctttgtaagattgtgctggatctgtgcttctgaaatgattttatttctcttctcattagtcttctgctcccacgtcacaagaacctgcatatacattatattcattaattcagccttccaggaaggtgagcctcttcccgtggtggtggtggggtgttgttgatgtagatgtgtattttgcatgtgtttgcagtgagagtgtgtgtgcacatcctggcaagttgttctttattgtgtgtatctgagtagcttctgttaaatgactgtatttaaatgtcaatgggccaatgagaaatgccttactggttctgtctggagaaaaataacagcttctagactaagagaacagtagactagatgagtttttgggagtttctgtgggaggtaaaggacagtcagagacagaaaggaggtgctttgcacagagagactacggggtacttagtaggtcagctgaggctatggtgagagatactggaggggtttgcaaggcagggcatattgcctggagctggaggagtagactggatctagagagacacaatcttgaccttcagagaccagagaaaggtcctggccagtcagtcacctgctggtggaggcctctggactgaggcaacccatccttttgcactgaaatccttctccaagctgagttcgtagctctcttgtgtacttggaaacagagttgggtatcctggtacacatggtcattgtttttctcttgtatggaaggggatgggaagagtggtgttcccaaggctggagccacagtgtgaagccagaaagccttaacatggtagtatgggaatttgggagtccacacaactgtggaagtccatgcaggtcagggaccacaggtttgaaggggtttaggacagattttcagacttttcattcaacctccttccaataagccattcaacctacttggatcccatcgtgagagagatttgtttttaattatatgctacaatataaggccatatagatgttcacaggcaccatgttcacctgctttggtgtatgtaaactctatatgctactgaatgtgcctctgaattctagtgtccttgggttggcaattatttatatgcctggattgtttacattaagggtgtgtgtatgcatgcgttgaagagatacatggtttggggcagtatttgcattaggattgcctgagggatatgtgtgtatgtgtatgtgtatgtgtatgtgtatgtgtgtgtgctctgggaatgtgtgtgtgtatatatatacacaaatatgtatatatatgtgtgtgtgtatatatatatatatatacacacacacacacatatgtgtatgggttttaggtgtatgtgggtatggaacagcaaattctgattttggttcagaaatatcatattataggcaaatactgtatatattgtgtcttccctggagaccataaacaccattgttttgctcctagggtgacagattctattcattttctggctgagagtgcctcagaatttttctgggccctgagtctcttttgggacctctcacatcacttaggagtgggagagcacttatctcgaagttaagtattctttaccttctgaatttctagtctggatccaggaagaggaaccacagcccttccttcaatagcactatctatgaagtggtaagattctggaactcctcaatgggtttactgtctgttgcatagccctgaaatctagccatgaaagggtacacttaggaaaagatcattcacacagtctcagagttgtagggaatttagagatcttctaatgcaagtctttgttttagagatgaagacactgaagcccaaggagagtgagggtctgacccaagatcatattgcgtgtttagatatgatacttactgggcagcttgggttttaaattagggccgtccccgagctagttcccaggctgtgggccacaaactggacatctctcctttccaagagtgttcggaggaggggtcagagaggggaagataaaggactctaaatgattttctaaaattagcaagtctttgggagccattccaggacataggtgagcttaatcttcttcaggggtcaacactgttcagagatgaccactgagcctggtggttgaattgattcccatcagagcatttagggactggaaaggagggactcaacatttcttgggggtttattatggataaggtagcctgccagtgtcttcacatggattattttatttagtcctcacagaatgctacaagataggtataattatactttccatttatactcagagaaattaaggcatggagagcatcccccaacctcccccactacccattagcctcatactacacctgagcctccccacctgtggtccaataaagatgctgccattggtcagaagggagggatgggtggctgcctgctggaattcctggcacttcagctatcacccaacattaaagccaactggacaacccagggtcatagagggcactgtgtagacccaggtagcttgtgaggtcatgaaaaagcatatgtggttaagagagtactggaattggagccagaagaactagattcaagtccctcctgcacttcacactagtcgtggatcctgagtaatttgttttgtcactctgagcttcattttttaaatctgtaaaatggggatggcaagtcatacctcacaggattgtgataaggacctcccagtgcaagggtctgaagtttctccttttcttttgcagattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctaagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctcca

SEQ ID NO: 103 - DNA, 5378 bp, Homo sapiens
cccgctcgtctggcccgcccccctcgccctcgcaggcggtccgcgccactgcctctcagtccctgtcctgcgcccgcgcgccccgggagcctacccagcacgcgctccgcgcccactggttccctccagccgccgccgtccagccgagtccccactccggagtcgccgctgccgcggggacatggtcctctgcgttcaggggtaagcgcggctctctgcccccttcccggccaccacgaggggcgcacgggagaacaggggcttcgtgctagctgccgggcattgggagggcttgacgggccagaggtgactgagcgcagacggacctcaggagcaaggctctgtgtggggctgtgacactcccactccccgcccccacacacttacctcaattcccactgtggattgggaaaccgggggctggccggctaaaggaggaactcacagggtgggctcagcctgggttctcattggagcagatggatgctaacggcacggcgtcccccaagatgtggccaacaatcccagatattcttctgggcccagagcactctacgctagcctgcctgctgccctgcctgctagtaaccttggaccagcccctggccccctctgtcctggtgtcccctctcctgccccaggctagcaagtaggctcttcttgggaagccagccgcagatccttgcctttcctcaggctggcacctgatggtctgcaactctcgggaggccctgggtttggcctggtcctgcttggggtacccccacaatcgtctcacaaccctgtctcagcccagtctgggatcccaatgtgagaaggaccttggctcctgcctctcatcttcaaatttcccagacttgaggtaagggacagtggagaggggatgctgataagacagagtcttgacctgagctgagcattcctggccatccactctgtcctgaacctcagcaaccccttcaaccaaagggtctgatgctggccatggtgatgtgacaggagctcaggaagctccaaggagagaggaagaaggtataaatgggtgttctgcactcagggaggactgggtggctgtgcttatcgcaactggcctggtgccaagtgagggagggtggaaggtgaggccaaggaagaggacatggaggtgctgggaagactacttctcccttgctgtctccagcaagttccttcctcctgtctgcattctgggactcctgaatacctgccccaccactgccttccaccccaggagcctccccctgcattccggggtcccatagcctctttcactttttaccctaggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccaggtacacactcaccaggagcttgtggtgatcaacacagctattcatacacccagctaccacatcagccccaaaggtgcccacacctacatgtgggatctgaggaccggctaagctatctggacgtggccacccacagaggttccagcctgactggctagccaccaaccatgctcctgggaaggtagctctgggccccagcaagcaggtcatctcaaaatttggcctccagctctccaagagggatttccaagatcccacagtacagccagggtaggtgtggaaaagtttttgtcaggctgtggtgtgccagagttgtgtggccctttctcactgtgagtggtcatagggccatgatttgttagaacctagagggtcacctataacctacacaggagtcaggtctggctcctgccaccagctcctgcctgcgccttcctgcctcacaagcaatactggcgctgtttgcccatgctgtcctctctacctggggtcccttcccccagctccttcctttggcctggaagacacagctcaggagcaagcagaccctgactcccccgtgacacctgcagttttatgactttgcattataattactcttagtgtcatcttccccagccagtctggttctccttgagggcaaggccatggtttcattatggcggtgtcctgaggcccagccagggactagacccagaactaaggcttggagatgtattttgcaaggagtgagggaggagcagctgtcttcctggggaagtagagccagtccctgctgccctcccaaggaggaagccctagtatcaccctgctgggtgggcttcccctaggagaaagctgctactcagattttggtcggctcagttcccccaaccccagccatccaagaatatggtgttactgaacctctcagtgcatgggttggtgggaccctttattgcggaaaagggaaactgaagcccagtgaagagcaagctttgtacaagatcgtagagcctggtagggctggcttgccagggtgggaactggagtgtggattaggtccctgcccttggtgggagctcatactgacaggaggtgagacttgccagtgcctttagaggccactgtccaccccagaccctccactgggagaagcagaggccaggataggctgacttgtatgggtaggggattatttcagtctctaagtcctggccagtgtggacctaggtccctctgagagacactcctatccatggggaggtagcgtgtgacctcaggcagcctaccataatcctggggcttctctggaggaccccacacagatctatcataggataaatctacttgtctgtcgtagatctatctcaactaggaccattcatcagtgggccatttaatcagcccacttcagccaggagggcacaaacatgaagctactttgcactgaatcctatcagtgtggtgagaacattagacatgcctatagggaatgatctgtgtttttggttgatataaaatagagagcaattaattactgtttagtaaatgcagggcagtggaaaagaatctttcaaaagaggatccccacatggaaacaatcaaggtggcttttgtgatgacaagtggggaacgagatactggactaactgagcccatggctgggtagaggggaagctgaggctcatagtgagatgggccagccagaggtcatgaaactagtctggggcataggggggtctctggagatgggggaagcatgggtcctccactcactgctcatccactgccttctagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggtgagtctgaggggggaggcaggccttttcctgagtagtctggtgggagaagcttagttctgcctttgagtctgatttgggaggcatagcccggcccaggagagtctgatgggagaggcacagccctctctagggaagcgtgaagctggaggcactgccttgacttgcactggattggttaccccagctaatttccactatgtcccttggccccctctgcacttgcctaggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccgccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgtacagagccctcaatggggccgattttcagttgtgta

SEQ ID NO: 104 - DNA, 40524 bp, Homo sapiens
ggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtggtgagcagctcggcctgccggccctggccggttcaggcccacgcggcaggtggcggccgggccctgaggcgcgggatccgcagtgcgggctcgggcggccgggcccagggaaccccgcaggcgggggcggccagtttcccgggttcggctttacgtcacgcgagggcggcagggaggacggaatggcggggtttggggtgggtccctcctcgggggagccctgggaaaagaggactgcgtgtgggaagagaaggtggaaatggcgttttggttgacatgtgccgcctgcgagcgtgctgcggggaggggccgagggcagattcgggaatgatggcgcggggtgggggcgtgggggctttctcgggagaggcccttccctggaagtttggggtgcgatggtgaggttctcggggcacctctggaggggcctcggcacggaaagcgaccacctgggagggcgtgtggggaccaggttttgcctttagttttgcacacactgtagttcatctttatggagatgctcatggcctcattgaagccccactacagctctggtagcggtaaccatgcgtatttgacacacgaaggaactagggaaaaggcattaggtcatttcaagccgaaattcacatgtgctagaatccagattccatgctgaccgatgccccaggatatagaaaatgagaatctggtccttaccttcaagaacattcttaaccgtaatcagcctctggtatcttagctccaccctcactggttttttcttgtttgttgaaccggccaagctgctggcctccctcctcaaccgttctgatcatgcttgctaaaatagtcaaaaccccggccagttaaatatgctttagcctgctttattatgattatttttgttgttttggcaatgacctggttacctgttgtttctcccactaaaactttttaagggcaggaatcaccgccgtaactctagcacttagcacagtacttggcttgtaagaggtcctcgatgatggtttgttgaatgaatacattaaataattaaccacttgaaccctaagaaagaagcgattctatttcatattaggcattgtaatgacttaaggtaaagagcagtgctattaacggagtctaactgggaatccagcttgtttgggctatttactagttgtgtggctgtgggcaacttacttcacctctctgggcttaagtcattttatgtatatctgaggtgctggctacctcttggagttattgagaggattataagacagtctatgtgaatcagcaacccttgcatggcccctggcggggaacagtaataatagccatcatcatgtttacttacatagtcctaattagtcttcaaaacagccctgtagcaatggtatgattattaccattttacagatgaggaacctttgaagcctcagagaggctaacagacataccctaggtcatacagttattaagagaaggagctctgtctcgaacctagctctctctctctcgagtaataccagttaaaaaataggctacaaataggtactcaaaaaaatggtagtggctgttgtttttattcagttgctgaggaaaaaatgttgatttttcatctctaaacatcaacttacttaattctgccaatttcttttttttgagacagggtctcactctgtcacctaggatggagtgcagtggcacaatcactgctcactgcagcctcgacttcccgggctcgggtgattctccccaggctcaggggattctcccacttcagcctcccaagtagctgggactacaggtgcgcaccaccatccctggctaatatttgtactttattttatttatttatttatttattttttgagatggagtttcgctcttgttgcccgggctggagtacagtggcatgatctcggctcagtgcaacctctgcctcccgggttcaagcgattctcctacctcatccccctgagtagctgggattacaggcgcctgccaccatgcctggctaattttttgtatttttaatagagacgaggtttcaccatgttggccaggctactctcgaactcctgatctcaggtgatccacccgccttggcctcccaaagtgctgggattacaggcgtgagccactgcgcccggcctaatatttgtattttttgtagagatggtgttttgccatgttgtccaggctggtcttgaactcctgagctcaagcgatctgcccgcctctgcttcccaaagtgctgggattacaggcatgagccaccgtgcctggcctaggtagacgcttttagctttggggtgtgatgcctgccccagtatatagtgaatttaattattgctagagctggctgtttgttagttttctttgaacataagatactcattgtttttagtttgcaaatccctcttcctttttaaaaaatttctttcccttaaattgtttgcatgttagcaataacaaatgcttaaatggtgctatgtgctagatactcttctaagccctgttatgtatattaactaattttttaaattacacaaatcagagaggttaagtaacttgcccaagattacccaacaatactaggatttgaacctaagtttgtctcaccccagattctgctcttaatctctaaacttttaagttagtagtgacaatagtaggtatttattgaatacttaactatgttttaggcgttgaagtaaatattttgcaggcattatctaatgtaaacaccctaaagttacataacaggtaccctttaggtaaataaacactagtatgaccttggaggcacagatagttgaagtaacttgcccaatatcacttacatgaaattggccctcaaatgtgtctgatacaacccatgctgcttgtaactatcgttttaaactgccagggtaaacttggacacacttgagctaagaaaaagcttttagatttttgcaaattaatgtgaaagatatgctttatgtggatataatatcttctaaatttcggggatggtagtcctagaaatgtaatcctgccctagccgagcttaccctgccaataattttttacagaattggtaaaacggagcaccttttttttgtccttggccacactgttatcaacagggtgtagattgacatcaatctgtaggtgtaaaccagaattactctttgtgaccaccaggaaatagagcagttcagttcaggggtttctttctgtgaatttagcactgtgacctgcatactacaagtctactttgttttctatccattgtttgtatctgggtattgcaaaaggtaggaaaaggaccaaccagatcagcagagaagagttgccttggagttttcttttagttttctgcagttcattagatagtaactaggccatgtcattttactcccttgtagtgaagatatgttgaagttgtactggtatactcttctacctttctgtaattttatattgtgtagacttgataaaatttatgtgtcaatcaccaccattaatatcaatattgagcctcaattcttatttttctgcccagtggctgccaaattactaacatttacaataattcactactactaagataatctactagttcgatcacatacttcaaattgttatggaactactgtcttcagcattgtgcttctgataactgataagtataattttttttttgtccagagtgaacatgtctattcttccactgtacacactaataaaaggaaaaattgtaatattgggtaaattcatgtccttacacatgtagtagttatgagcccatgtccctagaatgagtaataatttatccctcccttggttgaatagtcaagaatgctgattttaattcttctaacagctttatccctcagaagggaaggcaagcaagttatatatgtagtttatttgtaagactgatatgaaattggaagatgaatctactattagctttaattatttttacatttaggaatattgcatcagtaactcataattttggttttctgttatcctgagttaacacaaattatccaaggagatggcggatcatctgctttgaggtgtttttttttgagaattttaatgtatctgaatataaaaggtaaaaatatgccaactagcaatttctgcccattccagaagtttggaaatattactcattactaggaattaaataaaatatggtttatctattgttatacctcttttaattcacatagctcatttttatcttttatttttgtttgttttttttgagatggagtcttgctctgtcaccaggcaggagtgcagtgatgcaatctcggctcactctagccaccgactccctggttcaagcgattctcctgcctgagccttctgagtagctgggattacaggcaggcaccaccacgcccagctaatttttgtagagacaggatttcaccgtgttggccaggatggtctccatctcctgacctcatgatctgcctgcttcggcctcccaaagtgctgggattacaggtgggagccactacgcctggcccacatagctcatttttagactcacttccattaagtcttgtttggacccacgaacattgtctttttttttttaagatggagtttcacttttgttgcccagactgtagtgcaatggtgcaatctcagctcactgcaatctctgcctcctgggttctagcaattctcctgcctcagcctcccgagtagctggaattacaggcgcccgccaccacgcccagctaatttttgtgtttttagtagagacggggtttcaccatgttgggcaggccaggggtgatccgcccacctcagcctcccaaagtgctgggattacaggtgtgagccaccgcatctggccaacatgtcttttttttttttttcctttttaaccacaaagagacttaagcagtccttgtcacagatgatgaattgatgttgcaagtattgtcttagcttggattaattttcttgcttactgtaattttagataatatagctttgtaattagagattttatgtgtaaaccacaaaaatgtttacatgaaggccattattacagatgtgacgtgcataattattagtaatttgtatgtttacatgggtcagtctggcaaaaaattatgaagttttaaaaattaaaaaaaattataatgccagttttactggaaagtaaaattatttcagtaatcgattatagcaaaagtattgattttcattccagacaaaagtcagaatgaaaggtaatttctcaatactctttcagattaataaaagtacctgtagcgatttttatcattcacaagtatatcacaagtaagttagaatttgagaactgtgttctagatctctgaggagatgcagtcagatttctgaactgtctcagcaaatggtaagtaacttagagctagtaattaataacctgtcctttgatttctgattcagccaagaatggccatatttgggaaaggcagatctggagagtaaccacgttttcattcatttaccacttctaggcccctccagagctctcagatattttggggttgagcccttccccaaagccatacaggaccttttttttgtgatctgttctagccatttttatgttgggtgcttgttatggactgagcatttatgtcctcccacaccccccccataccttttttgaagtcctaacccccagtgtgatggtatttggagacagggcctttggaaggtaattacagttagaagaagtcgggagggttgggcccaggtctgattggattagtgcccttatatgaaaagacaccaggacgggcgcagtggctcacacctgtaatcccagcactttgggaggccaaggtgggtggatcacgaggtcaggagtttgagaccagcctggccaatgtagtgaaacaccatctctactaaaaatacaaaaattagctgggtgtggtagcgggctcctgtcatccaagctactcgggagggtgaggcatgagaatcacttgaacccgggagttggaggttgcagtgagcccagattgtgccactgtactccagcctgggtgacagagtgagactctgtctcaaaaaagaaaaaaaaaaaaaaagagacaccagagagcttgttagaagaggtcatgtgagcacacagttagaagaccttcaagccaaagaagaggcctgagattgaaacctaccttgcaggtaccttaattttggacttcccagcctccaaaactgtgagaaataagtttctgttaagtcactcagtctgtggtattttgttatggcagcctgagcaggtagttgttctttcagaaggtgttgataataaccacatgcaacaccaagtcacaaataataaaacagatgtaacttatattcatacagaaagttgggcactgccattgccttgttggtttacacggctgtgctagttcagtagcagaaaggtgctggtctcctttactcagtttacaatctaggcagtagaatgtaatcactgctttaaacttgatactgcttagggagagaatcattggtgctgggtaactttgggttctaggtttactttttgtgtatatataactgtttttggtaaatcacaagtttctgggcttgtcgaattagattttgttacagattatgagctttattatgctatacagttagttgtatgtatatatgcctttcccactagattttaagctttttttttttttttttttttgtgacggagtcttgctcttgtcgcccaggctgaagtggagtgcagtggcacaatctcggctcactgcagcctccacctcctaggttcaagcgattctcctgcctcggcctcccaagtaactgggactacaggcacgtgccaccacacccggctaatttttgtattttttgtagagacagggtttcgccatgttggctaggctggtcttgaacttctggcctcaggtgatccacccgcctcagcctcccaaagtgctgggatttacaggcatgagccaccacgcccagctataagctctttaagggttgtaaatttataatcattcttttactctcctgcaaattctgttgcacactgccttaatcaaggtagatgctgaatgcatttttgtataattgaatatgttgcaatccccaactctctccaactgttcctgtcaaagcagccactggattgttaactaatccatattagatggggttaattaatatcagatgggacaagtaagggctaataagattataggccaccaagtagatttctgtctagctcttatagagattgagtttattggacctgtttgataggaagttttggtgtttgggatgattaaaactgaagttcctatttattgaattatacctatttatattatttcatatcagtggtccacatgcaagtgaggcttctgagacagagtttgagttctctcttcaactaccataacacttaacctgtatctttttttttttttttttttttagacggagtctcgctctgtcactcaggctggagtgtagtggtatgatctcggctcactgtaacctctgcctcctggattcaagcagttctccatgtctcagcctccctagtagctgggattacaggcctgtgccaccatgcctggctaattttttttttgtatttttagtagagacggggttttaccacgttggccaggctggtctcgaactcttgacctcgagcgatcaacttgccttggcctcccaaagtgctgggattacaggcatgagccacagcgcccagccgtctttttttttaaatagcaatttaacactgttcacagttactcatgtacatgtcatgccatctattacactgtaagttctgtgagggtagctgtatcaaatttatctaactctctctagtatgcatgacatagtaagtattcaataaatatttgcatattagtgataaggatacaggttctgaatagtgggtccttaccatttaagaattagtatttgatggccgggcggggtggctcacgcctgtaatcccagcactttgggaggctgaggcgggcggatcatgagatcaggagatcgagaccatcctggctaacatggtgaaatcccgtctttacaaaaaaaatacaaaagaattaaccaagtgtggtggtgggtgcctgtagtcccagctactgctttgtgaggctgaggcaggcagatcacctgaggtgggaaattcaagaccagcctgaccaacatggagaaaccccatctctactaaaaatacaaaattagccgggcgtggtggcgcatgtctgtaatcccagctactcgggaggctgaggcaggagaatggcgtgaacccgggaggcggagcttgcagtgagccaggatcgcgccactgcactccagcctgggcgacagagcgagactccgtctcaaaaaaaaaaaaaaaaaaaaaattagtatttgatatttgatcattaaatatgaattaagaggacttagactttttgttaaatgtcaagctgggaaaagttgtcatttaaatgaattgcctcttatttaatttcgtctgatgatacattttgtttttattttgtaaaaaattattttttttctttttggagacagggtcttgctctgttgcccaggctggtcacaaactcctgacctcaagcaatcctcctgccttagcctcccaaaatgctgggattacaggcgtgagccacctcgcccggccttgtattatgatacattttgaacaactacaagtagacttggtataatgaacctgcacgtacccattgccaagttctgacaactgtctgtctatagccaattatgcatttcttaaattagaacccccccaatatacccaaatatatatatatgtgtgcatatatatagtaagttgtaacaaagttgtgaattcatacctgaagtatctcaagtgatgcaagttttatgaatttttgtttatgccttttgggaagagttgtattgacaaattttttatgcttaaagtaaaccataaatcaaaaaaataaaatctaggatgcaataaaacaaaacaacttcttgacataagtatggtatgtaaatctgttttgattggaaatcaatttgttatattgccagaattcctgttttagaatacatctctgctgatctgtctgtattcttagactgcatatctgggatgaactctgggcagaattcacatgggcttcctttgaaataaacaagacttttcaaattcttagtcgatctgcagaacctgtagccaggcactgaaccattttgatagatgcagtaatcgttgcaagtgtatatttcaaggagttctggctgggtcctagtttatgcttgtggcagaagcagtgagtaactgggaggaagttggtgagtaagcttcaaggaagaagtcatttttagtactctggatcttcctgattttaaagcactacaaaatggtgcattttcattcttgtcaagtgataacagatatattctgatgagcctgaaatgaatatatattgtatcatttttataatatctagcaaggtttgtattttcctagaacttgaactaaatttcagttcataaaatttataaaatacttagttgttgtaaaatatttttggaatgttcacataggtgacacacaaatgtcccattttcattctttctatagtaaatatgttctgatatgtgaaggtttagcagatgcatcagcatttaatcctagaggatctggcataatcttttcccccaagaatagaaattttttctgcttatgaaagtagtacatgtttctttaaaaacaaatcaatattgacttctgcctgctgtatagcactatgcctccacctggccatgaccaggggcatgtcctggtccacctacctgaaaatgtttgcaaccagcctcctggccatgtgcacaggggctgaagttgtcccacaggtattacgggccaacctgacaatacatgaagttccaccaaagtctgagaactcagaactgagctttggggactgaaagacagcacaaacctcaaatttctcagcactggaaacctcaaaatataactgaattccataaataagattttaagtcttaaatatgtatttttaaatgtattaaaagtcaagctgcttgtatttaagcacctaatacaatgcttaggttgtaaaaggagatgctcaataggtactaactgatatattgagatttaattatggtttgaccaatatttattggaaaccgccaaagcttaaatcatcagcttcttgaatgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatattaaagtgtagaaagtgaccaggcgtggtggctcacacctgtaatccaagcaccttgggaggctgaggcaggaggatctcttgatcccaggagttcaagaccagcctgggcaacatagcgagacttcgtctctaaaaaaaaaaaagagagagaaaaaaattttttttatttaaaaaaagtgtagaaagtgtcaagaccccacttcttaccattatttggtatatttctctatacccacccacccttcctccttactccctccctcccttcccaatctttttatctttttgtattctgattttttgtttgtatattttgctttaatttaatgtatcctttaaaaatttcccatacattttatatgtatatataaaaacgcatgctgccaaagataatttataagaaagaccattgaatttttttaaaagtgatatatattcattgaaaaaaatttagaatatatagcaaagcaataaagaactaaataaaattgctgtaactcctctttcaaagataagtgcttttatgattttgttgtatttttttctgtatataggtacatatatagtatttataaagctgtactcatagtacattttcacatcacaggtaccatatcagtgttattaaatattttgtatgccaggggctagacataccaagacaaccaatatgtggttctacttaaataatattagagtatcttttatgatgacacttcatgagttgactataataatcttagacttctaagagtttgggttttcaaaagatcacttagcttttttgggtgatttttcccccttactgtgagatgagagaggctgtttggatttgggattggggtagcggggacagcaacttttcttttctttttcttttttattttgaggtagggtattgctgtgtcacccaggctggagtgcagtggtgtgatctcggctcactgcaacctccacctcccgggctcaggtgatcctcctgcttcagcctccccagtaactgggactacaggcgcgtgccacatgcctggctaattttgtatttttagtagagatggggtttcaccatgttggccaggctggtctctaactcctgacctcaggtgatacgcccacctgggcctcccaaaatactgggattacaggcatgagccgctgcatcagccagcagtttttcttgtggttttttttgtttgttttgttttgttttgtttttgagatagggtcttactctgttgtccacgctggagtgctgtggtatgatcgtagctcactgcagcctcaaactcctgggctcaagtgattccttctgcctccgcctcccgagtagctgggactacaggtatgcaccaccatacctggcaaatttttacaaagttttttgtagggacggggtcttgctacattccccatgtcggtcttgaactcctggcctcaagcaactctcctgtctcagcctcccaaagcactgggattacaagtgtgagccaccacaccatgccagtttttcctgttcagtgtgatattttatcttgttagactacagtgtgttaaaacttgttttactaaattttcaaacatactcaaaagtggagagaatagtataatgaatacccgtatgttcatcacccatgtttagaatattattaaatataaagattttgctgcgtttgtcttagctctttaaaatttttctttttctctttgtgacctaaaggaaattccatatcttatcactttacttctacattcttgactaagatgactaagacatatagttacatggttttttgttttgttttttgttttttaaagacgaaatctcgctcttgtcccccaggctggagtgcaatggtgccatctcagctcagtgcaacctctgccttctgggtacaagcgattctcctgcctcagcctcccaagtagctgggattacaggctcctgccaccacgcctggctaatttttgtatttttagtagagacggcggggggaggtttcaccatgttgacaaggctggtctggaactcctgacctcaggtgatccacccgcctcggcctcccaaagtgctgggattacaggcgtgagccaccgcgcccagcctgtttttttgtttgtttgttttgttttttttgagacagagtcttgctctgtttcccaggctggagtgaagtggcgcattcttggctcactgcaaccttcacctcccaggttcaagtgattctcctgcctcagcctcccaagtagctgggactacaggcatgtgtcaccacacccggctaatttttttgtatttttagtagagacgggatttcaccgtgttgcccaggctggtctcgaactcctgagctcaggcagtctgcctgcctcagcctcccaaagtgctgggattacacgtgtgaaccaacccgcccggcctgttgttttcttacataattcattatcatacctacaaagttaacagttactaatatcatcttacacctaaatttctctgatagactaaggttattttttaacatcttaatccaatcaaatgtttgtatcctgtaatgctctcattgaaacagctatatttctttttcagattagtgatgatgaaccaggttatgaccttgatttattttgcatacctaatcattatgctgaggatttggaaagggtgtttattcctcatggactaattatggacaggtaagtaagatcttaaaatgaggttttttactttttcttgtgttaatttcaaacatcagcagctgttctgagtacttgctatttgaacataaactaggccaacttattaaataactgatgctttctaaaatcttctttattaaaaataaaagaggagggccttactaattacttagtatcagttgtggtatagtgggactctgtagggaccagaacaaagtaaacattgaagggagatggaagaaggaactctagccagagtcttgcatttctcagtcctaaacagggtaatggactggggctgaatcacatgaaggcaaggtcagatttttattattatgcacatctagcttgaaaattttctgttaagtcaattacagtgaaaaaccttacctggtattgaatgcttgcattgtatgtctggctattctgtgtttttattttaaaattataatatcaaaatatttgtgttataaaatattctaactatggaggccataaacaagaagactaaagttctctcctttcagccttctgtacacatttcttctcaagcactggctatgcatgtatactatatgcaaaagtacatatatacatttatattttaacgtatgagtatagttttaaatgttattggacacttttaatattagtgtgtctagagctatctaatatattttaaaggttgcatagcattctgtcttatggagataccataactgatttaaccagtccactattgatagacactattttgttcttaccgactgtactagaagaaacattcttttacatgtttggtacttgttcagctttattcaagtggaatttctgggtcaaggggaaagagtttattgaatattttggtattgccaaattttcctctaagaagttgaatcattttatactcctgatgttatatgagagtacctttctcttcacaatttgtctcttttttttttttttttgagacaaggtctctgttgcccaggctggggtgcagtgcagcagaatgatcacagttcactgcagtctcaacctcctgggttcaagcgatccttccacctcagcctcctgagtagctgggactataggtgtgcgccaccactcccagctaatatttttattttgtagaaacagggttcgccatgttacccagcctcccaaagtgctgggattacaggcatgagccactggcccagtttctacagtctctcttaatattgtatattatccaagaaatttcatttaatcagaacctgccagtctgataggtgaaaatggtatcttgtttttatttgcatttaaaaaaaattatgatagtggtatgcttggtttttttgaaggtatcaaattttttaccttatgaaacatgagggcaaaggatgtgttacgtggaagatttaaaaaaaatttttaatgcatttttttgagacaaggtcttgctctattgtccaggctggagtgcagtggcacaatcacagttcactccagcctcaacatcctgcactaaagtgattttcccacctcacctctcaagtagctgggactacaggtacatgctaccatgcctggctaatttttttttttttgcaggcatggggtctcactgtattgcccaggttggtgtggaagtttaatgactaagaggtgtttgttataaagtttaatgtatgaaactttctattaaattcctgattttatttctgtaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtgtgagtatatttaatatatgattctttttagtggcaacagtaggttttcttatattttctttgaatctctgcaaaccatacttgctttcatttcacttggttacagtgagatttttctaacatattcactagtactttacatcaaagccaatactgtttttttaaaactagtcaccttggaggatatatacttattttacaggtgtgtgtggttttttaaataaactccttttaggaattgctgttgggacttgggatacttttttcactatacatactggtgacagataccctctcttgagctacatcggtttgtggggagtcaaaagtcctttggagctaggtttgacaaataaggtgggttaacacttgtttcctagaaagcacatggagagctagagtattggcgaattgaagaaatccccctttttttttaacacacttaagaaaggggactgcaggtatactcaagagagtaagtcgcaccagaaaccacttttgatccacagtctgcctgtgtcacacaattgaaatgcatcacaacattgacactgtggatgaaacaaaatcagtgtgaattttagtagtgaatttcattcataatttgatcgtgcaaacgtttgatttttattactttagactattgtttctgattttatgttgggttggtatttcctgtgagttactgttttcctttaaaataggaatttttcatactcttcaaagattagaacaaatgtccagtttttgctgtttcatgaatgagtcctgtccatctttgtagaaactcgccttatgttcacatttttattgagaataagaccacttatctacatttaactatcaacctcatcctctccattaatcatctattttagtgacccaagtttttgaccttttccatgtttacatcaatcctgtaggtgattgggcagccatttaagtattattatagacattttcactatcccattaaaaccctttatgcccatacatcataacactacttcctacccataagctccttttaacttgttaaagtcttgcttgaattaaagacttgtttaaacacaaaatttagacttttactcaacaaaagtgattgattgattgattgattgattgatggtttacagtaggacttcattctagtcattatagctgctggcagtataactggccagcctttaatacattgctgcttagagtcaaagcatgtacttagagttggtatgatttatctttttggtcttctatagcctccttccccatccccatcagtcttaatcagtcttgttacgttatgactaatctttggggatttgtgcagaatgttattttagataagcaaaaacgagcaaaataggggagtttaactttaatattttcttttaaaaagcatttcatgttataagatcaattctgagtggtagaaatgctttgacattttatttccattttctacttttagtttttttcctatttgtttaagatcttagaggattattaagctgaactcctcaactgataaaaagcatgacatcttaaacataagcaaagcatatttttaggttaattttcacatagaaaacagtttattttatgtgaaattctatgtagatatactatttttttggtatttattgatatgtttattttattttattttattttattttattttattttattttatttatttatttttttttttgagacagagtctcactctgttgcccaggctggagtgcagtggcatgatcgtagctcactgcaacctccacctcccgggttcaagcaattcttctgtctcagcctcccgagtagctgggactacaggtgcctgccactatgcccggctaatttttgtgtttttagtagagatggggtttcaccttgttggtcaggctggtctcgaacccctgacctcaggtgatccacccacctcagcctcccaaagtgctgggattataggcatgagccaccgtgcccggccgacatgttaattttttaaaaaaggctttactggggtatattttatataatataataatcacatgttttaactatacaattccaagctttttagtatatttatagggctatgcaaggaagatatactgttaaacagtagaaattgagaaagctcttctgataatatctcttgatttgatgatggctcatgcctgtaatctcagtgctttggaaggccaagacagcagaatcacttgaggccaggggttcgagaccagcctgggcaacacagcaataccctatctttacaaataataaaaatatctgttgatttgaagtaaagtttttttttaaagacaaggtctcattctgtcacccaggctggaatgcagtagcaagatcacagctcactgtggccttgaccttctgggctcaagtgattctcccacttcggcctcccgagtagctgggactaacaggtgtgcaccaccatggctggctaatttttttttatgtttgtagagattgggtcttactgtgttgcccaggctgatcccgaactcctgggctcaagcagtcttcctgcctcagcctctaaaattgctgggattacaggcttgagtcaccatgcccagcctgaagtagcatttctaccctgtttaataattcagcagcttgtcatgtaagatattcatatatgcatataaaacattaggcagcttaatttggtaaaactgtaaaatggaaattttaaattgtttgcagcatcaataacattgatgtcagtatgatttttacatgctgatcttgaccaatttgaaacagtgagttaaaatctggctgatccgtactaatcctaaagaaatattctatgaactattaaatgtttccagaatatataaagaaacattatgatgtcaacacacccatctatttttttttggaaataaaaactccatttttcttattaaagaaaacatgcttattagaaaacatacggctgggtgcagtggcacacatgtaattccagtgctttgggagatcgaggtgggagaatcacttgaggccaggagtttgagaccagcctagacaacataatgagaccccctctctacacaaaaagaattagttgtgcatggtggcgtgcacctgtagtcccagctacttgggaggcagaggcaggagcatcccttgagcctaggagtttgagactgcaggagttcgagactgagtggaatgcagtggaactgcattccagcctgagtgacagagggagaccctgtcttaaaaaaataagaaagaaaacacaactgcagaaaattataaaggatttaagtcattccaaatatcactgccactttttatttagaatattctaaagaattctctctctgtgtacacacacacatatgcgtactcttaatccaagtagcttggtaggattttatttacctagtgcctagatgggaaattgcctggggattccaaatacctatttcattaaattaaagatgtcactgattttaagacttaacactatttttcatactgccaagaaagaaaacactaccagttataaatgtaaattgccatcaattgtaatacatcaattttagagctattattaataaaatgtgaatgtgcatcttagagcaatgaaatatagtactatatatttgatgaccttttctgccctgtgatattcagaaagtgaaagttaaatatgggctgagcatggtggctcacacctgtaatcccagtactttgggaagtcaagacgggaggctggcttgaacccaggagttcaagaccagcctaggcaatgtagcgagacgccatctcaaaatattaaaaataagtaaataagtaaataaaaagaaggttaagtatacaaatgtatttcctttgttgtgaatttatttcaattttatagtgattttttttttttgagacgaagtctcactcttgtcccccaggctggagtgcgatggcgtgatctcagctcactgcaacctctgcctcccaggttcaagctatactcctgccttggccccccgagtagctgggattacaggcgcctgctaccatgcctggctaatttttgtatttttagttgagatggggtttcaccatgttggccaggctggtctagaactcttgacctctggtgatccacccgcctcggactcccaaaatgctgggattacaggcgtgagccaccgtgcctggccagtggttttttgttgttgttgttgttgttgttttgtttttgtttttgtttttgttttgagacaggatcttgctctgtcacccaggctggagtgcagtggtgccatcttggttcactgcaacctctgcgtgggctcaagcaatcctcccacctccctttccagagtagcggggaccacaggtgtgtgccaccacacctgactaatttttgcatttttttttgtagaaacagggttttgccatgttgcccaggttggtctgaaactcctgagctcaaacaatccaactgccttggcttccctaagtgaaattacaggcatgggccactgtacccagtctagtgatttttttatttttatttttattttattttattttatttttttaccaaaaaaacaacaaagcctcaggaggaaaagttgatacacaagtaaattttattggaaatgtttttgtgtggaccttaagcagagggaaaattagtctgcattatggtgtatccagactaaatgactgatattaaaatgaaattattcttaggatttgcaatcttagagaaaactttttcatttttatttttttgagttacaaattatcttcatttacatttgagaacagtgagtcacagagggattaagtaacttactcaagatcatacaagtctttgatttgaacccaatcttttaactctgcagaactcagagtcactcttatttggaaaaactttttaactgatgtggatcctctaatatgggcttcctattattcattctctattagtcagaagttttgcaagcagacagaattcattttgccaattacgggattttccctcagttgcagtcaaggttcataaaactataactctttatctttaattagaaatgtttttttttttgagacaaggtcttgctctgttgcccagactggaatgcagtggcatagtggcccattgcagctttgaactcctgggctcaagggatcctctgcctcagcctcccaagtatctgagactacaagtgcgtgccatcacccatggctattttaaaaaaaaaaaaaattgtagagatagggtcttgctgtgttgcccaggctggtctcaaactcctggtctcaagcaatccttctgccttggtctcccaaagtgctgagattacaggtgtcagccgttgcacctggccaaaacgataacttaaaatacacacacacacacacacacacaaacacatatgtgtatttgtgtgtgtgtgtgtgtgtgtgtgtctcaaaaggtatcaaaagagaatagctataactttagtgttgatcttgatagtgacttgattaggctctgtttaacatcaaagatgcaaattaatactttctttgaacatattaaaaatgcagaaaatattggagtattttattttaaataaattgtattctgtatatttaaggtatacaacatgatgttatgggatacatataggtggttaaaagattactgcagtgaagcaaattaacgtatccctcaactcacatagttacccattttttttttgttttggtggcaagaggagcttaaaatctcatttagtgtgaatcccaaatacagcacaattttattacctatatacttcatgttgtacattatatttctagacttgttcatcctacatatctgctactttgtatcctctgagctacatctccccattttctcacttgccccccaagtagtttcttaaagtgtctcatgtaagagggcagtagctttcagcttaaactttttctctgtatgtagtcgatttctttgaggtatacttttctctccagaatagttagatgtaggtataccactttgatgttgacactagtttacctagaacttatcttctgtaaatctgtctctatttccatctctgtctccatctttgtctctatctctatctgtctatctctatctatctatctatctatctatctatctatctatctatctatctatctatctaaagcaaattcatgcccttctcctatttattgaatcgagaccatagacaggggtgagagaaagaatttggcaggaatggggatgtgtattatctgtggcataaggaaactttacagaactaggttcaaaagtatactttctagttctttcccatggcttttcactttgatgtagtccttatcaggtaactgaggttttatataagtcccctgattcttagaacatgaaggtgtagtagtcaaggttggtcccttgaaaccacaaattttgtgaaaaaaaattaagaaaattgaataatttcctcagcaaatacatattgatcatctgttatacagccatgagaagtggttctgttgcacacgtttattttatcagatcctaatcccaaaccaggcataaaatggaaaccatgaagataggatgaaataacttctgaatgtttgaatgtttgaaaatagtgtacttaaaaataccaggtggtttttgtttgttttttgtttttttctttttttgagacagggtctcactctgtcacccaggctggagtgtagtggtgcaatctcatctcattgcagtcttgacctcccaggctcaggttatctcccacctcagcctcccaagtagctgggactacaggcacatgccaccacgcccagctaattttttgtattttttgtagagacggggtttcaccctgttgcccaggctggtctagaactcctgggcttaagcgatcctcccacctcagcctcccaaagtgctaggattacaggcatgagccaccatgcctggcagaaaataccaggtttttaagtatcagcacttactcttcaatcttttctattactatgttgtgctaaatggtattttttatttaattagagcaatgctgttcaatagaactttctttgaggatggaaatcttttatgtttctgctatgtggtacagagccactagtgacatgtggcttttgagcgcttgacacatcttgtgcaacacaggaactgaatttttaagtaatttatattgccacatgtggctaccgtatgggacagtgtagtactagatgatctgtaagggctgtgcttcatcagtgtcgttttttaactgacaaaaacctttagttttttttttagtaatgtgtttatttaaaagaattcataaaatacaagtaaacaaattaacttgttacctgagcatatgtcctttcatacttattttttctgcatacatattttggaaaatggaatatctgccctttttttttatctgagatacagtctacctctaaaaatacatgattctaacattctcacttttgttggcatttgatcagggtatagaaaaacagttaaaaggacagagaatggttgagagattatgatatgaagagaaaatgtgattgagtgtggtagacttggggcctgcttgaatgttgagagaatgactgttttccgataaaaaaaaaaagtccattctaggatcctaaaagaagggtctgaagttcactgcagaaagcaagctacatagtactaagccactaaggggacatggagcccttagtaattcctaccttagtaatagtctcatcatgccctcttgggaacccagccttgttgattagcctctctgctttctctccttatagttcaacctccctgtttgttccaagcagttcttttcctgcccatttattatgcatttctatacagctttcctcctctttttctataccatgctgcagttcttattgctacctagaggttttcaaaattcctaggggcggataagtaggcataaacaaagttcttccctattatccttcctattttttcacctagactgaagaggtagacaaaatagaaataaagacattaagggtatgtgtttgtagtcccaaagagcttctctggcaattttatgtagttgacagtgacgctctgagttcaggacagattggactccttggctgagaggagtgaggagataggacggtagaggagagggtagagcaactctggaggaagctttcccctcacctttgccagtcctgttatcctagacttaaccataattaaagatgagggaggcactcagtaaagggatctagtgggaagcttgttccagacagccaaggagggaggttcgcgcagttcctttggccacccaggtggggtaattgatccatgtatgccattcatgtacaatgtaggcacttatacctgtattccaatgtagtgaactataccattactcttaaattaatattctttattagcttccatggtggctataggccaggcaagagagttaagaaaaaataaatagccaggtatggtgactcaagcctgtaatctcggcactttaggaggccgaggcaggaggatcgcttgagtccaggagttcaagaccagcctgagcaaaatagtgagatcctgtctctattttttaaaaaagccttggggcaaacaggagtatggaggtttggatgctaatagaacagcagtgtcttactgcttggagttctcttgtttcttgtcctatcaccgtagcctttggatcacagcaatttttccatgactccatacttttcagttcttgaatattttttcctttattcctcttgtctctgtaaagacatcaactggagttggactgtaataccaggtatctccagaagatggcactatttaacagattttataaataatttgatgtgagtcactgtcatctgaagcttgttgccttttctttctttcttctttcttttttttccccatcaattctgtatgtttgaaatgctgggttttaagttagttagaataagggatgtctgtaatttccctaaattgagaagtaatatgcaaaggttgatatcagaagtcatatgctcaccttgcaacaccaaataatactggcccatttgtgatttttgaaagtaacactccataataaatggatgtatatatagaagcataacaaaaatagaagcacataaaagtgaaaagtctcataaacgccattgtcactactcatgtaattgctgttacaaatttgtttaaatgttgaataaaaatggtgtcataggcaacacagtgttccactacttggtgtttttaatagcattattctgtctcagtgtgctttggattatcaggtgctttttaatagttgcatggtattacattgtgtagatgaacttgattaatttaaatggttccctgttaatggacatgttggtttgtttttgtgaacaactgatacagtgaacatttattttttaaataaaaaaaagagagacagggtcttgctgtgtttctcgggctggccttgaactcctggggtcaagcgatcgtcttgcctctgcctccctgggattacaggcatgaagccaccgcacccggcccagtgaacactcttgaatgtatctttgtatacttgtcagtgtttttgtagcattgattcccagaagtgggattactggattaagtgacatgcatgtttgcaattttaacaggtattgctatgtcattttcaaaagaagctatgccaattaatactctcaccaacaagagtgcttatttcccctcagcatattatcaggcttaagttttgccagtatgggtgggagaacagtagaatcacattgttttagtgtttgtttctcagatagatataattttacaccttataaccttctcttctataaattgtctatttgtgttcattctccattttcctatgggttcttattgttggagcccaatatataaaagggggtatttgttacagaacctcttcagttttggttcatgtcatgcctgggtttttaccctttctacggatgttaaaaaaaattctctattttcttccagtccacttatggctttattttttacatttagattttaatccgtctggaatttatttttgtgtatgctgtgaggtagggaccatacttttattttttcccaaatgggttactagttggccaaacatcatttattgaataattcatcttttccctactgactcgaaataccatctttattgtatactaaatcctcatatagttctgggtctgtttctgggctctactttgttcatttactgtgctggtactgcaccgttgtaattgctgtggctttgtggtatggtatggcttgctctctgctagggcaagtcgaagctcttttgttcacctgctctttcacccaaattttctgtcctgaatccagcacagccaaattatggtcattgtcaccaccaactacagtgggtgttgagcatttcccattgaatctcctgtaagggttttattggattctgtgatagcagtaaaatgggagcctaagaggtattccttaaaggactactaatcagacctggtttcccagatgatgctgaagatgacggggcctgggctagacttttgagggacatatccttggggttgggtgtgatatagaccagcccttacaatttgcttgactcatgggaatcgtacagggccagaaccagacacctgtcatgctaataacttccctcacaattcagaaatcactgtgattgaagatgggtggctgttataatactacccacttaaaaatggatgtaacccattttttaggactcttaaaaacatcaaatcagtaatggccgattaggactttttaatttttactaatctctacttgaaagttttctagtcattcatttcaggaaacctaattcttataattcatatcatttagaatatcataatgctatggatattagctagctaacttctcaaatcttctagttctcatttaatttgaagtttgtgtgtgtacataaggatatacatatacatatgtgtgtgtagatatatatatatatagttttttttttttttaactagaatgaccagtcaacaggggacataaaagtaattggtggagatgatctctcaactttaactggaaaggtatgtatcttgaaagggaagaaaaaaaagcacttcataccgagtcaattagtaacagtgtgctttcaatcaatcactaagagataatttacatagtataactaaatgggttatttaacccttggaagcagtctaggttaattatcgttccctaggtcatgtagtaaaaagacagtagaatccaacattaaccttaaatgtccatattgtcaagtactgctgtctgcctctgtgggactctaatttgggatccttcaaaaaacattgatgggggaaaagatagcctttaaaaaaaaaaaaaaaacaaacctatgtgagtctatgtgaggtagactcacatagtttcctaaaagatagcaaagcagtattatgtagtggctgaaagtgtgagttccggagcctgacaactgattcaaagcatggcttagtacttcctaactctgaccttgggcaagttacttaacctctctgtgtcccatatgtgattagggtgaggttgataatagcagccatagagttaagaggattaagtgctataatgcaagtagagctcttacaacagtttctggtaaatcactcaataaattcagacatactattattttaagaaatctcaaagagttttcttgtaccttaaaattctcctagtgtgaaccattggttttggtatattgtgcttccatgtagtttaatatcaagatgtttttagatttcccttttaatttatttgttgacccattggttgttcaggagcatgctgtttacctgaaaataatggagatattaaggtatttgaatatttatcttctagtacattgaaaaactttttgagagtaaccaataataaatgatggaatgctactgctttttttttttgaagctgccagttattgtttacttacactatgccaaatataaaggcattaatctcataaaagtttcacaacaatcctgtgagggagacgatatccccattttacaaatcaggaaattaagacttaataaggttaaaagacttgcccaaagtcacagaaccagtaagtggtagagcttgaatttgaatacagacctgactctaaagctcttttctttctttagattttagtgttcattgcttacttgaatgagtatctataagaaaactttaacatgtaaaacttctgtgaaattatcttgtcccatatcagggtcatgtcaaactaatgtcctcctcagcatctttggaaaacttcagaggagaaatgagctttgcccctcctgttcatttcatataccactgttagacctgtccttccctttcagcatgctttgtccatatttagaagctgttgaagccattacttgtctggtcagtttttagtgctggaatggacctagccttttaggccttctgagatttagtttgatctcgtctttcccacctaatggctctgttctactacatagatttgatctgaaacagttctctgtttctaaaataactttcttttcatgatagtcacagtaaagtacatttattatggaaaaatcaataagtataacgagtgaaagttatttcttggtggtaagattatgggattatttgaactttctgtttcattgtattttatttatttatttatttttgtgatggagtctcactctgctgcccaggctggagtgcagtagtacgatcttggctcactgcaacctccccttcccagttcaagtgattctcctgcctcagactcccaagtagctgggattacaggcgcacgccaccatgcctggctaatttttttatctttagtagagacagggtttcaccatgttgaccaggctgatctccaactcctgatctcaggtatccacctgcctcagcctcccaaagtaccgggattacgggtgtgagccaccctgcctggcctcattttgtcttttgggggtatttttgtgtgcagatatatatgtatataaatatttttccctcttttccccagttagtatttgagcagatgaactttggacccgaatacctgtattcaagtctctaataccacttcttggctattttcattttatcaaatggcctcttatcctcgtttttctcatttattaagtagagatgtaactacttgatataattcaaaaactcaataatggcattcttttgttttttagactctagtgtctgtactcgttgtaccatgctgggattcatttgaacaattgcatggcttttttagtgtattattaaatttgcagtttacttagaatttactgggacctcatacaaatgggaaaaaaacataactgtgttactcatttgctgtgtgcctttggattgaccctattttttgtattcattttctccccatgtcctgagttccactttgaataaaaagtaatttttttcctgcctgtaaaataggctaccaataggctgcagttgtctatagtagctgcttcactgaggagagctcagcatgagagaaatagtatgaattgcttgccacaagttatgggctagccttacttcattctgtacttggacctgtttaggcttctaagagatcttacctccaacaataaactgctttgagacatgaaaaggtggaagctttacttggttataactttacttttaatacctagaacagtgagtcttcaaacttgtatttgcatgcccaatttataaaaagtttcctgagcatttacccctaatatatgcattttaaattatatatgatttatggtaataataatatatatgttacaaaatacatacaaaaatatagattaaacaaggtgaggtaaaaaatttaaaagttctaatctttcttgcaaaccagtggatcttttgtgccttactctggtaaacactgtcttagaagaatatatagaacattaaaatcttaatgctatagttatatgacagagtatgatgagagctacagataaacaacacatcatgaatcttcttgtggcagtgtttataaccattatgtgaaatgctgcctcattcttataactagcataagaacagataggactttctcgattttgaggggtaattattagatggtattttctgttaaggactcttccagctataaaattcttaaatgtagaaagcgaagtgagggtttatggtgagaggaagcattggtatcatgttttagtgtagtccaagaatatggacacatccagaaaatgcagatcaagtttagcctaatgagaaaatatattttggagtccatatggtaaattaaattatgtgatttttgagttattgtacaaatataattcttagaatgttagagtcaggagactataagagaccaactgcttcaagtttcatttaacacatgggaaactaaggccagagaaatttcaagacttgcccaagattagacctcttgttaagtaatgaaagtgttttaaaaacaggtgggtcaaattctgtttttaaaatttccattatgatgaaaatttcagtattacaggcttccaaatcccagcagatgggccacttgtttaaaggagagtttgatataataaagcatctaaaaacaagagtttggataattccttagggttgttatgatgtgatttgacttataattggaaataccgttttattcattgtactgattttcatttctctttttcttctagaatgtcttgattgtggaagtaagttcacatttacttttaatataacatttatgacttttctaacttagtatgcaccatcctaaaggtaagccagggagagaaattcctctgcatcagttttaatggtgggcttgtgttctaaaggagtgagattggttttttgtaaagactacttagtaatttgtttttaccaataatggaatggtatacttcctacctctctttttttagtttgaagtattttctttctaaacataactctctctctctatttatctatatataatatatacatatatatcttatattttatgtatatatatatatatcttgcttagattttgtcttatgtaatatttggtacataaaaaataatatttataatttatagactattttccatgtgttattatgtgctaaagtattttgtatcttagcaccgagaggctaagcagtttcctagggttaccagctagtaaactaagggaaacctttacttcctttagctcagtggttctcaaaatgtggttccctagaccaaaagtattaatatcagacaagaacctaccgaatcaaaatatctgtgatgaggcccagcaagctatgctttaacaagtttccgagtgattctgatgcatgctaaggtttaggatcccttgtttttactcataagtcactttctcattaaggccttccctggccatcctatataaaatctcatgttttcacaccgtcaacttcgtattcctcctcaatacttttattttcctgatcacttatcactaacagcctctctctctctctctctctctctctatgtatatatatatatatatcacttatcactgtctaacagcctctctttatatatatataatctatagattatatatatatgcagcattgtgcaatcattatcacgctcaattttaaaacattttcattgccccacaaagaaacccaatccccttagccatcactccccatttccccttcccccagcacctagcaaactgatcatctacctacttgctgtctataagatttgcctattctggacattttgtataaatagaatcatacaatatgtggccttttgtatctggcttctctcacttaatgttttcaaggttcattcatgttgtggagtatatctgcactcatttcctttttattgccaaattgtatggatagacaggtgttcctcaactgtgtcctgataaacccatctgaagttgaaaatatcataagttgaaaatggatttactactttgataaatctatcctaaagtcagaaaaatctcatgttgaaccatcgtaagttggataccatctgaattacatttttgttatccattcactggttgacagacgttaggttgtttccactgtttgctccttatttctcgtacctgaaatgtccttattccctcccttcttatcccatgtttaagtcatttaagacccagctcaaacgtcacctccacaaaaccttccttgatacccctttcctcttcaattcacttggaccttttgcatttaattttaatttttattttttttaagacagagtctcactctgtcaccaggctggagtgcagtggtatgatctcagctcactaactactctgcctcccaggttcaagcaattctcatgtctcagcctcccaagtagctgggactacaggtgtgcgccaccatgcctggctaattgtgtgtgtgtgtgtgtgtatgtatgtatgtatatatgtgtgtgtgtgtatatatatatatacacacacatatataaatatatatacatatatatatatacacacatatataaatatatatacatatatatatatacacacacacacacatatatatatatatagttttttttttttttaagtagagatggggttttgccatgttggccaggctggtctggcctcaagccatcctcccacctcggcctcgcaaagtgctggtattataggcatgagccactgtgcctggcctgcatttcattttaattataaaatattttgaactcagaaaaaagggtatgctgaatacctacgtacccacaaaagtattaacattttgccatatttgcttctgatcttattttttttgagaaattaaagatcataatacaactaaagccccatttctttcccttcattcccagaagtatgacaattatccttaaagttgatatatatcattcccatgcatgttttttatacttccctagtacaagttagctgtatcctctgctcaggggctcatcaagctgaatcaagggactcatgatcctcttcaaagttccttcaggttgttggcagaatttagttccttgtgattgtaggactgagggcccgttttctcactggctgctggccaggggttgctcccagatatttaaaggctcatgccctagcccatgacagtctcacaacatggcagctgacttcttcaaaaccagcaggagaatcttgctctagtctaccacataacctaatcacaggagcggctatcccgttattttcacagatcctggtcacattcaaggggagggaacccttctgtgtgtgtacaccaggaggcaggaattttttttttctttttcttttttgttaaaaagtcttaaagtcttttatccctaaaggaggcaggaattttgagagccatcagaattctgcctaccacagcccagaaatctgcatttttcacaagtctccagccatgatgtttctgatggctcacactgctttattccatttttaaagagtatttttattgaaaagcattagggttatggtttaaaaaatattttccctaacaaagatgggtttgtttagagtcctacttttgactaaatagctgagattcacttttatgtaaagtcattttatagcgttattaatttgggtgcctttaaaaatagtataaagcatgtttctcgagtgtagtctgttagccacctatattggagagttgggaggagagagtctctatcttgaatttatgggaaaaattctaaaatactttttataatgaaggacaacatcataactccctaataaaatgtgcatgtatatattcaaatttgctgtcattgatcctgcacctacaaaatccagtcctgggggctggcattcttactgcttgctgagggccagatgatatagattccagaatatctccatgtagattttggtgagaattactgtgctgaaaagaatgacagtattgcagttatacatgggggttttggtactttatattgtgactctgaatttaaagctatgcaatgtcttcttttttgaaaggatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcattttatcttcgaaaagtaatgtaatctcatataagacttaagatataatccttttaaataattttgtcatgtgttaataaagctcataattacagtcacttccttgcctaatattaacatttggtttttcagcatgctaattatatcagtttgtcctgaatagcatggcagaggattttgggcccccttgcaaaattaagaataaggattccaaagcgggtgaggaagtgataggaaggggtgggccctgaagatctggacctcctggaattgagtgatgaatgctgcatcttctttgtgtctgtagtgaaattttataatgcctgcttccttttttattaagtcggcctcacctcctcaccttacctatgctgttttacttttgcttttatagttctacctgtgtttatttctcattttcgtttcatctctcaacaactctggggtggcattattattcccacttttcagataaggttactgaggcatagggaattgtccaaaggtacagagctagtccgctatagagatgagatttgaacccagggaacctggctcacagtttatgcttttgctaccttaagtttttaatagagtgacatcaaacaaacatttaagaatatgtttttcttttccttttataatttcattaaaaacattaagtctctgatcagtctgcagtttttatgtaggggtcaggtaatgttctaacttctgctttttcctaagtgattaacaggtttttataagcccttttgaaaaaatcacggtatctgtcgagcatctttgaatcagagtaagccttctagtgagtcatatgtcagcagtttgactgtatgggcttttctaatatccagttcaagtgtttatcagtgagtttttcttttaaatagatttgggacaggtactatgagagtatataagtgatacgttataggacactaactagtatcctatgaaatggcaaaaactgcaatcacttttgcaccaaccaaatagaaactaatcagtgcacttgcttatttttctacatgctctttagggttttaaatgtcaacctactgtggcatagactttaatcctctgggtattcttttgttgttctttcctggtatatgctgtggaattgagatagactggttcgtgagcgagagattttgtgttgccacaggtaggacatgctcaaacaatacttgggtcatttcttgacccaagtcatctattcaccatagttttgtagcaccgatcttgcatacatttcatgtatcttctttgaaccccacgtcagtgctgcttatatgatactcagaaattaaacactaaggaataagattttcaggtaggattgagttttggagggtcacaaatcttgtaatgtctaatatttccactctccctgctgagaattagttttggcttccttggaggtgatatcgcctctgttgagtataagtggcctactgtgatcacaccactgcactccagcctgggtgacagagtgagaccctgtctcagaaaaaaaaaaaaaaaaaaagaatgcatggcctagatgacttctaaggtttttcccacccagttccagttttcatgttctaggcagagcagtaaagtgagaaacacatggacttgggagtttagtctcgcatttcactgccacttaatctgagcgactattccatatttaatctctctgaatgtatttactcatctttaaaggggaatgattattaacatctttttctcagggaaactatatgagtcaaggagataatatatttgaaaatctttttaactgcaaagcgctgtttcactgttggttataatgtgattgatctcattgtagtgagcagctgcttaattgcgttttagaatgtagggaagatagtaatatttttcacattatatatgtagctggttctggaactgtaaacatactccttttttatggagatctgagtcacgtaccataaaattcactcttttaaagttgtacaatccagtggtttttgatatattcagagttgtgcatctgctaccactatttcattttggaacccaaagaaaccttgtacccattagcagtcattctcccttctcccagcccctggcaactactaatctactttctacagaaagtccgtacagatttgtgtattatggacattccatataaatggactcatgcaatatcctgtcttctttcacttagcatagtgttttcaaggttcatctaggttggggcatgtatcagtacttcatcccttgttttggctgaataatatttcattgtacaaatatatcacattttgcttatccatctgttggtgaacatttgagtttctacctgttggcttttatgaataatgttgatttgaatgtttgtgtacaagtatgaatacctgttttcaggtctcttgagtatatagttgctaggtcatatagtaactctgtgtttaacattttgaggaattgcccgactatttaacaaggtatatgtactgttttacaccagtaacatatgagggttccaatatctccacatccttgacaacacttgttactgtcctttttattgtagccatcctagtggctatgatgtggtatctcattgtggttttgatttgtgtttctctgatgctgatgatgttgaacatgttttcatctgcttattggccatttacatatatcttcttaagaacggttacccatttacagtatggaaaatgcttcagatgcaactctagtcatgccttagagatggagctttattaaacattcagatctctaggcatatgaagtgctgagttctcttgaactcctaatacagattgcactgagtttagtgataccttttctggagcattcctgagttcaggtagggagaagggtttttgctgtgattggcttgttatgttctttctaaatggaaatagaattgaagtgtctcctctctccatttattggaagagtcatgagggacataattagatgatcccttggagtctccggcttaggtcagtggttatctacttaggctgcacattggaatcacctgagagttaaaaaaccaggataacctctgcctgtgtctcatctccagcaattctgatgtaattggtcagggctgtggcccgagtaggtgagttctggttttttaaagctcccaggtgattctgatgtgcaatccaggttgagatcactttgggccctttccagctctttaaacatatatatttatctaggaaggtatgaaagcataagttttcttgagactgcctttaacatctgtaaaggctttcaaagcagcttctgtagttttttttaaatggctgaatatttttcaacaggcagcatttgggttataaaattagcttttggtagagttgacttataccacctccagcttttgttccaaaaataaatactggttcttttggcacactagttgttttaccctaaagttcctctttgtaagccagttattaaaagttgtgatgcagccagggcgaagtggtacacatctgtagtcccagctactcggaaggctgaggggggaggatcgctagagcccaagaagtcaaggctgcagtgaactgtgattacaccactgcactgcagcctgggccacagagcgagactcatctctttaaaaaaaagaatgttgtgaggccgggcgcagtggctcacgcctgtgatcccagcactttgggaggccgaggtggacggatcacctgaggttgggagttcgagaccagcctgaccaacatggagaaaccctgtctctactaaaaaaaatacaaaattagccgggcgtggtggcacatgcctgtagtcccagctactcggcaggctgaggcaggagaatcgcttgaacctgggaggcagaggttgtggtgagttgggcgagccattgcactccagcctgggcaacaagagcaaaactccatctcaaaaaaaagaaaagaaaagaaaagaatgttgtggccaggcgcggtggcttacgcctgtaatttcagcactttgggagaccgaggtgggcggatcacgaggtcaggagatcaagaccatcctggctaacacagtaaaaccccatctctactaaatacaaaaaaaaattagccgggagtgctggcgggtgcctgtagtcccagctactcaggaggctgaggcgggagaatggcgtgaacccaggaggcagagcttgcagtgagcggagatcgcgccactgcactccagcctgggcaacagagcgagattccgtctaaaaaaaaaaaaaaagaatgttgtgataaaaggtgatgctcacctctcccacacccttttatagtttagggattgtatttccaaggtttctagactgagagcccttttcatctttgctcattgacactctgtacccattaatcctccttattagctccccttcaatggacacatgggtagtcagggtgcaggtctcagaactgtccttcaggttccaggtgatcaaccaagtgccttgtctgtagtgtcaactcattgctgccccttcctagtaatccccataatttagctctccatttcatagtctttccttgggtgtgttaaaagtgaccatggtacactcagcacggatgaaatgaaacagtgtttagaaacgtcagtcttctcttttgtaatgccctgtagtctctctgtatgttatatgtcacattttgtaattaacagcttgctggtgaaaaggaccccacgaagtgttggatataagccagactgtaagtgaattactttttttgtcaatcatttaaccatctttaacctaaaagagttttatgtgaaatggcttataattgcttagagaatatttgtagagaggcacatttgccagtattagatttaaaagtgatgttttctttatctaaatgatgaattatgattctttttagttgttggatttgaaattccagacaagtttgttgtaggatatgcccttgactataatgaatacttcagggatttgaatgtaagtaattgcttctttttctcactcatttttcaaaacacgcataaaaatttaggaaagagaattgttttctccttccagcacctcataatttgaacagactgatggttcccattagtcacataaagctgtagtctagtacagacgtccttagaactggaacctggccaggctagggtgacacttcttgttggctgaaatagttgaacagctttaatatacaataattgttgcattattatttcagatgataaatgtggtcataagtaagaaataaatgatcgagtttagtcttttaattcactgtcctttgaatacctgcctcttactctggaggcagaagtcccatggatgtgtttatgaacatggttgaggaagatttaggaagactgcaacagtacactacctaaagcaggttttttactccatctttttttgccacgtacactggcctcccactttgatatgcttgaaattatctccttgatttgtctttcaaaactacatattgaggctggttgcggtggctcacacctgtaatcctagcactttgggaggccaagccggacagatcacttgaggtcaggagttcgagaccagcctggcaaacatgatgaaaccccacctttactaaaaatacaaaaattagccaggcgtagtggtgtgtgcctgtaacccagctacctgggaggctgaggcaggagaatcactggaacccgggaggcagaggctacagtgagccaacatcacgccactgcactccagcctgggtgacagagcaagactctgtctcaaaacaaaacaaaaaacaaaaaactacgtattaagacaagaaacagactgggcgcggtggctcacgcctgtaatcccagcactttgggaggctgaggcgggcggatcacaaggtcaggagatcgagaccatcctggctaacacggtgaaaccccgtctctactaaaaaatagaaaaaattagctggggtggtggcgggcgcctatagtctcagctactcgggaggctgaggcaggagaatggcgtgaacccgggaggcagagcttgcagtgagcagagatcgtgccactgcactccagtctgggtgacagagcaagactccgtctcaaaaaaaaaaacaaaaacaagaaacaaattaaactaatgtgatagactactgctttgttttcaaaagatacactccccaaaagttactgatctaaaatacagtagtactatctctgtttagtaagaaccctgacaactaatagtgttcttatatgtaaaatgctattcttgcctttcatttcagaatatactttttaaatgtgaatttctggatttttttttatagcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaa

SEQ ID NO: 105 - DNA, 4067 bp, Homo sapiens
  modified_base (869)..(869): a, c, t or g
  modified_base (2622)..(2622): a, c, t or g
gaattcctaactgccccggggcagtctgctattcatcccctttacgcggtgctacacacacttgctagtatgccgtggggacccctccggcctgtagactccatttcccagcattccccggaggaggccctcatctggcgatttccactgggggcctcggagctgcggacttcccagtgtgcatcggggcacagcgactcctggaagtggccacttctgctaatggactccatttcccaggctcccgctacctgcccagcacaccctggggcatccgtgacgtcagcaagccgggcggggaccggagatccttggggcggtggggggccagcggcagttcccaggcggcccccggggcgggcgggcgggcgggtggtggcggcggttggggctccgggcgcgtcgctcgctcgctcgctgggcgggcgggcggtgcgatgtccggagaggatggccggcggctggcccgggggcggcggcgcggctgcccgggagcggcgacgggagcagctgcggcagtggggcgcgggcgggcgccgagcctggccccggagagcgccgcgcccgcaccgtccgcttcgagcgcgccgccgagttcctggcggcctgtgcgggcggcgacctggacgaggcgcgtctgatgctgcgcgccgccgaccctggccccggcgccggagctcgaccccgccggccgccgcccgcccgcgccgtgctggactccaccaacgccgacggtatcagcgccctgcaccaggtcagcgccccccgcggcgtctcccggggccaggtccaccctctgcgccacctggggcatcctccttccccgttgccagtctcgatccgccccgtcgttactggccctgggtttncaccctatgctgacaccccgttccagtccccttaccattcccttcgaccaccccacttccgaattggagcgcttcaactggctgggctagcactctgtgtgacactctgaagctctacattcccttcgacctactctcttcgattggagtcgctttaactggccctggctttggcagcctgtgctgacccatcgagtcctccttaccatccctccctcgacttcccctcttccgatgttgagcccctccagccggtcctggactttgtctccttccctgccctgccctctcctgaacctgagccagctcccatagctcaggtctggtctatctgcctggccctggccattgtcactttgcgctgccctcctctcgcccccgagtgcccttgctgtgccgccggaactctgccctctaacgctgccgtgccgtctctctcctgagtccggaccactttgagctctactggcttctgcgcgcctctggcccactgtttccccttcccaggcaggtcctgctttctctgaccagcattctctcccctgggcctgtgccgctttctgtctgcagcttgtggcctgggtcacctctacggctggcccaagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtgttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggcttagcacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggccctatgtccacttcaggacagcatgtttgctgcctccagggatcctgtgtccccgagctgggaccaccttatattcccagggccggttaatgtggctctggttctgggtacttttatctgtcccctccaccccacagtggggccactagggacaggattggtgacagaaaagcccccatccttaggcctcctccttcctagtctcctgatattcgtctaacccccacctcctgttaggcagattccttatctggtgacacacccccatttcctggagccatctctctccttgccagaacctctaaggtttgcttacgatggagccagagaggatcctgggagggagacttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagnccccaatttatattgttcctccgtgcgtcagttttacctgtgagataaggccagtagccacccccgtcctggcagggctgtggtgaggaggggggtgtccgtgtggaaaactccctttgtgagaatggtgcgtcctaggtgttcaccaggtcgtggccgcctctactccctttctctttctccatccatccttctttccttaaagagcccccagtgctatctggacatattcctccgcccagagcagggtccgcttccctaaggccctgctctgggcttctgggtttgagtccttgcaagcccaggagagcgctagcttccctgtcccccttcctcgtccaccatctcatgccctggctctcctgccccttcctacaggggttcctggctctgctcttcagactgagccccgttcccctgcatccccgttcccctgcatcccccttcccctgcatcccccagagccccaggccacctacttggcctggaaccccacgagaggccaccccagccctgtctaccaggctgaccttttgggtgattctcctccaactgtggggtgactgcttgggcaaactcactcttcggggtatcccaggaggcctggagcattggggtgggctggggttcagagaggagggattccctccaggttacgtggccaagaagcaggggagctgggtttgggtcaggctgggtgtggggtgaccagcttatgctgtttgcccaggacagcctagttttagcgctgaaaccctcagtcctaggaaaacagggatggttggtcactgtctctgggtgactcttgattcccggccagtttctccacctggggctgtgtttctcgtcctgcatccttctccaggcaggtccccaagcatcgcccccctggctgttcccaagttcttaggtaccccacgtgggtttatgaaccacttggtgaggctggtaccctgcccccattcctgcaccccaattgccttagtggctagggggttgggggctagagtaggaggggctggagccaggattcttagggctgaacagagccgagctgggggcctgggctcctgggtttgagagaggaggggctggggcctggactcctgggtccgagggaggaggggctggggcctggactcctgggtctgagggtggagggactgggggcctggactcctgggtccgagggaggaggggctggggcctggactcgtgggtctgagggaggaggggtcgggggcctggacttctgggtcttagggaggcggggctgggcctggacccctgggtctgaatggggagaggctgggggcctggactccttcatctgagggcggaagggctggggcctggcctcctgggttgaatggggaggggttgggcctggactctggagtccctggtgcccaggcctcaggcatctttcacagggatgcctgtac

SEQ ID NO: 106 - DNA, 6065 bp, Homo sapiens
cttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttgtttccgtttacagagaacaataatattgggtggtgagcatctgtgtgggggttggggtgggataggggatacggggagagtggagaaaaaggggacacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccggtaagtaacctctcagctgcttggcctgttagttagcttctgagatgagtaaaagactttacaggaaacccatagaagacatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatagtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatattaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcagaaactacaaacacaaacttcacagaaaatgtgaggattttacaattggctgttgtcatctatgaccttccctgggacttgggcacccggccatttcactctgactacatcatgtcaccaaacatctgatggtcttgccttttaattctcttttcgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagccgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatggtccaggctgcagtgagccatgatcgtgccactgcactccagcctgggcgacagagtgagaccctgtctcacaacaacaacaacaacaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataa

SEQ ID NO: 107 - DNA, 19856 bp, Homo sapiens
aagtgtgagcaatgacgaaactggagagatagggttttaacaagatgcaaggacaatctgaggactgagagccatttcaacgtgagcccccagtctgagaacaagaaagaagaacttctgtctcgaggtaaaaaggcctgctggggacctggggtccaggtgaagggatgggatggttgacagaactgctcaggtgaggacaggcttctcatgaggtccctgagaaacttgccttttggagggaaatgtcctctgccctctggagcctggggagaaggttatttctgcccgccagaccagcatgctcgcttttcttccatgggcattcaggaatcctggccccattctgacattcctcaaatggaggaattcctcaaattaccagaggaaagttaccaaagtttagatctgctggagctcttcaaggattggcctgagacaagccgggaggtgccacggggcttggagctggccctgtgaggcacctccgggggaagttcatgtcctaggtggttcacgtcatggacctcttggaggtccgtgaatagatttattcatgggatttgtgaattggggggaaaaatacatctttattttcactaatctttaattgaaagtcagcacttgcttcagttatgaatgtagacaatgaaccacaatagaatttgccatcaatagaaaacacaaatattttcaaatctcattacagtttttatagatttctccaaatgtccttaacgctcagcactactacagaattacaacagttattaggctgatgtcaaatctaaagaagcatgtgtactgctctaccacacattcttctaatgttttgacaactgtcttgtcataatttgttccctttattatcccatgtatcttattaatttttaaatgttgttctgagaagggactccatatgccttcccagaccaccaaagaggtccatggcgcctttatgtcaggcacctgctttggtgtgttgagcaggaagcctgagatctcagacaagagcttcaagggccccccagcccaaacctctgtctactaacaagtctggttctactttaaggcagttggggttgtggagattgaaaaagaagccccttcacagctgcaaatgagatctttctgggcatctttttcagtgtcgtgggagatctgtatacagaggtatttgtggagctcagagctgaccttccagctcctctgagaggttagatccgggctccggtggcagaggaaatggagactcttccttgccctcttgtccccaccctccccagaaaacctctggcaaagctttatgtgtcatctaaccgtcaccacattcctatgaggtagttttaaacacaagaggaatgtgaggctgagtgaggtccagcaatgtgctggtcacacaaagcttggatttgaacccaggagtccacaagactccaggaccgcctccgaaggtgcgggagggaagagtttcccgccgtctgtgagctgtcgcctgagagaggcaccgagccctggggccaccagcgcagctcaggagccccggggaccatcaaagatgaggatgccaactccacgggcaccctcccccctgcccgcgctggggctcacaacgttttaagaggggagacccgcccctggcgtgtagtgggcccggaaaattcccagacttctcacgaccacccgctctcccctctgttgagggccaggtgccgctctagtacatgctgcgtccccaggacccaccaggcccaactttgcaccccctcatctcccctcctagtttagactttccctggctagcccccatgctcgctggatggcccatggctggagtgacgcgggccaacgcggggcaggtagggggtcactcggctttggctgaaaggcagcgccctctagcggccagagtgcgaaatcagcgccgccggctccgcgctgccccgcctgcatcacaacagggtgctcccctcccgggcaccaaggtcacttcccagagcatccttgcccagtgacctcgctgccccccagcgctggtgaggggcccacaacagacttacatgctcttcttcaactcggccctaggcaccgcgaagtctggccactccagcggagtgaccagctgcatcagcccctcccgcctgtcctctctctccttggaagcggtccctaccctgcgcccctcccatcccgctgcaccagtcccttaggaaacacgcctagagaagggacacgaccttgtcaacattccacagctacctagtgcggagccaggactggaagccagatctcctcagcccattccccaccttaattcacccaccgtattctttagtcaccagctcccgagagcccacaaacaactatgaaggcctaacttcattgccatcttgcagcctttccacatccctcatccagaatttctcctgtgctgccccttgacactttatgaccttattacttagtacagtcgttcttgtgttaacagctgttcgtgaatggatgagcggctgtgaggagagggacaaaggggactccaagagaaagactctcataacttgggttagagtcctgctccccaacttaggagctgtgattttaagcaagtcacaagtcccctccaagcctctatatgcttcgtacaaataataaattttagaaaataataatggcttagtgttttataaggactaaacacagtcttgcaggtagatgtgcctggaacactgtccattgattccaatataagaaagcataaaactaatcatagctatcatttattgagcccttactctctgccaggcactgtgctaagtaatttacataggtgacctcatttgaccctcacaacccaaggaagagaatattttgtcaccattttataggtcattaagagattaagaaacttgcccaatattacacagatagttaagtttcaaagccagatctgaaacatcctggtctgactctagagaccatttaaccactaaaacgtccgcctctgctgtgttagtgatctctctgtgccccatggtgtctgacacattatagatgctccgtgtttctgaaatatgtctatttattaaaggctgagcatagcgcctggcccaggagcctaagaaacttgaccgagtcatgcaactattaagttttttttgtttttatttttgttttttcgagacagaatcttgctctgtcgcccaggctggagtgcagtagcgcgatctcagctcactgcaagctccgcctctcgggctcacgccattctcctgcctcagcctcccgagtagctgggactacaggcgcccgccaccacgcccggctaattttttgtattttttttagtagagatggggtttcaccgtgttagccaggatggtctcgatctcctgacctcgtgatctgcccacctcggcctcccaaagtgctgggattacaggcgtgagacaccgcgcccggcgccactattaagttttaggaccaggatttgaacacaaacactctggctctagagtctacgctttttaaccataattctgggctgaatgaataattgcaatccttctttgtcttcctctttgaataaaatgatttgtcattttattcatttatcctctttgtcacttaatattccatgtttcaagagtcaccaggacattctggtgtagcatgaaggtatgataacacaggagaaggaacaaggagaggtcaaggctaggaaaggacattggggccataccatgagctgctgctgggatgttttattaggattgtgacaaatgtatagataagtacagaagaatttaacaatcgtctctacttagattttcttttatgttccttaatagtactgtatagtttgtatcctataggtcctattcggaatgttgttacatttttctggacatttgatgggttttttggttgctataatgaatggaacttttccttctaccatattttctgactaataattatatccaggaaaatttttaatcttatgtattaataagtaccttattaaattgtatgtatatacactaatttagtttattgttttatacaaactataattacataacattctattctgtggatctgcaataatttattcaaccattctcaccagtgggtcttcacctgtttcctttttttatgggggcaggaaggcgacaaagttttgctctgttgcccaggctggagtgcagtggcgtgatcttggctcactgcaatctctgcctcccaggttcaagcaattatcctgcctcagcctcctgagtaggtgggatcacaggcacctgctacaacacccagctaatttttgcatttttagtagagccagggtttcaccatgtgggccaggctggtctcgaactcctgacctcaggtgatccgcacgcctcccaaagtgctgggattacaggtgtgagccaccacacctggccttcacctgtttctatttttttggtattataaaaaatgctgcagtgaatatccttgtacatctatactagcacactcatgcttttatttctgtaagctatagccaaagggacagggtatgtgcatttgaaatgttaatatataatgagtattcccccaaagctccgtaacaatgtatagttctacctagagtgaatgattgcacatatttcttcttacccttaccaaaatttgatttatcttttaaatttttgttcacttaacaggtggtaattctgaaattctgaactctgaatttttaatttgtacttccctgaatacttgtaaaactgaaaaactttttattgcatttcgtcttttgtgaactgcctattcagatactcttttattgtttctaataattctcaattaagtttcttgggttttctagatgtaagttatatcacatataaatagtaataaatttgccttaagatttccaatatttataccctttgctttattttcttgtctaaatataatggcaaacactttcagaacaatgtgaaataacagaaataataggaagcatctctgccttgctcctaatattaatagaaattatcccatattttaccattaaatatgatgctgcaattttatctgagatatacatttctccattatattgaatagtattcatccattaccattttacttaggattttagtgggaattaatgtaagatgttatcagaaggtaatattgactttcttttttatccagtagtatgttaattaatagatttcctaatattaaatcatccaagaatttctaaaaatgaaaccttattccatttgtcatggtgtattatatttttaatatcttgtatgattggttaatttgtgtgtgtgtgtaatttttgattttggttttcttgagacagggtctcactgtcaaccaggccagagtgcagtgaagatcatacctcactacatccgtgaactcccgggctcctcccacctaagtctcttgagtagctgggacttcaggtacgcaccaccacacgtggctaatttttgtattttttgtaaagacatggtctcactttgctgcccaggctggtctcaaactcctgggctcaagtgatcctcccacctcggcctcccaaaggcttgggattacaggcgtgagccaccgcaactgggcctttcaatttttaaaaatttaaatataatattataaaacagaatacagcagcacatgaaaagaataacatactaggccgggcgtggtggttcacgcctgtaatcccagcactttgggaggccaaggtgggtggatcacaaggttaggagttcaagatcaccctggccaagatggtgaaaccccgtctctactaaaaatacaaaaattagccgagcgcagtggcaggcgcctgtaatcccagatactcggcaggcgcctgtaatcccagatactcggcaggctgaggcaggagaatcgcttgaacccaggaggtggaagttgcagtaagccaagatcgtgccactgcactccagcctgggcgacagagtgagactctgtctcaaaagaaaataacaacatactatgaccaaatggcttcagtttttgtttgtttgtctgggactgcaaagatgtatcaattttaggaaatctattaatgtagatcgccatcttaatatatcttaaagaaaaataatatcattttagttgatatttaaaggcaattaataaaacattcacatccatccttgacattttaaaactcttaataaaatagaaataaatgtatattccttaacataataaaatacatctcattctcaaagctactataatacttaataaggaaacatttaagcatcccccattaaacttagaaaaaagacagagattcattattaccattattatttaatatttttctggagatattaaccaacacaattagaagaaagaaatcagagatataaaatagaaaaggaagtaattatcattatgtacacataatatgattgcataactggaaaatccaagagaatcaactgaaaaatgatagaattaagggaggggagctgggtatgaaattaatatctagtaaaacaaatagcctttcatatatgaacaataatgaaaaattaaaagatataatgaatgatataaagagactgaaaaaataagttaaaagatacaacgagtggaaacaacagatgctggagaagatgtggagaaataggaatgcttttacactgttgatgggagtgtaaattagttcaaccactgtggaagacagtgtggggattcctcaaggatctagaactagaaataccatttgacccagcaatctcattactgggcatatacccaaaggattataaatcattctacgataaagatgcacaagtatgtttattgtggtactattcacaatagcaaagcctgggaaccaacccaaatgtccatcaatgatagactggattaagaaaatgtggcacatatacaccatggaatactatgcagccataaaaaaggatgagttcatgtcctttgcagggacatagatgaagctggaaaccatcattctaagcaaactgtcacaaggacaggaaaccaaacactgcatgttctcgctcataagtaggagttgaacaatgagaacacatgaacccagggtggggaacatcacacaccgatgacgttccacgggtgggggcccgggggagggatagcattaggagaaatacctaatgtaaatgacaagttgatgggtgcagcaaaccaacatgaaacatgtacaactatgtaacaaacctgcacattgtgcacatgtaccctagaacttaaagtatattaaaaaaaagatataatgggtaaaagatgacattttcaatagtgaaaaaatatgaattactcaagaaacaaacttagctaagaaatggacgaggactttatgaagaaaacttctatacatacctgagacacacatatttgaaaaatgaatatcacattctcggatcaaaagaatcaatgtcacaacaaattcagttctccctaagttaaaatataaattgaacatatcccaattttaaaataccaataggactttttcttgatggtacacacagtaggaagggcaagactagacaagctgattataaaaatcagaaaaataaatttatagaaaaattcttgttttccccttttgaattttaaatgctgtgaatgtaattaccacttcaaaagttataaactacaaaaccttaaatatatttttaaaacacatacacacatagagaggattttttaaaataaaaatgtatttattttatatacataattgcaatttgccctttttgacctaatgctatatcatgaacatccctccaggcccatatttatagaagtatctcattcttttaataatatataatattttgtcacatagattaattgaaacttattaaaccattttccctattgatgaaattcaagtgtttgtttttcttcagtttgtttattttgaaacaggagtaatttttcttagccaggattagaagatgtaactataaaaagtaaaacaataaaaatattgaaagaaaattatagcctcaattggagggaaactttcctaaacaatgcaggaaacccagacaacttaaaggaaaagatagatatgttgtatttaattacatacaatgtaaactttccttgtgaaaaaaaagcctcataaaaaaagtgaagagacaaacaacaaattgggagaaagtatttgcctaaaaaaatggcagatgggttaatatctctaatacggagaaagtgcctaaaagttaagaaatgtgaagaatatgaacacacaattcacagacaagggaatactaatgaccaataagcatatgaaaagatcctcaacttcactaatcatggaaatgcaacataaagcaggtctaatttttcatccatcagattggcaaaaatgttaaagtacagataatacccagagctagcaagggcacgaggaaatgtacactatcaagcattcttggtgaacatctgattatcaacagcctttttggagagcaatctgattatagtagaaaaaaagttttaatcatcatattctttgacgcagcaatccaatttaacttaaaaaaatatatatgagaaaatagcctttagtgtctccctatgcccctccctccccggctcccagtgtatctcacttggtttaccgcctcacttcccagccagctggactctcatgcccaagccctcctctacctccatcatactctagccaatcaaagctagagcctgggatggggaaatggtcttggaaccctggaaggctttgtctagtgggtccccctgtgcttttaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggtgaggatagaccctagagcagagacggccatggggaggatcctgggcttgtgggaagggctggatcccgtgattttctctagtggggaaacaaaggactcttttttttttttttttttttttgagggagtctcgctctgtcacccaggctggagtgcagtggcgcgatctcggctcactgcaacctccgcctcccatgttcaagcaattctgctggctcagcttcccgagtagctgggactacaggcttatgccgccaccgccggctaatttttgtatttttagtagagacggggtttcaccatattggtcaggctggcctcgaactctgcctgacctcaggtgatcctcaggcgcccggctgactcactctccttgacattaaggaaagggtaaagaatatattgtctttttctttttcattagaactgatactattgcctctctatcagacactctgtctctgctatatgtttcaaagagcctggcaatctgcgcctcaacctaagattcctttaggctcttatatactataaatttatgaaatccaggtttgagatccagatactgcaatcttcattaacttcagcagctagtttaaccactctgtgcctcaatttgtgtatttataaaatgggaagagtaatacctgccctctatggctatactgaggatttgatatacagaaaagcactctaacagagaccctatagaagttccagctggaaagtagaaataaaatataaaccattttggagtgaatcaatggctgggattgcaggtctccctcagatatgggtcttggaagacccatatctcttactcttgtaggagaatggcattcaatatgcagggggcagcctccatctctgcctcttcaccgttttcatgagagtgaatttagtttactatgtataccaaggggagtcttaaaaggaaaagcaagtcatagcggatcaagctgccaagggagtgggggagggggctggcagcctcagcatctgccggatgagttttcagcagagagctggatttaaccgaggttggggttttgcgaggatccatcacagtaggagtaaagctaagggagctgagggtggatataagggagagattataataatggactacaaaatataaactacagaaggaagtgaagtttgaggagagtgaggggcagtacaaagttggcagggccaatgcattgcaaaattaggtcagagacacccatcgagccaaaacatcctgggttaacccaactattttctccacttctgtatccaggttacagattacttacagggaaaatcaagtgggcagactggcaccatcagagtcatggtctttggatatcaatggtccctcaataattagtctgtttctccagtccattctcactccatttccacacagtggctgtttttaatcatctctggtatttctgtggtctctctcatcctatatttcttagaaaaacttttactcatccttcaagtcagctccagcactaacttcactgtgaagtttccctgatgcttcagactcaggaatctctaagattcctcaattataataactgtggaattaaattgtaactttttgctaatttgtttttacattaggctttaaactctgagagtggccaggcacagtggttcatgcctgtaatcccagcagtttgggaggcagaggcaggagggttgcttgatgcctagagttcaagactagcctggacaacatagtgagaatctgtctctacaaaataaaaaattagccaggcatagtggtgcatacctgtagtgttagctattcggaaggcggaagcaggaggattgcttgagcccaggagttcaaaggtgcagtgagttacgattgtgccactgccctccagcctgggtgacacagcaagaccttgttttaaaaaaaaattttttaaattaaaaatccccggtcatctaatggttaggggaaaaaaaagttctgacagtagggctcacgtcctagtcctcatagccccagcagggcttggcagagtgaatacctaaacgtatttgttaagtggaggaacaaataaacctatgaattaatggatgctttgagcatattatttagtcccttaattttcattttccagatgaataaactactgcccaaggagttaggtaacttgcttacagtcacacagccatcgatagagctggaatttgtatttcctgtctgccagcactactgccaggttctgcttcagtccttccttgaagacttctagtgataaggagcagttacggtgaaattcacagaatgctacctgacctctgggtaattcttccctttccattccaggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacaggtgagtgctcaaatactcctaatgccaccaggtgggacagtgagcagggttgacagtggagatgtaaccagatagttcaggtcctggaaaggcagtttccttcttcctcaatccttttccaacatccccattggcagatgctgcctttcttcaaagcgcacacacaaacataatctcattttgtctttaattttagaactcttacttggggtggccattgcatttttactgacagggagatggtgacacaggggttgaagagacttgtccagtgctactcactggtgaaagtaaaaacagatagaaattaggcttcctggccaggcatggtggctcatgcctgtaatcccagcattttgggaggctgaggtaggcagatcacccgaggtcaggagttaaagatcagcctagccaacatggagaaaccctgtctctactaaaaatacaaaattagccgggtgtggtggcgcatgcctgtaatcccagctactcaggaggctaaggcaagagaatcgcttgaacctgggaggcggaggttgcagtgagccgagattgtgccattgcactctatcttgggcaactagagcgaaactgtgtctcaaaaaaataaaaaacaagaaaagaaaagaaagaaattaggcctcctgattcccaattcagaactctcccagaaatgtggctatatttctaaattcaggcagacaacgagattaggtttgagataatatgggtgtctgtcttaaggagcatttagttggaggaaacagaaaccaattcaaagtaccatagattaaaggaggaaaaaataaaaaagtacagctggccctcatgagttctagctcctggaatcagaaactagaaaggggacaggacgcaaaacagttaccgtttcaaactgtgaggcagcaaggcctctggcttctgcatctgtctttcactctatgcatgctccccctgctccattactactttggcatatcctaaatatggccactccagccccagctttaagtggcttccttaagtcaaattgtgcccaacagaaagtgtctctctgtgtaactatattcctagacaatagagcaagccttcaaaattctgtgggaaaaaaaaaatttacctagaattatatattcagccaaactataaaccaaatgtaaggaaagaaaaaagacactatcatgagatgcaatgactcaaaaaaatttgccttccatgtgatcttttcaaagaagctaccagaggatgtgcttcagtaaaacaagaaagtgaatccataaaggggataaaatgacatacaggaaacaaggagtctaacaaggaagttctaggctggacacagtggctcatgccagcacttttggaggccaaggtgggaggatcacttgagcccaggagttagagataagcctgggcaacacagggagacaccatctctagtggaaaagaaaaaaaaaaggaaattcaagaattaaaaaagggcagttagtccagaagagagcaagagaaagacgactctggaagggagatctctaggaggtaaaaatggaatcgacatatcatctttctaaaggcccattaaagacccaataaaaagattaaagaaatggatatggaaaactctgccagtaaaaaaataaaatcaggctctagaaaaaactaaattttacaaaagaaacatagcgcacaacttgattttgcaaaaaataacacagaatccaaattatgtaaacatgactaatttaaataaaatttgtggtacaattatttttagaagaatgcagagaaggaaaatgggtgaaagtataatcctcatctactatattctagcacatcttcatctactgtagcagaaagccaatagaaaatgtctaaattttatcactaggaagcagcaatatgagcatattatttaggaatataataagacatctcgaagagttgacagtggttgtctcagacaataagcctaggaggacaaaagggcactgctattattctctatgaacttttacaactatcttacttctccatgaacttacaactatcttacttttttttttctttttctttgattttttgagacagactctcactctgtggtccgggctggagagcagtggcgtgatctctgctcactgcaacctccacctccaaggttcaagtgattctcctgcctcagccgcccaaatagctgggactacaggcacacgccaccacccatccaactaattttttttgtatttttagttgagacggggttttgccatgacggccaggctggtctcaaactcctgacctcaggtgatctatccgcctcagcctagccaaagtgctgggattacaggtgtgagccaccgtgcctggcctatcttactttttaagaaaaacaagtataaattacccactcaccaccctccccccatgaaaaactggcccagagcctttgaacaaatgtttctaatcacctcctatggttcctagttaattcaaattttcaacttgtttagtttgactgactttgttccttgcttcctggtgtcttcctgtctgacctagctatagcattcagcacttctgactattccctccttcatcaaactgtcatctccagtggcttctgtgactgtactcccctggctgttctacccacctggctgttcttttgtcttctctatttcctcctcccacctctcaaacatgagtattccccaagactcacttctcaccccttcaaccttttctctttactctctctccctagttctcatctacccacgatttaaaccagcatctccctgcaactgaccagcaaatcaacttctccagcttgaacacctttcctaagttttaattaaacgtttaaactaaaaactgtactcctagctcctggatgtcccaccatttcctcaaactcagtatcaaagctatcctcctgagaccctatttctgttcatgacggagtcaactttggttcctccttttttcttaacccccaattcagagagttactaagtactgctgttcttccgcacagcagtacttagtggggaagaatagcagtactttgttattcctttccttccaaaggtgtttttcaggtcttcatcacctcacacttaacatattcctatagtctcctaactagtgagtcccttgagttcagcaactgtgccctagtcacctttgtatctcccacacctaccacagggcctagcactgagctgttgcctaatggtccagcaactctaaatactgtttctgcctccaatccattctacatactaccaccagcttgtctttccaaaatgctaatttgtacatgccacatcactcaaagttttaatggcttctcactgtctatggaataaagtctaaattacattagcctggcactagagactctatagcatttcattctatttatgtgaatacattgcttcagttaaactgcactagtggatactcctctttcattcatctaacaaatatgtattgtgcatcccaggcccagcgctatgccttggagaacagaatgaggtataacacagtccttgctccttataacctaaatcctgttctcctaatatattgttttagttgtgaagattctccctaaggaagaatgcttttctcatcttctcagcatatttaagtattagagtcagcacatctagatggttccccaagtgtggaaattaggtgcattttggaaggtaaaactagttaagaagagacaggtaataaacaatgtcagggtgggtggtggctcacgcctgtaatcccagcacttcaggaggctgaggctggcagatcatttgagatcaggagttcgagacaagcctggccaacatggtgaaaccctgtctctactaaaaatacaaaaaatagccgagtgtggtagcacgcacctgtaatcccagctacttgggaggctgaggcaggagaatcacttgaacccgggaagcagaggttgcagtgagccgagattgcgccactgcactcgagcctgggcgacagagccagactctgtctcaaaaaaagaaataataaaataaaataaaaaacaatgtctgccatttactgagtgcttactgtgggccaggcattgtgctaagtgatattatattatttaatctccatggtcttttgagctattgtcctgtgataactcaagcttgaagataatttatgttcatccaacagtaaatgatggataaaaatccagatctagtccaggtgcagtgtctcatgcctgtaaccccagcacttagggaggccaaggcaggtgcatcacttgaacccaggagttcgagaccagcctgggcaacacagtgaaaacctgtctctacaaaaaatacaaaaattggctgggcgtggtggcacatgcctgtagtcccagctactagggaagctgaggtgggaggatcgattgggctcggggcatgaggctgcagtgacccatgatcatgccactgtactctagcctggatgacagagcaagaccctgtctcaaaaaaacaaaaacaaaacaaacaaacaaacaaaaaaaacccagatctattccaaaagggcaagattttaacttatgctagattgcttgaaccactctagaaaatggggctatttggggatacccaagtccaaggcgactaagctgtttcagctatctctgtggcaaaactttagaattactttaagatctatctgcatccctagtgtctgacacacaggagattctatacttatttatggctgcctaagtacatcatcattacccacaatgttaaaaatacttatttgggcaacgaattacagagggaggaatccttggagatcataaaagagatgttatgagatgatgcaaaaggagatactgatgatttctgaaaccctcccctgatccatgattctcttttgaaccagagacagggaactacacagtgacgggattgaaacaaagacaacaccttgagttcagccataatgaaggcactctcagttcaggcttcctacaagaaaaggtctgggtaatgctggtcaccagccttgtggcccttcaaggtatgtccaaaagagccgtaagcaccccaagcaatgagggtgctattatatttctgccaccttggttattctccaggaggagaaggttggaaaggatgtccagggggagagaaaaatgttactcaagccctggctatccacaggaaagttcaaaccagtttcactgatccaaaggcactaaggaggaagacagataaatcagacttttcaatgggtaggaggtaagactcattaggaatgaaggcctgtgagagaggcaagttagtacaactacctctactcactgcatgaacagagggctacaagttgaagcaacagattttcagctattagaggaagaaaaggcaagagacagacttggtttggagatgggttttgaacaatgcggctcctcagcaaaggctgatggccagattgagtatattaaacacatgtagctgagtcctctgaaaaccatttaccaatatagattagcgttttccctattagataacaaaaagtgaaacttccaataatttgtcataacgtttttgcataacaagcaactgattcaggtttttgcctggccttggcattcttaactccattttatttaggcattcctcaaatcaataactaccactgttttgaatggcatcagaatgtaagctctatatatatgtaaggactttgtcttctttaccccaacgaaaagtcccacacatatggcaggctcttaataaatttgttaaaaaacctgtatgatgaatcagatgctttacacatgatgattctaaccttatacaacccttgcaagcaaacatcccctggttactcatcaggaaacagacacaaggaagttaaatagggcctggtgcggtggctcacgcctgtaatcccagcactttgggaggccaaggcaggcagatcctttgagcctaggagtttgaggccagtctgggcaacatggcaaaaccccaactatacaaaaaaatacaaaaattaggcatggtggcacacaactgtagtcccaagctaaggcatgaggatcacctgagcccaggctggttgaggttgcagtgagccatgatcatgccactgtactccagcctgggtgacagggtgagacactttctcaaaggaaaaaaaaaaaaaaaaagagttaattgttgcccgtcacagcaattaatacagatccttctcactctaaaaccttacactcagtaatgatctactatatgcaaagcacctcttacatccttcaccaccccattcattctgagattgactcctcccctttccagaaacaggaccacctaaacattccctattccagtcccttatttgcaagtcatcaaaagaaaacagagatttcaaaaagaaaacagagaccttatctgtaatccttggtaaggatcttccaaatttaagcctatgccagttttcaggaggaaacatgaatatgaaacagtctgacctttagacataattttttgttgactttaaattcccttggttaggccactgtaaccagtaaaataaattttattttagaataaaaattataaaggggaaattgagtctagccatacaacctactactagttactatctttgattcccaagtcatcctagagcaaaaaaaaaaaaaaaaaaatcatctctggcctttttttccttttccactcaggtgaagagaatgagcttttgaatccaattttttgttttctcctatattcaattcaagtagctttaaagttaaccaaaggaaaaaaccaaagctcaatatttgattaaacgagaaaatatacactacttagaagctttcttttctttatccttcttccccaactcaaggcttagtagaattattgaaagaggtagtattcagtagaatagtacacatgctttttcaggtccagaaacaccacataggtcaagttatcatgcttacatgtggggaaaaggaggagggagtttcctggacctctgtgcctctctcagctcatgaactagtttcagtgaatatccttgtcttaccactgtgccaacaattcagagctatacgtggaaaacctaccttcaactttttgagtggcatctattgcttctttgattgttccttccagcaaggagcgatcaaaggctagcccccttcccactcccaccagaatcagatttgctcaagattacaaccctaatttagtaataagatgcaatacataaaatagttcccactttccttttccaatccctttacagtcatgagggcctatcacgcacgcatctcaggacaggtgagacttcattatatcaggtattttgttgctattctaagttataaggcagtaatacaaactttctttccacagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaag

SEQ ID NO: 108 - DNA, 16303 bp, Homo sapiens
cgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggtaaggcctgaaacccagcagagcagcagggaggaaaaacaaggctaagcttggttggagacttgggtgcttgtgtagggaagactccaagagcatgccacagctgcttgagagaaagaaattgcaacttttagagtcctgtgtactcttatttaagaaaggacaatctctgagaatgaggtggggttctgtttttggtggcagatgaaggactttgcagacttccggggttggaggagcctgactggccagcacaagaaggagcaggagaagaagaagggctgggcaggaggcattgccagtttgcttttagaagctcattcctgctccagcttcttttctgttgcctttcaggaactttccaggaaaacattataagttctctgtgaattgaaaatgtctttttcacagattccagaggttctaccactagagactgattttttgttaaatttatttcttctatattaaaaatcagagtcaaatatttctgagggaggggaacacaaatatttaaaaactgtggtataaattagtttttatgttgccttctgaactatctgaggatggagatgtgcccagggttgctggggagaggttaagtgctgagagggtggttatgcctgggagaagcagggtttcctgctaagcttcctttgctattggatttcttggctttcctgaaggttttttcaggcactgcaaatgacaatcaaccaaacagcaaggttttatttcaaaggataatgcatccagcatagaactaggccgcaggaagaaacataaaaacaaaacaaaataaaaacagaagaggtggtatcagctgacaagggcttatattctaagtgggtagacaaaataggcctacgaaaataacaagctggccatgaagctacatagcagaatatgcgagggggcaacgtgctaagttgtgtagtcataagccaggcatttagtaaggtgctaattatacaatacaggcagtgaatgtgaaaggaaaagggaggttgagatgggctgaggtcttctaggaggcggggagggagtgcagccttgacaagcctccctgtgggcgaggtgtaaagaggggcagaagtcagctctggaagcatagggcagtgggtggggaggagatgggctgggctgggctggagtagagatgtgtggagaagggtgagaagactggaaagacaacctgaatgggggactgggagccttgaataacaggcatggagaggagcgtctcttgaaatggaagaaacaggaaataattacagcctctatggaggagcaacaggatggactggagaaactatcattccaaaatccagttggggcctcaaaggcccttagaatttttctaggaaggttgaaggccagctgctgacccaggactcacatgtgcttcgtcctcttccctaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcctcacccagaccaattcaatcagaatccctaatagcagagctaaacaagggtaaggtctaaaagcatttccaggtgattctaatgggcagccaatactgagaaccactgttcttatgtaagaagcacatcttacctatatttcctaggaagaccagttgatgaggtcatatgcaaaagttcccatttattggtttagtataattgtgcaaattagaattaacccctaagtgtataaagagtagagctggttaaaaacatagcctgtgctaagtttaattgtacagtaatttacatttgtgtggtacttccaagtttcccaaatgccctcatatttgttatccacctgtacatttaaaccaattcccagaggttagaaaaggattcttatcttatctgagagacagtatagcaccatggttaaaagctcagactctgacaccagacagtctgggtgcaaatcctggctctgctgttgccctcagacaggatttcttagcttctctgtgtatcagttttctcatctgtgaaaggaggatgaatataagaccttatgcgatgctaatgtaggattaaattccctactacaagaaaatggtcttagaacaatgcctggaacatggtaagtgctgtataagtgttaactattagtatgattcccatttgtttgatgcaggcagaagctggagcttggagttgctcagagtggtagagctgattttaacacagatgtttttgttctactaaactgcatcctcagaactcctatttactgctgtcagttatgttgaagattaagttatatggttgcaaaatatgtgtaaactgagaagataaaaggttaccttaaagtttcctttcaaatgttacttctttttttttttttttttttttgagacggagtttcgctcttgttgcccaggctggagtgcaatggcgcaatctcagctcactgcaacttccgcctcctgagttcaagcgattctctcctgcctcagcctcctgagtatctgggattacaggcacccaccaccatgcccggctaattttgtatttttagtagagacagggtttcttcacgttggtcaggctggtctcaaactcccgacctccagtgatctgcccgcctcagcctcccaaagtgttacttcttaactgatttcacataggccaaacaaagactggttaagagttgaggctctggaattgcactgtctggggttgactattgcagttgaccccacgaagtctgggtaaattatgtactttttttctcagttttcttgtcgataaaatgtggcaaataatttcatgagctgatacaagtaaggtcttacaacagtgctagataggtaataagcttaacttcataagggctagtttttatgctatttattggttcatggttagaggaggcctgggacaataagcagggcaggggacctagattctggcaaagtaaccaagtgatggccttgaccattctgggctctttaccccagtgtcatatgccagaggacccatcaccagacggcaggaccgggaacagggagggagttcatcaggcagaaggcccctgtggagtggtagtaccagcaactgaagaccaaatgggagctatgtctggttgctaatctccaggccaggccattcatggagatcggtggtcctgacatgcacactcctccccaagaccacagtggcacggctatttcccagcctgaacctggggaaatgaaggtgcaaatttcttctctgtggctcatggacccctggggagagagatcagaagatgttctattggacccctgtgcagcctccccacaaagcctgtatgtttccacccttttgccattgcagactccagggaacaccattggtcactcggctcttccctcttgtttcccaagtggtcagttgcttatgtggaatgcaaactctccttaattacttgcattagcacaaaccctggcttctttttgaacctaatctcaaaccttagtccaagtccctatcctaatactatctgtaatatttaagctattcctaaccttaatgctaaaattgtacttaaccccaaagtcaacctggttaataggcagaagttttaagtaacccttatacagagtctgccccttccccaccctgcatgtagtgatgtcatgcttactcagggctgcttctgtttcaaagaccttgatatctttgttctatgaccataactgtgaatggagacattggtgcttttatttcaaaccaaaaattccaaatgaaattgatacatctaatatcccaagttccactctggtcccaattgtatctcgaacttatccttaaacctaaccaaactcattatcataatcttccctaaacctcaacatgcttttcactccatctatcttcatctgtccccaaggtgtaagagaacccaggcctaaccctgcctccaatctggctctgtccccaaactgatcatatatcctttcctggttttatggatagccctctgcagcccctcttacctgctgcagtgtgttctctatgacccctgtgctttccatctgtcctctttactccagagctaactgtatggctatggctaaccagaagccgtcctggccaactgtgactgagtccctcaaggcaggaggaacatgttctggggaatttgaattgtgcaggcaccacccttgtcttatggattggattcctaagccaccttttagcaacccagacccttaggtagagggatgagatgtgaggcttctgctgcatcctttgaagactcccctggatacctgagccctacctgagctgctggggcagactggaaacctacctacagcgcagcatgcatgggggtgatggtgttctttttctcacattcttcttgggtcagatcttactcatctcttcaaaactcccctcctgcatcttcttgcttccacttacatgttatctcttaatgaaatgcactagttcatgatttcacttatgccacaaatatttatatttactgagcattcgctatgtgtcagatgctgagaaaacagcaaaggataagagtccagagcctcatgccctccagggtttcacagcctagctggaaataagtgttataggcttaagggaaaaggttacatactttttttcatttttgtaatttaatgttaactttattttaattttgaattaaatatttttattgatatgatttcatatttgaagttcaataaaagaaaatattcactttctgagtttttttctggaactactatttgtttcatttcatgattaccaaaaatgattttgtcaaatagaagaaacgaatgttaaaatgacctgctctggtatcaaatatacaaggtacaccactgctgaaaatatcagtcattgatttcatgatgggccagatggatactctgctgttcaaagtgttgggcttaaaggctccagtcccatggttacacaaagggcttggccaatcctcccctctctgccgtgaagctcaggctgccctggggaaatcagcttcacttctggcttctgccactcatctctgttttgtcctccctctagtggctgagcacggtgccaggttccagattccattgcttggagccatggccgcgacgctggtggtcatctgcacagcagtcatcgtggtggtcgcgttgactagaaaggtaatggctccggctgcacaccgcagtcatgggcacccccacgtctggcacccgggtcctttcaggttctctttccacccagagagagacccagatgtgatcttcccgagtgctctttgtgcctttttcctggcatttgttctgcctattagtgcagttatttatgctcttccgttgtccctctcatagggagggaccccctggacagctggacctgtttcctacccatcttgctgtcatttgtaactcctggtttctgcttatcccttaagccactgctctgagagtttaatttatctactatgattttgatgcatcgtgggcatctatatatgctagagctttctgcacattagctcttttgattattacaactctctggtagtgctaggttacccagcatgtctgtagaatgagaaataaacactccaaaaatgtagggttaggccaggagctgtggctcacacctcagaagccacagatatggctggtgctattgggaaagtcaatgatctgtaatattttcatttatgtgttggctatcacaatagacataattccacccactcgggagactgtggcgggaggatcacttgactctaggagttcaaggctgcagtgagctatgactgcactccagcgtgggcaacagagcaagactctatctctaaaaaaaaaaaaaaattggtggtaaagtgggcatggcaagatcagcaggttgtaaatcctctgtttagcttaagagcttatgtggctgaaagagtaatgaatggggaattgaaagatctagtttctagttttggcactgagtgtatgcttttaggaaagttacttaatctttcaaggtcttcatttccttatatataaaatggggatttgtcttagtctattttctgccgctgtaacagaatacaattattgggaaatttataaagaaaagaagtttatttggctcatggttctggaggctgggaagtccaggagcatggtgtatttggcgaggttcatcccacggcagaaggcatcatgtgatgagtgcatgcatgtgagagagagagagaaatgaggccaaattcatccttttaattaggaacttactcccatgatacctaacccactcctgagataatggcattaatcccttcatgagggcagatcttcatggcctaatcacctcttaaaagcattaccacttaatactattacaatggtaattaagtttccaacacatggccttttgggggacacattaaaaccatagctgtattataattcggcttactctatatcatagagttgtgatgaacaagtggcatatttcatgtaaaatctttataaataacaaagaattatatcagtgaaatttatgtcatcagctactggtattgattgggaggagtgaaagaatttccactccttgttttgtctgatctcttgggccctttaagtcagctcagcccaggtcaccttaattcaagtcaccacataaatattttgggaaacacaagtttgtaatttctacctttaccccagaccctccacctgagatcctaacccacttttcctccaactctaattccattcaattaacaactcagttctgcagcctggttgaactgcagtggctgagacatggctggtgctattgggaaagtcaatgatctataatattttcatttatgtgttggctatcacaatagacataatgaggaaatgaaccctctatgggaaggtgaggacaagagaaatgattgaatagaggggggaggtgaagaagatgaaagttgatctcttagctgggaagggagctgctatggtggttggtgaacaggttctctgctgttagcagtgtcctgatggtctggaataaaagaatcaaaggctctttagaaggagctgaacaacttttcctgttaaggattcaagactggttaattttcattctgggcacctggactaactttggtcatctggagggtagagaaagagaaaaaggtgaagagacctattgagtcctgttgctccctttctacagtgtttgattccccagccctctctgacatttccactgcttcctgtgtagtgtgggtcctctctgcatctttcctgtgctttggatatagttgtcagtcttctgtctctctctccttgctcaaagcattttatagttgcattattcagggttccagcagggaacatgtagtactcaaactgggttgtttgaagacagtttaataataggatttccagaagtctagtaggatgtaaggacaccacaaggaggagtagcaaggtgctgtaaccattcctagttcttcaaagggtaggggaggggctaattattggagcctggaaggagagagttatgtggaggggtctccttcagaagtgctgtagtctttgctggagggtcacaaccagtccaaggccaccctgcagaaagaacaaagggaactacataccctcatctcattcctctctccattcccctactgttgctttgcattggctgacctcaaacttaggatggaggataaggggactcattgatgtagtacatttagtacagtcttcatagggcacagaatagggtggagaaggttagagagcagagccaagaggcaaatggctggtatccattcaagtagtgctcatagacatgaacactggacaaaggatcttgactttccacagggttggctggcttcagccttctctcttgtagtcttgacctcttttgattatgtatgtaagcaatacccttcttggctgcccagctgtatctctcctgggcacactgtgctctattaaccattttaatattcccatggatcaggctttcttggctcccattgaagtaattacatccattttgtttctttaagtgctgctatctgttctgtactattttgggatctcctcatcctcattgctactaggaatccagttctgtaaaagcatctcctattttagccctagcctatagaggagagatgccaccaaacttctcaatgatgctggagctcccctagcacattcttttccagcttagtaaaagggatattctttttctttttcctttttcccctttattgttgctattatcttaagggatgttctctggatcttccctagaaaagtcaatataatcagctattggattttggaaattattcagtacagggattggcaaaatttctctgtaaagaggcagatagtatatctttttgggtttgtaggtcatatggtctctgttgcaacaattcaactctgccattgtagtgtgaaagtgctatagattatatacaaatgaatgactatgactctgttccaacaaacctttatttataaacactaaaatgttaatttcatataatttttatgtgtaataaaatattcgtttttctttctataaatttttatgttttaattttttatatattttttatttcaataggtttttggggaataagtcctttagtggtgatttctgagattttggtgcacccatcacccgaacagtgtacactgtacccagtgtgtagtcctttatccctcagccctctcccactcttttccctgagtccccaaagtccattagtcccttgtatcattcttaacgcctttgcgtcctcatagcttagctcccacttctgagtgagaacatacaatgtttggtttttcattcctgagttacttcacttatagtagtggtttccaattccatccaggctgctgcaaatgccattattttgttcctttttatggctgagtagtattccatggtgtgtatatatatatgtatatatatatacacatatatatgtatatatatacacatatatatgtatatatatatacatatatatgtatatatatatatacatatatatgtatatatatatatacatatatatgtatatatatacacacacacacacacacacacacacagacacattacaatttctttatccactcattgattgatgggcatttgggctggttccatatttttgcaattgcaaattgtgctgctttttgtataatgacttcttttcctctggatagatacccagtagtgggattactggattaaatcatagttctacttttagttccttaaggaatctccacactgttttccatagtcatactagtttacattcccacaagcagtgtaaaagtgttcccctttcaccacatccatgccaacatgggttatttttttattttttgattaaggccattcttacaagagtaaggtggtattgtgttttgatttgcgtttccctgataattagtgatgttgagcattttttcatatgtttgttggccatttgtatatccttttctgagaattgtctttttatgtccttagcccactttttgatgggatttttttttcagctgatttgtttgagttccttgtagattctggatattagtcctttgttggatatataatttacaaatattttctcccaatctgtgggctgtttactctgctgattatttcttttgctgtgcagaagatattactttttaaaactatttttgttttaaaaaaacacttaaaatataaaagccatctttagttcaagggctgtaaaaaaccagcagtgggccatatttgacccacaaaactcagtttgccatttctgatttagtaggtttattctctgagcattttgttccccttttccatagtttgccaaagcagtgttgtcatctctattgacagcagtatatcagaatcatctcctggggcccttgtgagggtgttaaatattgagcgttccaatattgacgcattatccctcatccaggcttatgttctaccccctaccacaatccatcaccttcagaattcatgcctaggcatcttctcccagtccctgccagtagatgttagccaggtcctgtagtatataacctttctattctcttagcagacccagcacttcctccattagcatgggctgagattttatcctaattacgggcctgatggacagtaggggaggcagaggcagggcccagcagggattcttttccatcaaggggaagtgggccacttctgcagctccagatggtataagagaagcaggtggttcctggctctcaaatgcatctttccagagatcctcattccaagtttcaggagactcctcctctactatcaagatgctagctttggcatagaaaatttacctaggcttagaatcagccttctttaaagtcctgtccctcttacaattagcttatgtacctggtcttcagctgtggatagacgagtgtcttttaaatgctgccaaggaggagctttaactctcacactttgagttgctgatagatctgaggctgtcattttctcacttcagtccatcggtgcaatttagcaaaagtcaattttgagtcctaatattaactattaccctatactgttgacccaattccagagttctaacactaactatttaccctatacacctcaaatgttagagtcagtgcaccagctcatagtttccatccatctgtgtcccatctcatttcaccaccagtcatggggtttgtgttgccatctagcaggtgaatgatcccattccacaatcctgttcttacaggctgccttctaggactattcccagcagcaactgttttagatcaggtccccggaaatagagcctgacatgcaaattttggtgagagtgacttattgggacagctctcagatgaaaagtagtgaaggaagcagtatagggagggctaagggaagaaagctcagcatggatatggtctcagctggagacttggctgaagcaagaattgtacagagtcggttgaacctttaggcagggagctggcattttggaaatccacctaggtcagtcattacttctggctgctcaccagcgagggcccaagagcaattctccagagaaggggctgctgtgagctcacagcgtacactcccagcatctggaaaatgggagtgctggtcaggtagagagatctgagcaggaactgtacattagttatgggtctccggagggacagaaccaataggagatatagatggatggatggatggatggatggatggatggatggatggatggatggttggatggatggatgggtgggtggatggatggatggatagatagatagatagatagatagatagatagatagatagatgaggagggatttgttaggggaatttgttcaggtgattgtaaaggctgagaagtctcaccacaggctgtctgcaagctggagaccttgggatgctggtagcatggctcagttcaagtccaacagcctcagaaccactgaggctgttggtgtaattctcagtccaaggctaagggcctgaaaacccagggtcaggagcactggtttaagtcctggagtccgaaagccagggagcctggtgtcctgatgtccaaggacaggatgagaagagtgtgtcccaactccaaagagagaaagtacaattttgcctctcttctgttttgggaaaggcaggcctccaggtgagtggatggtgcttggctacatttagagtgtatcttacctactcacttcactcagactgacatgccaatctcctttggaaacaccctcacagacacacccaaaatgggctttactagctctctcagctcccttaatccagttaagatgatacctaaaattagctatgacaggcacaacagcattcactacagaccttgagagcccatagactgtgttatttaggagcatgttctttggaatcagacagtcctaggtttgggtcccaactcaaccacttgagtagctgtaccacctaactttgatgaacctcagttttctcatctgtaaaatgccgataattatggcattgccttcataaggtcatgagaaaacttcagtcaaataataattaatgtaaggcacttagcatttttcctagcatgtaagctggaaaggtgagtgggaccatcacaagggatgtttttgggatcatcacaagggatgttttggggatcatcacagtttcttatgaggaatgtagtgaaattatggattttcttcttgggcaaaattttctatacaatttacaaatcccctgaaatccagctgtgcatctcaggttaagcaccctcctatatacagtggagccattgaagagttttaggcagaaatatggactgacacaacttttgtttttgaaaatcactctgctggcgaccatgtggagttggactagaagtaagagggagtccagagacagtgaggatgaagcccaggtgtgagagaagacatggatatagagatggaaaagagggagtagatttcagaactgcctaggattaaaattggatgaagttttacagataaattgagttgaacattagcctccagatttctgctcagctggtgccataaaccagggcagtgaatataggggcaggagtggtttgttggggcaggaatgtgatggtgtcgtttgagacaatttgagtctgagcttgccgtgggtcatcaggtgatgatgcccagtggacaggtggacacctgcatctggagctcagggcagaagcctgggctagtttagatagagatttgggcatcttcagaggacagatggtggttgtagatgtaagaaagtagatgctcatgaaatcactcagagagcatgtttagcgtgagagaaagcagagagcagaaccctggggaaccccacggtttggggagctgatgtgcaaagagaaaaggggcaggcctggctgaagacgaaggtgggggttcaaaggaggagaagaaaatcaggagagagtgatgccaaaggatccagagaaagagaacatttcagaaagtaagaggtcgacagagtcaagtgcagtaaacagtacaagaaaatagagaatggaaagctgcctcactaagcttagtgaacaggaagtaacaaggtgtgtggcacgtggtatatgtagtaagtgcagtttccatggactagttagcatttaaatctagctgtaacgcggttgagaaattaagggctaaggaattggtgttggtaagaacataagtttgctggtgtgcatgtgtgtaagaaaggaagagagagatgtcatattggggattaactgttgaataacatccccacatactcactttgtagtttgtttgtttttagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatta

SEQ ID NO: 109 - DNA, 110281 bp, Homo sapiens
ttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggtaagacttccagttgtcccttcttgtcggatgggccgctttaggggcggatggggcctctgttcatttaaaatgccttgtgactgctgctgaaattgatcaccaaaggacaaatcattactaagggtttcagttatgtatttaagcggcaggtataagagagatgctagaatctagaaatgattactaatgaacactaaaaataagaagggaatgggtcatttgtgccactgctctgaggcattttcacccatttcctttctaacaggatctctggagtaattggcaaattgtgtttcttggaaatgaaatgctctccaaatggtagccaaaacaactgcggaaaaattaaaaattacaaagccatcaacgctcagagatccttgtttaacttttttctctctcaagtactctctttcttttggatataacaagtatttctcatccaaatactaaggtctttgggagttgaaaacacgttgaattttaatgaggcatgtgtaggtatgaacctgggagacaaagtggaatccttatgacagtgggaacgagagcctaatgggcctatttaaaaagagaaggaagcaagattagttctgtattccacagtatgagagtatcatagtaagcctgagtgtcttaagaattaactgtgcttttcagacatagctatgaaaatattaaggagaatttctaaatcaaaagagatttggaatataatgctgtagataggatcagagccatattttcaggcaaaggatagctcacaggaagttacattaaactgtactaacctctgcctaccaaacttttgcatccacagaagtatgataattcccatttgtcaagtacttttacttttaagaggcttgtttcttctcagttgcttgtcatctttttatcttttccttttgtgagcttcagtggtacttgtcacaataatatatatcatttctgtaacaggattccatgttaattctaaaactgaggccaacactattgaaggcatgtcacagtctcaatgcttaacacattttaagtgtcctgtatcactcagtcagactgctgatgggaaagagactctacttatgtctagtatttcagaccatcgattagaggtgatactaagtggaacctctacctaaggttagatgaggtcctttcaatccttgtatattgaaagtgaaatttcttactctaatcaactagactgaatttgggagacagtttggaagttatgtggaaggaaaataaaataaaataagtaataataaagtttaaaataataagcataacataggtaatagttaacattaagtataggttacttagaagttatatgtaggctaagaaatttaagtagcccctcccagcattgctaacaagttgcagctgtgagcttatctcaaccttccaagcttcttgcctgcccccagacccccacatatttctgtaactcctgttttaccttaccccatctctgtctagcttcaagattgactggttaagataactaaattgtaagttttctcagaattgtcacgggttaaataatttactgtctttgcctgaaacctgtatcctgccttgttttcccacctcaaacgacatataagcaagcctgctttctttgtcagagtcagcagccattttgggcatgagtctgctgtgggcctggatgcctgaattaaataaagttctctttggtctctaaaggtctctttgtcttccttggctggagttttactgttatacttatgagggttatagaaagaccacagactctgggcaactgaattcattcttttactggaggtgtgactttttttgttttgtttcgtttttcgtttttttgagatggagtctcactctgttgccaggctggagtgcagtggcatgatttcggctcactgtaatctccgcctcccaggttcaagcgattctcctgcttcagcctcccaagtagctgggactacaggcgtgcaccaccacgcccagctaatttttgtatttttagtagagacggggttttgccgtgttggccaggatggtctggttctcttgacctcatgatctgcccacctcagcctcccaaagtgctgggattacaggcgtgagccactgcgccaggcctggaggtgtgactttgagcatactgtttcatctctctgtggcccagtttcttcctcataaaaaggggttaacaacatcacctatggcgtgtgagggggattaaacaagataagatatgaaaggcccttgtaaacatgtatttttcaaagaaattgctatacacatatcatttatttttgcagtttcagaaagcatcacgtgtgtattatattcagctgtcgttttataacccaaaaagccaattatattaaacgtaagaagaatcgtcatactaagtttgctggtgtgcttcaattttcaaataggcttaattttattcacaggtagtctgaaaccttcaattatattttggtcagaccaacacatagataaatatttagaagtcagtaattacctctagcttctctacgtaaatgcctcctcatttatattgtctcatgcatctctatctgagtgagacacaagctctactctattcctaaagcagccagggagaaatttcctcagttgctcccctcaccttactgaagtgactagggtttttaattaagcgtcattctatgtgaattatttaaactcatggctcatgttctttcttttcaggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacggtaagcataactggtagagggatgtgctttcattcagctctctctcattcaacaaatgtacattttaagaaaagcaaggttaggcttggtgctcagcatacaaaggttgagcagaaagagctactgtctgataagagagacaggaagtgaccacagcatttaagtaaataaatgtaaacttgcaacagtgataagtgtcgataataaatactgtaacagtcttgtgaaggagcacatcacagaggccattgaaattgtcctttagaaattaacaccatagcttaagtctaaagaatgagtagacactaccacaatttaggaggtggggctgaggcagagtgggattgtgagtaatcccagagagagaaaagagcttgcatgaagctctttggagtgtttgaagaaatgggaaaatgccagtgggacagcaatacagcaattaaaggataaggcaggtaaggaccagatcatgttggacctggtcagcttcccttttaaaaggtttctattttgatctcagaaccataagaagacatggaagtatttccaacaaaaggatggcatgacatttataggctgactgtatttgtgttgtttaaaaaaaaaaagtcatactgactttcatgtgaaaatgaggtgaagatggacaagaaggagaaggtagagacaactcaggagaccacctcagtagcccagaaaagagagagtggtagttcaggtagatatagaaggaaaatggcaaattttgttcattgggcataaaacagatatgatcatagagagaatataagacaagggcagtatgaaggaaggagagaaagaagttaaaggtgacatctgggtgtctggcatgcacacctgaatggtggtgctattcactgtgatggaaggtaaaggaaggtttgtgggtgaatttatgaaagtgattctgggtatacaatatttagtctagggcaggtaaagggacaaaggaagctgctaactatgaagcattcacaccaaacatactttggaggcctgcatttagaagtgggaatcctagatttaagttctagctcctttctgaatagaaataaaatttgacttggggcctgtggtgtaaattctctgagcccatttggaaaatgattataataatgcctgccctaaattacctggtcctaaagtaaatgattttcatttctgctaatggaaaacaatgaaagtgaaagccaacagatgcaaaatgcactggcagtggactggttctaactcagggcaaagtggcctggtaatataagaaaaaaaaataactcgtgaaggtcatattaaagggggcatagagctgtccagaacaagcaacaggtatggatttatagcctcctctccatgtcttataacttacttgctttaaaaatatgctgttggaacagtccacctataggccaaggtcccatcaactactatcttataatgcccaattcccttgctgttttccaggaggaaaacacaccacacacacacacacacagacacatacacacacacacacacacacacacacacttcagttcaattaaggatggagtggagtgggattgaagtaaagagaaatggaagacctatatagaaaactgtttagctatacatagtttgattcaggtagcctgtatttggatattggctctatcatttaccatacgtttcatcattcccaagttgtttcaagtttcttacataacaaatatggataattatagtgctttctttacaggtatcactagcttggtgattaaatgagataatctgtgtaatgcacttaaacatatagttcctgctaaaggataagagtttggtaaatggtagttttcaattaagaatagtaataattatattgagcaaattctatttctcagttccaattaaatatgagccctgctccttctttttatatattgacctcatttggaacccagtaagacatttgccatgtaatgttagtacaagtacacattgaccttggtttcatacatagttttttttgtacattctgcctgaaccagtaaacaatactattgcctcacggaggactcagtgtttccttcattgagacttggcaacatggactgatgtaccttataggaaatagaataagtgatgccacaaaatgaagacagcaatggagaacagatagtatattatccagaaaggaggatgatgttgcctttaaagaaatgtatttcttaaaataaagagaaccaagggagttaagcttgtagctactaaaaactgcaggtcactggagaggcagaaaccgtatctatactttttgcggttggaaaatttccggtcttctgaatgtaactttgctgctgtcatctggatcagatgaaaagcaatggcctcagtgttagagaaatggttctggtattgtgattttgggtacaaagggagtaaaatagaaaagagcaaaacagaagggggaaacatccttcaccacagagtgaccacaaatgtaagcctggtacggagctacagagtaggcagctgactaaagggaggcagttgccatctgagagctctgtcaagttcacaaccaatagcatattttctttctaccctttactgttttgatcttctcttgcttcttctcctctcacttgtacagttttcttcttatgcccctgtgcaatctttaagtttacaagctagttgggtaagcaaaacacacctgaagtgcaaacacttatatagtacataaacaaatgcaaattgaagtggtgcataagaacctaatttgaaaatgctgagggacttgaagtgtttgagttgatcatctcttcctgtttcttttctgttgctgtttgagtcattctctcttgtctgctcacaacacagtgtgtgtctaaatcctgttcccatgttccccaagggcctagctgtgaaaggattctgttctcttttcacaatattttgtctctgtgtgtgtcttagtgctctgagattgtggacaagagtggaaatataataaacagtgtgaggtttgcctctttttcgctttcacttgacagagtttcctcctaggttaggagattttcagtcactccaagaaatgcagttctctgagttaagccttggattgtcataatctagatttcattcatttgaatgctactggatcccataatgcttcagattgtaagattttggtgcattttaaaatttgtagttattaagatcagttataagagtataacatggctttaatttactagttcacagtaaatgccttggtgggctgttaatgttattggaagcagtagtagcagtgaatgcggttggagaagtcatggtcctggaagtagtagtaatagtagcaataaaattttgatactacaatgttgataagcttggtctaaaacatgttgttatcctgtctagtttgtattgagcctgaatgctggctcttcttaaattcctgtatttagtctttatccaacaagtgtttttgagtgcttacagtgctagacactgggcactaggcacagagtaggcatatatgcatgactgtgtcttcatgaatcacaaagttcaataggaagaagttgacattcatcaaataagcaaacaaatatcaaattgcaacagtgagaagtgcttcagaagtgaggaagtagtgtatgagagggtataataggaaaatcagaaaagactttctttactttgtcctttcctttcccttcccccttattttcatttccctctcttctcccctcccctctcttcccctcccctcccctctcctttcctttcctttggaagcgctgcttcaactggagttaaccaagtgaacacagagctttacaaagaacaggacatgcaaaggttctatgggggaaggaagttataacaactgggtaggcaggggagattttaaaaggtattatggctggagcagagggattacaggtgaggcagttgacgataaggttagaaagattgattagtccatttaaggagttttgtctttatcctaagagctgtgggaactaattaaaaggtggttgttttgtttgattttttttgttttgcatttcaaaaatgcatctttgtggttcaagtgtagagaatgaattggagaaggcagagacgatagtgtggatcagttagaagacaacagcagaaagctacatgagagatgctggtaccattaagtacagtggcaatgaactagaaatagaagaatgtttagattagaaacttgtgtaggagattctccccacaggatcagtggtggattgcctacgtgaaggaaggaataaaaagcagcgtcaaggatgatgctttaatttctaatatgtgacacagaaaaaataggggaacattgtattagggaacactggaagatgatcagatcatacagaaattattttgcatttaatcttatagatgttgagttaggcatgaagttgtgacatacagaagacgttaggtaaactggatatacaatttcagatctaggagagaggtttaagctgaagatacagagtcatctgagtgtgagtgttaactaaaattctgggagtgaaagaaatcctctaggaagagaaaatcaagcaagaaaagccatgtggcacttcagcagagtccatggtgacggatggagaaaggtgagtcttcagaggataatgaagagcaattaaagaggcaaaagtagaatcaggagtgaattgggtcacaaaaacctggaaacatattacataaaaggaatagccatcaattataaagtttctaagaagataaaatagttattcgaatgtattttaaaacatgaagttttttttatcacctaacaggaactgtttgatggcattatggaatggaagtcaggctggagggagaagaggaatgagtgggaggcaaggaaatggggacagcacattgatatgactttcaagaaatctgccagtagtaataggaagagtagatagaggtgttcaaatgcgggattctgttgatactacagtagtgatggtggtggtggtttcaattaataagaaacacttgactgtgcttcaaagttaatgggcaggatctagttgaaaaagggtagttaaatacacagtatggaagataaaataataaaccaaggtttctaagaaaatggggacaatgatactcacaacacaagtaggactaccccgatattgaaaaaaaaagaacagtttttttttattgtaacaggtgggagggaaaataagatgagtgcatatgatgagggaggtgctgtcttctatttctctaaaataggaaacaaaaccatcttcagctagagagaggaaggaagcttcagaaaagaagattgaggaaggtttgaaacagctgctatggatagaagggaaatggattcactaagttaacacatttggatttttggtctgtgttgaacatccatttgggtatggtatgaaatggtagtgaaaacaattcgcacaaggctttctccagcagtgattggctgcttgagtctgggcattaaaaagtacatagtgccacatttggattcctttttagattgttgccaaaaggaaaacaaaaaggcaaaggatttggggtataagcaaaaatattattgacataatgcactatagaactttagcttgataataagagatgcaaagaaaaaataaagctggtgatttggaaaaaagtagagtgattaactcattaaaagaccaatgaggttggagaacagttgaaatgaaactggttgcacaaactggaagaagagatgtttgtaggtctgaatttgtgattttgtagatgagctattttacatgataacaagatccaagatgtgattgtgagagtagatggctaaaatgaagtggagacaattaatgaagatgacagtgggaagaactgagagtccaggtattggagaagtcatctgcatggtcactgaaagcacctaggttatgtcaggtttggggctgcaaaatattgcagtctacataaaaacattttcaaagaaaaacggagtgtgattgggagattacagcagaagttgacaaactttttctctgaagggtcatgctaagctttgaatatttgtccccttcaaaatcattttgaaatttattgtcattgtaacagtattaagacatgggaccttctttttcttcaaattttaagttcaggggtacatgtgcaggatgtgcaggtttgttatataggtaaatgtgtgccatggtagtttgctgcacagatcattccatcacccaggtattaagcccagcatccattagctattcttcctgatgctctccttcaccccaccacaccctccgacaggccccagtgtgtattgttccccctcatgggtcagaatgatttataacagaatgatttatattcctttgagtatataccagtaacgggattgctgggtcaaatggtatttctgcctttaggtctttgacgaatggccacactgtcttccacaatggctgaactaatttacactcccaccaacagtgtaaaagcattcctttttctcagcaacttcaccagcatctgttctttcttgactttttaataatagccattctgagtggtgcaagatgatatctccttgtagttttgatttgcatttctctaattatcagtgatgttgagctttttttcatatttgttggctgcatatatgtcttcttttgagaagtgtctattcatgtcctgtgcccactttttaatgagtttgttttttttcttgtaaatttgtttaagttcctttgtagacactggatattagaccccaggccctttaagaggtgatataagggctccactctcctggaaaagatttgtggcaatataaaaatgtgtgtttgtccccctcttttctctctgtggctcttctgctcttctgccatgtggggagcagcattcctccctccgaggatgcagcattcaaagtgccatcttgaaagaggacaggacactgggctctaaccagacaccaaacctgccgatgttttgatcttggactttccagcctcaagaactgagataaacaaatatgtcttttaataagttacctaatctcagatattcttttgcagcatcacaaaacagactgaaatagtccaaatactaaatattttaggctttgtggtccatgtagtctctgtcacaactactcaactctaccactgttgcataaaaagcatcacagagaatatgtaaatgaatgggcctgactgtgttctaattcaactttatttacaaaaataggcaacaagccagatttggcccacaggccaaggtttatgacctctgagttagaggataatagcagtgaatcaaggaagaaagggattgttttgtttttcttaaaatatgttgctcataactgacaatactggtactggagatggttttaggtgattcatgaaacaactataaaagctttaattgtggaaaactctaaacaatatacaaaaaatacatagaataattatgaaaattatatagaataatttcccacatactgaacatacaacttcaacaattatcaactcataggcaatctcattttatttaaacccttatcaactgctgccttccaagattactttggagaaaatgcaagacttcttgtttattttagtatgaatctttaaaagataaagatgtcattaaaaaaaagccataatctaccaccaaaactaaaaaaaaattagtatttaatattattcaatatcccatcagcctgatgttatattttgtttttttttttaaattaggatgcagataaactagatatattgtgattatttggaaattcccttttaatctgaaagctatattacatttgttatttttcctttgcgatatatttgttgaataaatttgatgatttgtccagcctggattttgctcttatagtcccatagtatctctatgttttcaccttatagttagacttataaactctaagttatcttatattcttgacagagacttgataacatttaggttttcttttttctttttttttttttttggcaagactacgtgatagatgatgcatagttatatgagaggcacataattctggttacatgatattaagagccactggtgagccttgcctacatccattaaatcattatgatttgccgaatagaaatattctatcattccctaatttattagcttaagtatttctataaagagaaacttcctctcatcaacttattatttatttgatgtatagtttgtataagaaaagcagaatagatacttgattctttccctttaatcaccagttttaaaaatgagttggttaactagtatttttagaaagtgacccgtaagtattttatgttaagtatcatgaatttatatgaacttaaacatactgatgaatttcaattcattacggttattatccttattttactgaaaatttcccatatataaaacctattaatcctttgttatataagttgcaaatattttcccagtttgtcatttattcttactttcttatattgtttgcaatgcagcatgtttcttatttttattaaataaaatctattactcttttcccttattggtcctgattttaagttttggtcaagaaaagttttcttcatttccaaattatataagaattcactcataatttctgatacttgcatgctttcttttatgagcatttaaatttgtaacattaggtttctggtgcaaaataaaaacacctaaatttacatttttatatatctctaatgccttcttctatattttctactttttttcccttctgtgattcaattaggtattcacctgtcttccaatcatgaactctatctctatgatgtccaataagtttttaccccatcaaattagttcttaatttctgatattgtatttttaagttatttgatcacatttgatagatttttaatttttgataaatttgtccaccttttgatctacttcctccatttcttctctgttttcttgactatatgaaaaagagttattttaaatctttgttggataactccaaagtcagaagcatttgtttgtctgttcctatgtctatttttctcttattttctttttttgcaacttgctccaccgtatctcctctaaaccactctgtattactaaatatactgcatctatatcaaactataaagtacacgtatataataatatatgtattaaactcaacagttcagtgttaaattaaggatttaaagcagcagtacccaactttttgacactaggtaccggcatggaagacaacttttccatagactgtggtggagggggatggtttggggatgattcaagcctattacatttattgtgcactttatttgtattattattacattgtaatatataatgaaataattatacaactcaccataatgtagaatcagtgggagccctgagcttgtcttcctgcaactagatggtcccatctgggggtgatgggaaacagcaacagatcatcaggcattagattctcataaggagcacacaacctagatccctcaaatgtgtaattcacaatagagttcgcactcctatgaaaatctaatgcagccactgatttggcaggacacagatctcagatggtaatgcaagtgatggggagtagctgtaaatacagatgaagcttttcttactcacacactgctcacctcctgctgtgtggccccattccttaacaggccacggacaagtaccagtccatggtccaggggctaagaacccctgatttaaagaatttcatgttctttaacaaaattaagagaaaagaaaagaaaaataaatgtatgtatagtttttatttactcacatatgaagactacatatataatttttcatatttactcacgtatttaccattttttgtgctctttattttatcccatgaattggagttactgtttgttgtcatttcttttcagcctgaaggactttagtatttcgtgtaagacaaatctacttgcaatgaattctttcagattttttcatttttaattttaaaggataatttcaatggatatagaattcagagtggattgtttctctttcttttagcattttgaatatatctttcgatcgccattatttctgattaaaatgagccactagttatattattagtctgctgaatgggatgagcttttgtttttgtttgtttggttggttggtttttgctcctttcaattgctacttttataatttagtctttctttttggcttccagaagtttgattatgatgtgtcttttggctttcagaagtttgattatgggtgtctctttgtgtttgtcctattcaggttttgttaaagttcttggatgtgtagattaattttaagaaagtttttaaataatcaaatatgtgaagtttttggccattttttcttcaaatatttgatccatccccttactctttcacttctttttctactactcctgtttcatgtatgttaccatacttgatactgtcctatatggctctgaagctgttttcatttctttcaatcctttttctcccttgagattagataatttatattgaacaatgttcaaatacactgattctttcttcagccatctcaaatttgctattgagaacatctagtaaatttcttatttttgctactgacatttcaactctaaaatatacatttgcttcattttatagctttctatttctctactaacatttcctatttattgagtcattgtcatattttgctttaatactttgaatagactaataacaacttcttttttttttattatactttaagttttagggtacatgtgcacattgtgcaggttagttacatatgtatacatgtgccgtgctggtgcgccgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaaagatgatttccaatttcatccatgtccctacaaaggacgtgaactcatcattttttatggctgcatagtattccacggtgtatatgttccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctggctcaaatggtatttctagttctagatccctgaggaatcaccacactgacttccataatggtggaactagtttacagtcccaccaacagtgtaaaagtgttcctgtttctccacatcctctccagcacctgttgtttcctgactttgtaatgattgtcattctaactggtgtgagatggtatctcatagtggttttgatttgcatttctctgatggccagtgatgatgagcattttttcatgtgttttttggcagcataaatgtcttcttttgagaagtgtctgttcatgtccttcgcacactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccattcgtcaattttggcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttaattctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctctattttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtgtgttgttggtgtataagaatgcttgtgatttttgtacattgattctgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttatcattttgaaatacgtcccatcaataccgaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattggggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgactattgccacaatttcagctcctgttattggtctattcagagatgcaacttcttcctggtttagtcttgggagagtgtatgtgtcaaggaatttatccatttcttctagattttccagtttatttgcatagaggtgtttgtagtattctctgatggtagtttgtatttctgtgggaaaggtggtgatatcccctttatcattttttattgtgtctatttgattcttctctctttttttctttattagtcttgctagcggtctatcaattttgttgatcctttcaaaaaaccagctcctggattcattgattttttgaatggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgtcgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcgtggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatatgtgtctctgcacgtgagatgggtttcctgaatacaacacactgatgggtcttgactctttatccaatttgccagtctgtgtcttttaattggagaatttagtccatttacatttaaagttaatagtgttatgtgtgaatttgatcctgtcattatgatgttagctggtgattttgctcgttagttgacacagtttcttcctagtctcgatggtctttacattttggcatgattttgcagcagctggtaccagttgttcctttccatgtttagcgcttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcacattggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgtgttcctttggaggaggagaggcgctctgcgttttagagtttccagtttttctgttctgttttttccccatctttgtggttttatctactttcggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctgcggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgacttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcacttcccaggtgaggcaatgcctcgccctgcttcggctcccgcacggtgcgcgcacccactggcctgcgcccactgtctggcgctccctagtgagatgaacccagtacctcagatggaaatgcagaaatcaccggtcttctgcgtcgctcacgttgggagctgtagaccggagctgttcctattcggccatcttggctcctccccgaataacaacttctttgaagtctcttaaattcaacacctgggtccacccagattcagctgcaattaccttttttccttattatgggtcacacatccctgattcctccatgtctcataattttgtgttgaaaactggacattaaaaaatatatatatatttatagacagactatagaatatatatatatgttgcaactctatattatgtcttatttaggttcattttgtttcattttagtaacttatctgtgcttaaattgaatgtctcctttgcaatgcaaggccattgatctctcttctcgatttttatactaatagttattttttaatttggcttgcaagaagttgcccctgcattggcaaagccactttattggtccagccatgattttggcaaaagttatgctcaaatacttaaatccattaggcttcctctctttatgcatagatttgtgtgtcaatcagggagtgcattcaaagttgcagccagttgtccagacttcctgggcttttacattttgctacgctcttttgggtctccctgactcagtgtgtagtttcctagtcagggtataatctgtgaagtctttatcttagccattccatgactctagtttccaggatctccatgttaaaggtctttctggtctagcactgtctttgttttgtgctgctctaacagaataccacagactgatacattagaaaggatagacatttatcttctcacagttctggaggttgaaaatgtccaagatcaagccattgacatctggtgagggcctgcttgctaaatcctctggaggggagaaatgccatgtcctcacatggtggaaggcagaagggcaagagacaaaaggggaattaactcgcccttttataatggcattaatgccactcatgaaagctctgtcctatcacctcccaaaggttccaccttctaatactgacacaatggcaaccaaatttcaacatgcatttcagaggggagaagcattcaaatcatagcagccactcactccagatgggaatacaaacccaaactaaccaagcttcaggttttaggcacctacgaagtttgcttctgttatgggaaaaggtgaaaggtttctatccctagacctaatttaagtctgcccattgtggaaaaaaagctgctggtttttgcaaccagctccatgtggctaaaactacatttcttaatgaccaggttggagaagggaatggatggagctgaggcaaaaagattgaagtctcctgctgtttttactaaagctctagtgatttttcaataagaaatgctttgcaatttaatgactacctttagtcaatttccacggccctaaaattgttgttgtttttttaaacacatttccccagttttgtacttgtctgtttttactgacctcctcatgtccccataaccagaagtctctcattcctacaccccatattttgatatttatattgtatctttatttaaaaacatatattcatcactattccctttgttgtaacaattatatattcttagtgctaaaggtaaatagataatcaacatttaccactaacctttatgtaaatgcatctccagtttgaaatgtattctattggagaatcctcaggaaaggctcatagcagcaatattctctgagttcttgtgtaactctaacatctttctgtagtctttattaaaaaagactttattaaaaaagaatataaaatctttggctcacattttctttccctgagtatattaactatgttactctattgttttctggcagaggactgctatcaaaaagctaataacaatcagattttctttccccatgtttgactttgctcgatacttttatatgaacatgcttaaagttgtccattctgggtctattttcctattttgcagtataatcgtttaatgtgcagtttctagtcattttaaattttattatatttttcttgaattatagtttttaatatttgttctgttccattgctttcatcttttttctttaatgtcttttattgtacatatatttttatcttctttgcatatcatttcctttgaatctcttttatcaacttttttctttttttataattacatattgctttatttatttcaaaatttccctcattctattttgaaaatgaacttcaatgaattaacttttgtgtttctgtgtttctggtttcattctaattttgtcttagtttctggagtgatttttaaaaatttattatttctaaccctttctcgaatttcgttacctatgttttgtaagcttttttcttccactggactcattgggaactttccaaaattgtgcacaatttcatcattttatttcttttagctcattttgaataatttggctatagtttttatttactttgttgtcgtgtcttgataatatgctctcattgttgtaggaatgttattttgttctctattctttttttgcttctggtatctttataggttattctatctcattccctttctatcactcatgcttaagttaaatgcattcttatcacagaggagtgggccagcctagcttttctagagtgttcagtatccctaaagccgcctcttctgttattttcaaggtaagtaatttaccattgtactttctgagtgtatttcctttgcttctatccctcacttttacctaaattgcctatttgatttctcttagtggacctgtcctgtcttattggattctatgtccagcagttttttctccccatggcatgtgtcctgagaagtcctttctgctccagcactgacaacctttttcttatttttcttgaagacactggtgatttggtgcccgcaaactctcttctccatttgagctactattcttggattaatctacctgtctttccagtgattacctgttactaggcagagggaggtggtatgggttctctagttctaagatccatcagaagcccagttgatcttcctctgtttctgcacagttactgatagcacagtggtttagtggatttttccccaccaattaagagggatgtgttgttatttagtgttcgtgtagatatgatctatgtatttttagttttgttaccctatttatcttctttgtttttatagagggtttcaggtatattcaaaaagtaatgccacttatactgccagcttcccagattctggacaaaatttacaaaaatgtaatacttatgtatttgactgatgttcattaaaatataactaacatatttggattgcatggacttcagagatattcagtatattttaaataaatatatataagtaaaacaattacaataatttaagaataaaattagatagtagtaatggtcttatgcaaatatggcaaaaaatgatgatagtagagatggtatagaaacaactccatttggaagtgctgtgatagctaagtgattttttttctccttaagggacaggggtcttttttttcaattatgggcttggagtactatttggaaacagcagtggagagcaaggaaagcactgatcccacctccagaacttgaggaattagagtgcaagaaaatatataaccactatttggaaatgctgtggggaagatgtaccctaatgggaagatctggttttaattaggaaaaggaggaggaaagagttattggtaaagaagatagatgatattgataagagattaaaatataacaaagatctaaaggctagatataaaatttataaacagaaatatgccattaaaatgtatactgttatatagcatatatttatatatatatttatatatataatttttagccctaaattggtgctttaatcttcagtttccttttccttgatcagaaagactataaaacttcataacctagcctttgcctttttattttgatggactaatactgtataaaagttataccgttttataacatatatatatatattcacaatgttagtagcaataagaatgttcatactcaatgatccattaattatacctcagagaatttatcttaagtagctgaatggtcagaagaaagctattagcatgaggatgatccttgctatatagcatgtaatggtttaaaataaagtaaaaagtccaaactgaaagagcataatgattcaataattggaaatgactaaatgaatgatgattagtatatatgataaaatgacatgaagcccccataaatttaaatcacctgtagttcaagaatcacacaaaacattctaaagtaacaacatatataacattcattggtaaacaggattgcagactatgagaatacatgcatgtatgcaaacaagatttgaatatagaaaaaagaatataagatttttaggatatttagatggtagagttgcctttatttgtaaacttcttttgatgctatagtttagtcacaaatttatatgtatgtatataaaactttcccaataggagagactacaaaatggatatttatcttctattaccttaaaaatgaaaataattaacactgcttcctcaaagtttccttatatatgtttgtgtcattcctttgtgggaggaatgtttataaactctgggaagactgttagatatgaagactgtaaaaagaacagaattttagggcaggaaaactattatgtatgatactataactgtggacacatgtcattatacatttgtccaaacccatagaatgtgcaaaattaagagtaaaccctaatgtaaactatgaactttgggtgataatgaagtgccagtgtgggttcgttaattgtaacaaatgtaccgctgtggaacaggatgtccacagtgggggaggctgtgggtgggtagaggtagtagatatactgggaactttgtactttctgctcaattttgctgtgaacctaaaactactccaaaaaataaagtccaacaaaataaaaagacagttaaggctaggttatgaagttttgtattctatctgatcaaggaaatggaacctgaagattaaagcaccaatttggggccaaagcagaacatgccaaatcatgagtttgattctgttggggtcatttccttgtaatttttcagtgtttagcaacaattctgtgctcctcagtgactctgtttagccacttatacaatgagggctatcgtgggagtttgcctctctttttcataggtgtaccctgaggacagatgaatccctatactaaaactgtttttgtctctttgataaaaagcactttacaaaccaatcagagattcacatattttctaccttatgttttgttacagttacagcagatgaatggaacagcaaccatacgatagaaatagagataaatcagactctggaaataccatgctttcaaaatagctcctcaaaaatttcatctgagttcacctatgcatggtcggtggtaagtgttgcccttttcagtgaataacctcaatggtctttaaacattaacgaagtaaaatgaataagcagtaataatagggaaggaagcatacaaataacaggcaggcattatgccagtggtgggaagaggggtagggaaggaaggagaggtcactcagattccttctcacaggcaagcctctgagtctatgaatgcagtgaattaatttataaatttgcttctaaagattgatttttacttctatctatataccaaaccatggttacagaaagaacaaagtgtgatagtgccctagaaaggagccatattcagcagaagcccctactcacagatacttgtttcacaaacaacatatgcagagctacagactcctttctccaaaaacacttattactacatcctgggaaatatccaacattgggttagatagggaagcacagactctaatgcttgtgaaatataagcagcaaatgtatatgagacgagcaggccttgtataagaaacagtcactgcccagctcttgtaatgccacagggggctgcaggcctatagttgcatgccttctcattaaaaaacaaaaaacagacaaacaaacaaaagccagaaatctggatttttatgaaaaattttccaattttaaaaatgatgtgtagagcaaaaatgaatagtggtctattattttgatgttagagcaaaaataagtactggtctattattttgctaagacactgtaaaatataactctaattataaatttaaaaaatttcactgaggattcactttggcagttatggtgggccaactattaagttgcttaacatgcttaacatgtcctgtgatgactaaattctcccactacttttctctccttgaaatactgcagagttcatctatacagatctttatctaatcggatttatgatttaatttggcctgtcccttaacaaaactgcatcagttatctactttgtctgcctttgttattttatccttagtctacattgttctgcctaatgcatcagtttatttttaaaatctaaatttaatcttaaaaactaaaattgagctttttctcataacacgtaaacaaaatcaacatgaggataataataaatatgaaagaattgtgtcattataactttaatgttagtcaaccaaatggcagccagctactaaccagtgtatacagtaaacccctaaaactgttaaaaacaaatgacaacaaagagacaaacacaattatagaggtgatcataaacatgatttcaagaatcacataatagggcattcatttagatgatacagaatatgattactgtatgttaatttttatatttttgtcaaaatgaaaacaaaggatttaaaaattcttatgaaactcacagattctcatgaatgtaacagctggcacaatttggaaaatactgtgattcagatggctgattattcatattacaagctacctagatttttgtggacagtcttggaaactagaccctatatataaaaacatttccttgggtttgtgccaaacccaaaataattgacttgtactaaaaactttaaatacaacctactgataatttttcactgtctaggtatttttcagatagtaaataataaaaagaattatattttaaaataactttcccaaatggttgtaaaacctacagtatctctttgtcatctgtcacaaaactcgtctgcccttttataggatttgctttccaaaaagtaagtcttcctggacagtaggcctatcattaggatgagtataagtccattgttcttaataaacatgatgcaacatagttctgagaaaaaggttaattaagtgagataatttcaggaggacagaaatgtactatactaaaccttttagtaatgaaatgcatagcttgcttaatattttccaccaacagagcagaaagttcctatcccagttatctcaaattcattaacaatggcaactggtttaataaagccttactgtagatatttttactgtagtgttcttatcttgtctcatgggtatgtaatctgtttttctaagcaaatgtaaagccttcagtatgtgtcttttatgtgagtctgagcttctcctggacaaaaagttgtatctctcatttctttttttttccaaagtataaattcatattttgtaggaaatgtagtttacaaaacagtatcaatcgctacccccaatccagatgacccactttcctccgaagggggacgtttaggtcctattccactgggcaagggtaaaatgattcagtagtcttccaggttaacagtaaattcttctcccaaggctggggccgtcaaggcacagtctgtatgaggctcaccctgtctgaccctaggctggggctgcttgctcggtaggcaggaattggggtgggggtgggggctcagggaagggtctgcaccctgagacttctgcttacaggagggtgctgggaaaaccctgccttgggttggggaatcccctctctcccacctttggggaatagggtggggagggggtaagtgggaccctgctgcctggagggctcaggtctgagcagcagggagcccttagtgcccactccagcagacctattgggaatttactacctgaagacaaattataggtctagggtcttctttgtgattttgggggagtcgaggcattggggggtgagaggtatggtctaaggtcacagtctgggagaggagtccttgggatcaaaggttgtgcagaagcaccttccccacctcctgcctcatgagataaggttgccaggattccattatcatggtgaatttctctgggctcgtgggttaggggtcacagtggagccaccaaggtagaaatcacaaatgggacgcatgtgtgttaactgacagtggcctggccagacatcagggggcactagatccttggcaagaaagctaagggatcaacaggtgagatgtgagacaccaggcgcatggcagctcacacgtacatggcccgggacatgacaaagcatttgccctggtaggaatcagaggggctgctgtaggacagagcatcatagatggggttgatcttgtccagatactcttcctcctcctccccctcctcatcctctagatccagggaaacgtcttccaaagcaggtggccctggaggcaccgggatgggggaccccaggcttgtggctccagggtgcaagggtcctgaccgctcttccaaggtgggcagctcatggtatcgaggcatttcctgctcagtgcatgaggcgccagcgtcaaagtagggggtcttgagtgggctgtgctctgaggccaccagagtgaaaagctgggagggcatctcctgctcctccagcttctcttttggggtcagcggcttgtaggagggaggtccctccaggctgtggggtaggaggtaggtcaagtggagactaagacccgggcatccctctgaatccagggttacagcacatgctgttccctctacctgggtcccccttttccctgcccccttttcttgcctggagtaagagtttttttgttttgttttggtttttggtttttggttttttttttttattgctcatttcaaaaatctccagcatctagtatagagtctagagcataggtactcataaatacttaataaatacttgaattaatttatttctatttgtcccctttccccacagtcttattcattgttctcatattaaattaatgatcactaaattcatgctgtttgattgtttaatgagtggcagctcattaagtatcaaagacttgacaactgatgagtcaccgtttatcaagtagcttcctttaaagaaactaagaaggccatgtagacattacctttggattctgccaggacatttagagtaaatgaatgccagagagtgcatctaaggtcacacagtgagagggtgaatcttaaacatccactagaacctcaagccatgctgccactttaaagaatgcaccatgataccaacaacttgaagaatctttctaaagaaacctttcttcaaagggaacatggtgttggcaaatgtgctgattaaaatcctatggtacatttcctttcaaaatgtcaaaatctatttgctcctctcatttacatctatgccccacaatattgatggctgtaggattcagccagtctattaaaccatctaatgtccttataaagtagattacatagggtggttatagtctcccttaaatgagaacaaacttcctaaataagtggagggaacaaactgcctgacagttcataaaccacaccctgggctcatggttagaacatcccacagcaaggaagtaaaggaacagaatggaaaaatccccacattcatgcaagtgcagaaacccatgattagtgtctttgggctgacctatgctcatcataatggtaaaaaacacacccatgagtagagatttaagatgttaatgagacatgccatgtatctacccgcacgtacaacaatagcacatgcacatcgggaggaccaccccgaacatgcttaatagcaacacaccttcccaacccttcatgaataatcatatgagactctcataaagggagtttccctagtgtcagtcagcatcatctcacctttgagtagcccgctgtgatcagcggtgagtgtacttttgctttgcagtaagctctcttacctcttttcattttgaacttgctctcaaattcttttgtgtggtaaagtcaaaaacaaactggtgccactggcaacacttatattagggaataaactacaactcttagtatcataattgttacatgtctgcaaaggacacaaatattccagccaatccatatttttggtctttaatctcttcttaaactaagaataagaatcataagataagcctattgttcttacaaacatatataatctctttagaaagagattacaacatagaaatgatgaaggtgagctcaggagagcagaaacttcctatactgaactctgggaagtttcaaaggccttctgccccaagtgactcatgaaaccctggaaacaatttacaaactaaaattatctaagtcactgaaaaacaaaagtgatgtcttcctgtttgtggaattttataaaagctaattaattcaattatgaccctcataggaaaggttataattgggattctgtctcataaaataaactcttatgccacatctgcctgatctcatgccaaggctgtgttaagtgtgttaatgggacagactctgcattttgggaagttacatcgcaggactgggaatacactgaggtagacgggcatcaggtgcaaatggacagtgtatctaacattcatccagcatgaggggtaactaagtaaacacaaagggttaactctctaatggaaactaataatctacgtgaatggaggagtaatatataagaaatcctagaatatgtgtacttagatgggatgcagttggaagctgaaagataagtggtattttttcccatcttatgcattgggacataagcatatagtcatgagggaagttctgcaggcttattctggaagcttctaaatatactctaatattctgttttcatagcaaactatcatccttgtttcccacagcatgaatttcagttcagtccaataaacatatatgaatctgttttgagcactaagtcctgcagggatacaaaactatattggacatatttcctaccatgacatacacctttaataaaaatgttaaaaacggcagcatggggaaaatagttcaattccgactagatgaacctgggaaagcttcttagaaaaggttatatctgagctggataattaaatagttggctagcaaaagacagacatatactacaccaagaccctgggacctttaagtacaaattggtagtgcagacgggaaaatgcataagagggaatatttgttcccaaagtcagtgaaaataaagaaattcacgatttttctctttaaaatcatgaagagaaggacaagaatatttccaattcaaacaattcaatattagtgacaaaagcacataactatagattctcatctatcttaaaatttttatctataaatatatcttcaacatgctcttatttaatatttgtgctatttatgttaaaaggtaagtggtactatagacaatgtttgttatgcttatggatgcctcactattcagaaaacaaaactgtaacctcttacctgatggcagctgattctaattgtctttaataaaaaaatgaagtgccaaccaaactacaaagtgttgataaccaacagcaatggttagaaatatattgttctggtgctctagaaaatggatgtggggagctttgcaagcagcttgctttgacagcactgactggatggagaataaatggaggaaatgtgaagataagaaacagtttggagaaaaaaggagtagcaatcaatacagttaacagcagttattgaatgagctctgtacactcagcacctgccatgtgctgtggtcagtgcagccagctctgacatggagctggtttcaaggagctcaggatagctcagagatgaaatatcatcactaaatcaaggaggttgaacatcccaagtctgaaaacctgaaattcaaaatgctccaaaatctgaaacttttttagcgcacacatgatgctcaaaagaaatgttcaatggatcatttcagatttcagattttcagatttaagatgttcaactggcataatgtaaatagtccaaaatccaaaacatctgagcctgaaacatttctgataccaagcatttcagataagggttactcaacctgtagtacaaagattcctgttctaaattgaaaattttgattctagttcaaaaacaaagcctaaatgacttattttaggatttgtcaagtatttaagggacatataacagcagtttcatgattcaataagatccctttcagcagttatcatgctaattattttatcaagctcctatacataatttaattatgcatttgtttcttttctgtggctcctgattttcatatttgtttgtgtgtacatgtttgttcttctccttaagtatatttttagtgcaaaaaatctatttaaaaattatatttaaaaatatgaatttttagattttttttttttgaggcagtgtctcactttgctgcccaggccggagtgcagtgacataatcttggctcactgcagccttgacctccccaggctcaggtgatcctcccacctcagcctcccaaggaactgggaccacaggcatgtgccaccatacccagctaacttttttttttttttgtatttttagtaaagacagggtttcaccatgtttcccaggctggtcttgaactcctgggctcaagaaatccaccagccttggcctcccaaagtgctggaattacaggcatgagccaccaaatccagcccttaagtagattataagtaggaaaggctaagactgtttcttttactacttttgtgagactgtatatagcaaagtcattaacagtgtgatatttggagggaaattgctgttttcaagacctggatctccactacttactggctatgagacctaagggctgggattagagtgaagcaaggaaggccattaaccttggaagcaaaatttaaaggagcacaaaaagttagtgatcaagataaatattttaatacaacatttttaaaaatcagaagttagggaaaatccatggtgaacaaaacatcaaatttgtaaataaaggcagactgttgcttgtgtgtttttcagaccttgctacatttatattgtttaaggaacagtattttccaatcaacttgttgttcatggccattgtgtcccccaagggccaacccttacgggttgacattggcaagagagcagattgagctattcatggctttataactgtcttaatctattttgtgctgctacatgtaacagaatatctgaaactaagaaatttataaacagaacatttattctctcaagttctggaggctgggaagtccaaaatcaaggtgccagcaagttagagcctggtctctgtgcttccaagatggcaccttgaatgctatgttctccagagaggacaaaaatctttgtcctcacatggcagaagagcagaagagagagaactcactactacaagcactttgtagagtggcattaatctatttatgagggcagagccctttggatctcccattaggcttcacctcccaacactatgccattggggattaagtttcaatatgagttttggaagggacaaaaacattcaaaccatagcaatgaatctccataattcctcagtttagccaggcacatagtgaatactcatgagatagcaggttgatcataggctggactagataataataagcttgtattattgaacatctattaagtgtcaggactagagtaagtatatcatatatgttacctcattaaatctatatttcccattaaaatgtgggagtctaccaaggtgtgaatccataaagttttagaaatacttattaatattttttaaagtggacaatttttttctttgaagaacaggaaaagaaaaaactggtagaaataaggctgtcacatacaggttcttgcctctatctgtctgtttcctgaagactaggttagctaagagcattattatcaagtaggagttgaggtgtgctctaaacacctatcatcaaaagtgggccaatatgtcatacaaaggcccctttcaatcaacaaattgccctcacccctgtaatctacaactcacatgaaaggttctagctttctaaaatttctattaaatttctcactgtagatacttcagaaaggttttttatttattattattttatagtttggttcttattagtacaaattgtatctgagacttatttgtccccggttctgggcctccttgctttttgatgctgtgacttaaataactcttactttgtgtgatctttgatcaaatttttaacctcaatttattctacatagttgtaagaagtaaataagacttgaaaggactttgcagaattcttagaatatagtaggtgctaaataaatttaaactatgactaataagattatgaaagtttaataatggtcataacataatactagtattatttctccctctcccagtcctaggcatttcgttgtttgcctgtgctaattttttcacctctcctcccatttgctctgtgaaggcagccactcatatgtaagttcttgctactgccccctttataactgaagactctagaatgtcttaggatctccttatattgtaggttacggggcattctttgcaactgaatcccatctttcctaatgaaggaacaaacccttctttctgcaaaagtcaactgcccaggggaaaaaagcaacctttggataagttggaaggttttgtattttttctctatcaactaaaccacctagtcacaatctgctatataataaagaaaaaagcagtttttctcaccagtctccaacttcagcatgtaactgctctttttcccacaacaaagtgacagttgatggaactgttccaaatggcattcatatactaaatgaccaaggagcattttcaactctaaaatcctgacacacaaaaaagcaagaggctgccaaacgtacctgtgccaaaagatctgcagggggtacctgccttcttaattattgacctccagacttgccagtgctgagtgacatgctctccactttcttctcctgtccccacccaatacttagagctcctctgggggatcctatctctgtaatacagtctttctcccttcttcttttgctcttcttccttaggaaaacagcagcacggattcttgggtccttctttctaagggtataaaggtatgtaaattgctgcaggaaaaagaattcagcagagtatgattatttgcaggcaataacacaatactatctgtatgtaagactgacacaaatcctagccagattcagctaaagaacggtgtcttacataagagtttctactaagtatattctggaattttctatttaaactatttaagaagtctaccttagtccatcctctgtttctgcccatacttgaatgtggtttccatttcttgtagcctgatctgtctcatttttaaaactagagattccaattcatagatcttatcattattttgtaacatttcccccattgaatgcactcctgtttacccttctccattttacttccctccatttcccctgatgactgtacacaaggattcatctgttgtttagagttaggccagtagatgtcagccctggatctcctgagtaccttaaaagcaattgtcctagctatggccttatcccagacagactgaattagaatctctagaagacaagcttgtgcatcagagtgttttaaaagcagctcaactgagaatgttgagtcatactaacaggatatgaagacctaacccatcctctacccttgtgcccgtcaagaatcccctccttactgggcccctagtgagcacttttattgacatcaaccaacactgtgacaccccagggagtttgtccaaaaaaattccaggcacagagagaataatagggcttttcatcacagaccgaagaaaggatacgggatagaagaaccaagtacctcaaatatactctgatctccaaaattcagattaacattttcaggctactcttcatgcatcctctttgaagctaacacaaacacagaagaaagggaataaggttaggaccagaacaaggctgtgaaatgaggcaaggagctgccccagggcacaaaatttaaggaggtactcactgttgggtgtcaacatttcacttgcaagactttgagaatgccactttacctgatcctagtccaggctcggggaggagctgacaaagagtcattttctaaaggaatttagggatagctgtaatcatccagtttaaatgaagattttatgaaatcttcacactgatacagtcttctcatcttagcagtaagatgtcagaacttcttaaataaaaattaaaatctgccattagtcctgcccattccaaaccccaaatcctgctccagatatacagttcatagaagattatgaaggagaagctctagtcagaagaacagaatgcttccatttgttaggagagggtaacaatagtttttaactgaaagtcaagtgtatcatactttctctagtaatatactaaatgtcttctaatttcaatccttcattcttcctctctactttacaaaaagtaaatgaatcagtgcttgtcgaatgcctagttcagagctggcacagttgaggactcaataactggtaacaatttttctcaccaggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttggtaagggcttttgttctacagactcactggcatcctcctgtctcctgccctgctcttccttgaagaggaagcaccctattatgctgcagagcagccacatgtgggtaacagtgctggagtctgtttccctggatacttgtcattcttgttgggcagggggatgagggtaggatgctaaagaatgatgattctgttaacagaataaaatcatacagaagccaataattttctgtattggtcagttttctgttgcttacaatgaaatacctgaaactgagtaatttgtaaagaaaaggaatttattacttacagttatggaggctaagtccaaggtcgaggggacgcatctggtaagagccttcttgcggatggggactctctgaagaatcccaaggtggcacacggtatcacatggcgaggggacagagtttgctaatgtgctaactcaggtctctcttcctcttcttataaggccaccagtttccctcccattataactcatgactccagtaacccattaatccatgaatggattaatcttattcataagggcagagacctcatgattcaatcacctctgaaaggccccagctctcaatactgccacactggagattaagtttcaatatgaattttggagtggacattcaaaccataacagacagaacaatttcctggtgaccactatcttatttacaatgttaatatttctcagaatactggaaatctctttaattgtaactgccaaaatctaattgtttagttgtctaattgtcttagttgcttgcttgagcaaggtggagtaaagtcagtgagaaaaggaaggtgataaatatagccccagagaaactgcagaagttcctcctcccctgctatcctgccaaggcccagctggggtgagaccatccaggtccagcccttccagcaaaggagcctttaggaaaggccctctgaacctgcactctcaggagtgtggagctgagctgtgaaatccactgtggcctcactcaaaatgcagactatctgcagcgtgccaatttaaggaggaaaggttaaaattctattttccccagtggtacaaggaagtaccactaattaataaacaccattaatgaagggaagcctctgcctttggatgtttttttcattttttgtgacaaagatctgtgttttttagaaagtcaattttaaagaaggcaaagagaaaagcagtgaggtggatagacaattaattatttttgaaaatgagataaacaaagagaaaataacttcacaaacctatggacacaggctgctagattgttcctcaattctctaaagggcagagcaagcaaaaaaaaattatttggaattgtattgccctattattggcagtcatacaatttagtattttgaagaaaacacaaaattgcctcccccttccctcctctgtcctccccttccctctgcatcctcccccttctctttctcttcatctctcctcagggatggactaggcaataatcatccctgatgatcaggttccttacggagcctaaacagtgtcctgtgaagagttggaaacaagctgttcatctcttttgctatcaccatttgtttatttaccaggctgtgactgtcttagtgcaaacatgaaactgcttcatctggtctattgtcaaaccaatgaaggcagccatcctcaatgtagaaagaaatatcaattttaatctaggcaagctgtgtcccctattgatcaagactttttgcatcataacttgatctaattgccttgtcaacatttatgctgtgtcctgtatctctttgctgcattaaaacacctctatcttgatcttaaatgtttttcagccttctatatctcatttttatcaccctattggattctacagctctttgtctctacatttctcttgtttcttctttgaagtcctttcggtggatgcttaaaaatatgaaaccctgcctgcttgttcagaaaattagatttttcgtgcttcctggtttttgcatttagtaaattggctgggcgggttgtgtttgggtggagtctcatccagtccttaacctattttgaggtgttacccaagtatatattgtggccctgaccacatatcttataagaacctactttacatcccttggtgattcctcatatagaataagtctccccaaaacacccatgaaaaccttgaaatcaatacccaaatatatatcagatctattccacatgccctaaacccagcatatttcttcttcccaaacaatgtccattgctcaactcttcattgtctaacagaccagggacaagaggggctactccagcaattttgccacttcctgcatctccttcactggtctcctttggttttcctttccttggcagggagtcacctgcccatcacagggttctgttccactcctaaattccaaatctgattgtcctcaacctcaaagaaaatctgtctcaccctgtcacctctgcaatttttagtagttgttctttctttcagggcttttattctgctggtatttgttaacaggaggtaagagatacctctccatccattagtgtttcaggttgtatcttggttttgggttcccctgaaataaaacatcgagataaggattgcggttaatttatttgaaaggccatcctgggaaacatcagaaaaggagtgagaaagtgagtcagggaagggaaggaagataagaaaatgtacaagattatatcagttagcaccataggtttagagctcatcttactgggagacagcatagaacacacatcagagttatcccacatgaagggcaagaaagctggggtattcatctaccatctctccatctgtatcactattaactctctgggactcccagtttttactacttgtggactaagtatactcccataatctcaataaatcattatgcaaagagtcatctagtcatcaaagagttatcccagtaagagatcttcagtatgccaaggtaaatggctagtggctgtagcaggcactgacagcatctgtgactggaggtttagcattctttccactgagtcatagaaggctgtgtttgctatgctcaagaatttacttgaagccacttctgttcaacacgatgtacttaatgtctagtttgtgctgggcagttaagtgctagagatgaagaaattgataaaatactggctcagaggcacttaaaatctagtaaaacaacaaaatcactgaaatattccctgatatttcctagtgccaagcaaccaaacaagaatcaaatgtttctctgctccacttcagggacctttataatgagactttatttctaagctgcattagttcattttcatgctgctgataaagacatacccaaaactgggaagaaaaagagatttagttggacttaaagttccacatggctggggaggcctcagaatcatggcaggaggtgaaaggcacttcttacatggcagcagcaacagaaaaatgaggaaaatcaaaagcataaatgcctgataaacccattagatctcatgagacttattcactatagcatggtaaagaccagccctcatgattcaattgcctcccaccaggtcccttctgggagacacaattcaagttgagatttgggtggggacacagccaaaccatataatttcacccatggcctgtcccaaatctcatgtcctcacatttcaaaatcaatcatgccttcccaacagtcccccatattctcaacccatttcagcattaacccaaaagtccaagtccaaagtcccatctgagacaaggcaagtcccttctgcctatgagcctgtaaaatcaaacgcaagttagttactttctagatataatgggggtataagcattcagtaaatacaaccattctaaatgggagaaattggccaaaacaaaggggctgcaggccccatgcaagtccaaaatccaaaagggcagtcaaatcttaaagttccaaaatgatctcctttgactctatgtcttgcatctgggtcacacagatgcaagaggtaggttcccatgttcttaggcagttctgtccctgtggctttacagggtacagcctccctcctggctgctttcacaggctagtgttgagtgtctgcagctttttcaggagcacagtgcaatctgttggtggatctaccattctggggtctggaggatggtggccctcttctcacagctccactagtcagtgccccattagggactctgtgtgggggctccaaccccacatttcccttctgcactgcccaagcagaggttcttcatgagggccccgcccttgcagcaaacttttgctgggtattcagacatttccataaatcttctgaaatctaggtagatgttcccaaacctcagttcttgacttctctgcacgcacaggctcaacaccatgtggaagctgccaaggcttggggattccacacttttagaagcaatggcccaagctgcacgttggcccctttcagccatagctggaatggctgggacacagggcaccaagtcccgaggctgcacacagcaaggggaccctgggcccagcccaggaaaccactttttcctcctgggcctctggacctgtgatgggaggggctgctgtgaaggtctctgatgtggcctggggacattttccccatggtcttgtagattaacattaggctccttcctacttatgcaaatttcggcagccagcttgaatttctccctagaaaatgggtttctcttttctattgcatagtcaggctgcaaattttccaaactttcatgctctgcttcccttataaaactgagtgcctttaacagcacccaatacacctctcgaatgctttgctgcttagaaatttctcctgccagacaccctaaatcatctcttgtaagtccaaagttccacaaatctctagggcataggcaaaatgctgccagtctctttgctaaaacataacaagagtcacctttgctccagttcccaacaagttcctcatctctatctgagaccacttcagcctcaaccttattgttcatatcaccatcagcatttttgtcaaagtgattcaacaaatctctaggaggttccaaactttacaacattttctcgtcttcttctgagccctccaaactgtttcatcctctgcctgttacccagttccaaagttgcatccacatttttgggtatattttcagcaacactcgactgtactggtactaatttattgtattagtctgttttcacactgctgataaagacatacccaagactgggaagaaaaagaagtttaattggacttacagttccacatggctggggaggcctcagaatcatggtgcgtggtgaaaggtacttcttacacagcaatgggaagagaaaaatggggagaagcaaaggcgggaatccctgatagacccaccagatctcatgaaacttattcactatcatgagaatagcatgggaaagaccagcccccgtgattcaattacctctcgctgggtctcttccacaacacatgggaattctgggagatacaattcaagttgagatttgagtgaggacagagccaaaccatatcataagcctttggacatgtagaacattgctcttttctctccctccccaccacccatcctccgcttgcactaccagtcttccacattcccaattttacttgactcatcactgataaccacatcacatcttccaaaagcctcctcctatcctccaaggttaggttagaaaatttatttaaaagctgtcttcaaatcctacatgtccttaatcattgcacttatctcagtgtattgtaacttccagtttgtttatctgtattcccatgaaactgtagatttcttaagaacagtgaatattatttgtccacatttgtttcctaagcatctagcatactgccaggtacacagtgggcctggcagtattatattaataaatattaatttataaatattaatatttaatgaatgaagatgcttatagacacacacacacatacacacactagtggccaggtaggatgacatttggtgccactaactatgttttatttgcctttaagctaaaccagaaatccctgtgattgtggaaaataactccacggatgtcttggtagaggtgagtcacataaaagcctttgaaaatctacagtattacatgtaaggtgtgtcaggttgcatagttgccaggaatgttctctcaaagaactttactccttggcccttgaccaattaactgctaatagggatgaagggaagctgggttgtttctagaaagtgaatgggaatttttacttttagacttagggctctcagaatgtttgatgtgcacttttagtccttaaatttctcagaaaaaaaaatagtcacaatttgtttaaacttctcttttataaaaattcaggtggatagtgaggacaaagtagggcagaaagcagtgtgagccctggtgtaagaaggaggcttttgctcagctgacgtttaatttgttctaatccatttcctttacccactttcccattgtttttatttcaaagtgacaggaggagatatgccctcctgtactcctgcagaaccctgggtatgtctttggtagtaatgaagaagggcaggagaaaaaagaaaattgaatagggacctctgacttaacttcttctgggtggtagttaccagcctgtagtcactaggatctggactcaatttctcgctctttctcttgcgagctgtgaccttgggcaaattacttcatgtctttgcagtcagtttccccatctatatgaagtgaataataatagtatcttcacattgttgctgtttttaaaaattaaataacatatgaaaaaatctaagtacagtgtgtgacatatattaagtgtttaataaacattattgttcttgtttttgttattattattatctgtgttaatcaactgtcttgtggccttatgactttagccaagcttttaaaaaccctaagtaaaaaatatactcattaattctctaacattttctattacatggggcgagagaaaattatattcattctagtttcttctcgcaccaataacattaaataacttacaatctctggtcttactgaatattagtcatttaatttgataattgcatacaaatcatagcttagattgtttgagatggttttgcataacttggaaaaatatcttccaagtagttgtgtcttttgccagtttcatatattagtctcttaggtaactgcttgtattagtccattttcatgctgccagtaaagacacacccaagactgggtaatttatacagggaaaagagtttaattggacttacagttgcacatagctggggaagcctgacaatcatggcggaaggcaagaaggagcacatcatgtcttacatggatggcagagggcaaaaagacaatgtgcaggaaaactcccccttataataaccatcagatctcatgagacttactcactatcatgataacagcacaggaaagtccccatgcttcaattacctcccaccaggtccctcccacaacacgtgggaattcgagattagatttgggtggtgacacagccaaaccatatcattccacctctgacctctcccaaatctcatgtcctcacatttcaaaaccaatcattcctttccaacagtcccccaaagtcttaactcattgcagcattaactcaaaagtccagagtccaaagtctcatctgagataaggcaagtcccttctgcctatgaacctgtaaaatcaaaagcatgttagttacatcctagatacaatggagtacaggtattggataaatacagccattccaaatggaagacattggccaaaacaagtctgaaatccagcagggcagtcaaatcttaaggctccaaaatgatctcctttgactccaagactcatatccaggtcatacagatgcaagaggtgggttcccatagtcttaggcagctccacccctgtggctttgcagggtataactcccctcctggctgttttcacaggctggcattgagtgtctgcagcttttccaggcacacagtgcaagctgttggtggatctaccattctgtggtctgaaggatggtagtcctcttctcacatctctgctaggtggtgtcccattagggacacaagctctgccagtgtggctttgcaggatacagcctccctcctggctgctttcatggtctgatgatgagtttctgcagcttttccaggcacacagtgcaagctgtcacggatctaccattctgggatctgaagaatggtggtcctcttctcacagctccactaggcagtagcatagtggggactacttgtggggcctccaaccccacatcttccttttgcactgccctaggtggggttctccatgagggccccgcctgcagcaaacttttgcctgggcatccaggcattcccatacatcttctgaaatgtaggcagaggttcccaaacctcaattcttgacttctgtgcacctacaggctgaacaccacgtggaagcttccaaggcttgggacttccaccctctgaagcagcagcccaagctgtacccttggcccctttcagttatggctggagtggctaggacacagggcaccaagtcccaagactgcgcacagcatggagacctggggcatcacccacaaatccattttttcctcctaaacctctgggcctctgaaggaggggctgctgcaaaagtctccaacatgccctggaaacattttccccattgccttgatgattaacattcagctccttgttacttatgcaaatttctgcagccagcttgattttctctccagaaaatgggattttcttttctatcacattgtcaggctacaaattttccaaacttttattctctgtttatcttttgaaactgaatgcctttaacagcacccaagttacctcttgcatgctttgctgcttagaaattttttctgccagatatcctaaatcatctatcttaagttcaaagttccacagatctctagggtaggggcaaaatgccaccagtctcttaactaaaacataacaagagtcatctttgctccagttcccaacaagttcctcatctccatctgagacaacctcggcctggaccttattgttcatattactattggcatttttgttaaagccattcagcaagtctctaggaagttccaaactttcccatattttcctgtcttcttctgaacccaccaaactgttccaacctctgcctgttacccagttccaaagttgcatccacatttttggttattttttcagcagtgcccactcttctgataccaatttactgtattagtccattttcatactactgataaagacatacccaagactgggtaatttatacaggaaaaaggttataataaccatcagatctcatgagacttactcactgtcacaaaaacagcatgggaaagacctgcccccatgattcagttacctctcactgggagttcaagatgagatttggatgaggacacagccaaaccatatcactgctattataatcctgattatacagcaaaagatttaatcatttttgctgtgttgtaacttaatttctaagtgtattagtgaacttcatttcaatagtttacatttcaaaaataagctaatcatacagcttttggtaggtgtttttgtttctttttttttctttttttttttttttgagatgagtctcactctgtcacccaggctggagtccagtgccgcgatctctgctcactgcaagctccgcctcctgggttcacgctattctcctgcctcagcctcctgagtagctgggattacaggcgcctgccaccatgcctggctaattttttgtatttttagtagagatggggtttcaccgtgttagccagggtggtctcaatgccctgacctcgtgatccgcccgcctcggcctcccagagtgctgggattacaggcatgagccaccatgcccggcctgtttttgttttttataaggatctctaatagattcttggtgccagtgtttacaggtaatatgggctcaatccagatataggaccataaattggatccaagaatcccagttttaaaataaaacaaaaaactttacctaatgtgccataaaatttcctcttctctacccttgctttagtgctaactaagaaaaccagagaattttccttcctagagaattagtgagtaatctttctccaatcacacataaccagctacaggacatggcttgtctatggatcttttcagatcttgccaaacattagtaactcctcactctaatattcttacaatccctgctgtatttttaataatttattaactcttcaaagtcctttcacatacttttatcttgtgctgctcccagtgagcctctgaaatagatagggcatctgtcattttacagatgaaaaattggggcctggaaagtcttaacaactggctgagtcactaataaggggcagagctgggatgcatatttagtgtgcctgtatccaggcagaatagtattattatgatggaaggatatcatgcttcagggtcagatagcacaagtgtcaaattctaattcaactacttagctggttacataccctcatcaattaattaacctccacgagcctcagctaactcatatctaaaactggaataataacaaatacttcagagggttcttaggaaggttaaatttatgctctaatggagttcatggcacatagtatacatttcaggaatatttcttccctacccactatttatcatttacccactctcttacgttcataaatcagctatgtgactgattctagcagatactgtggaataattttttttaacccagaatacagactgtgggatctgatagaactaggtttgaattctcttccagcacttattaactctggcccctaagagctcagttccttaacttcctcaaaagtaaatgagggcaatggctccaacttcacaagggtgatgttaaggatcaagtaagagaatgtatgcaaaatacctaccatccagcaaccacaggtttttggtgttggcaatttcctgcccctccttcattccttagaaattcttgaagtcaacatgcacacactgtctctgctacctgttcactacactagcagcccgcagtgtggaaatactctggggacttggtcagttgtgagctgtgtcttcctgtgttattagttaaacttacaaagtttatggctaattttagtatttctgtaaaatacaagacccaaaagcatgatgcccctcaggcatggacatgccgtagatgtctaaagagagtgtcacacctgtgaatgttgtatcttatgcattcccaaagtcaagattttgccagggctccaacttgacacacagcttcactcctgcactacaatgagaaaagagtctttaacctaaatttcagggcccctccatgtggcaggtttttgtattagagcaaaagatatcaagccaaagagcccctcaactcacagctaatgatgtagcataagaaggcacaagagggatgcataaaagctccagagtgtactcagcagttcagactttccacaagcctcatacgtctctcactcttatgcttgtgctttatactttagccccgtcatctccatgggtcttgttcatatcactcgctacctttgttatgtttgaaataaattaggaaaaaaaatctaaagaaaattatctgtcatgaaacataggaaacaaaagcagtttggggttaagttgcctacaaaggaagagaggctacaatattaataaccatgtaaaacagataccagaggccagaagcagtggctcacgcctgtaatcccaacactttgggaggccgaggtgcgcggatcatgaggtcaagagatccagaccatcctggccaacgtggtgaaaccttgtctgtgctaaaaatacaaaaattagctgggcgtggtggcacgcacctgtagtcccagctactcaggaggcttaggcagaagaattgcttgaacccaggaggcggaggttgcagtgagccaagatcgcgccactgcactcctgcctggcaagagagtgagactccatcttaaaaaaaaaaaaaaaaaaaaaaaagacaccagaacctaaataccacactggttggcatcagcagagctccagcatctttgtgcagaatttgattatttgtgtttatttggtttgggttttgcaaagcttgaaccctgtggtttcctcaagcttcctaagccccactccaaaaatatgtgttttggttttcattttttaaataattaggtattacagcctccttttttttcctagcatcttttgcaacataataaggttctgagtccaaatgtccagccgtcgtcacttgcactggtgagcacctgagcttgcaccacaggtagagaaggttctaaaagggcatcatacctctgtggggagaccacatgacaaatgaaatctttaatatcaggcagatctctagataaaaaaagaacatgacgggacttcagtgtggcctggttatttcacaagcctggtgcctggacttttgtttgttctacaaacagctgttagggaagacaggtctagaagtgagggctgcctagcaagtctaggaagaatatgagtgaactacataggtcagggccaaaggaggcaagacaccactgttacacaaggacatcctctgcttccagagaggttggtgcccacaaagtacttgggctatctctgagataatgggatgctgtctttatctattcctgtcttcccaagctctttccccactccatccccattcccaacccacattatgttttgttttttaatgtgtgtgtttggttggaggagggtggtgtggttatagaggaatctgtcttctataacaaatatcaggtccagtgcagaggccagagtactttccagtttgattttattctatttctaaattaatattttaggcatactttcagcagcccaggaaattactctctccctatagactgttaggatctcttttttcaaagcatctctgaacatttaaaggtaaacagtttttaaaaatcagtgaacagtggattggcatgcagttagcatttcagaggtatgagtaaaatctaaaacctactgttcaaataaataactggtctgtaggcacaaagcaaaatcaagttaactcattaaaattaacttcaggatctaagaaaatgtactccatccttccctcattcagacagtcatgttctcttccattttcatgataaattttccctagagcactgtctctcttccccatctttgcatttcttctctatcccatttatttctaactttccttcctctgttctttatttctccttacttcctttatatctctgccttcttttcattctgaatttctttcagttcttcctcactaactccttttcctttgacaaaccttaatatgaaatcagattatattttaactatttatgaataagttttatataatctatactgaatgtttaaactaagtaagttgagaggtttttcatttctctgtgctaattacacattaattagtttaagcattaggttgttaaaaagacacaccggactcagattatactgatgaaacaactttaatataagcaagaaaatacattgcagcaataacaggagaaagagacgcattggaaaggtccaaagatctgaggctcacagttctttgtccttccacttgctgggtcacacagaacaagcttttattcatactggtggtctggaaactccaccagtacatgtgctaagacctcagtcctaggaagattaagctctgcttccggcagggtgtctgcaagtgagctggtcacataggcacattccagctacctaaccagcctcagccctcaaaatcgtcagctccaccaaaaccgagtgctaggcaaaaatctgattattttgttaaacaacgctgactggctggtacattctgccctgaaacaactcacagagttttactttggtagaagcatttatctttaataggtacattttagagtttcggccaagggtcagcagagctctaggaacctcgtagataagcatttggtcaattcagacctgctcagattaactcatactgtgcactatttcacataaaagcaaaatgtcaccaaactactttgctttacatttgagttgaaactaaaatggctcttttctacaagtctagagtcaatgttttcagaatagattctccaagcccaatttaaacaaaatggaagggatgtactgctgcaggcagctctttctcccgctggcatgcctccttctcagccctcaccttccacttcatctccaggatggccctttccacctcctccagggctcgctcccttttttccacagccctctcccgccattccactgccctttccctcctaagcacctccttttccctttggctggcccacaaagccatggtgcccacctgctccaggagcctaccccagttaccctcaatgcctgtggggagctggggcccgtggggccttggatcctggcgctgcccagcctgaccatggccactcttctccagctcctctctgtgcatgcttttcagatgcttccacagtgcagtggtgcccacgttgaccccagggccacggctcacctgcctgccacacaggcggcaggtggcatactggttgggatggtgcccagcacgagcaggagctaggtggaaatattcccatgcctcagagaaccgggtgcccttgttgtggggcattggagtgggcatagcactcacaaaagggccaaccagttctcctgtctcactaatctcttcctcctccttcatctctaagtccccttttgccttcatcattgttccctcctcttcctcgtcttcccgcctcatcatgtcacctcttctacagcgttctttatgatgtgcttagatgtgagccaaaagcttatttgaaccacaagattaaatatatatttgggaagggcctgtggtaactcttggggattcacaataatggccaaagtctggccacacctgggtggtgtgaggtttcttcctttctgcttcactggagagtcaggggtgagtcagatacaagcaaaacagcccaagagtgcattccttccatgccccagatacttacttatcctcccttgactaggccagaaagacaaaacatatcagttcctgtagcaaaggggttctctggtccaacaattacaaagctctttgatgaactcagtgttttctgcatcaaccaccacgacaggtatttttgaatattgaaaattttaggttttcttgtttctcctcctggttgtttccactgtttctgtgcttcttatttcctataattgcattttggaggcaggagaaacagcctcagggttcaggcttttcaggaccaacagagctagggcctcactgggtcttgctcaaagtaggtaaaagcaaacacaggcagatgctggtgcaggagacaatcttgcttcctaagaactgttgcaacaagcaatccagagtagacaaagcctatgaggatctggataataaagttcccaatgcaaggtcagtttgtccttagaggtgtctctcagaggccaggagtctaagaaatccaaaaagcaagctcagctgtttcagcaggaggagctgggatgcacagaggagaaggtggagcacatcttcacaaacacagcgttgcctggctgtccttagcaagcagctcaccatactccaccttctccaccaggatcacctgcaaagccaacagccaataagaccttcctgaggcaacttactccagatgttttgctctttacctcattttaaagataaataagtaaatggaaaatcatattacatttaaaaacagcccgacttctctctcctttcttgggtcatttcttaaactaatgagagctttatttaatcaagctctgcaaccgtgaacagttaggaaattccccccagccacaagtgggtacttacaagcaggcaaggctctggacttctctctgatctttcctgcgcagagtgaaagcactcctgcacaccttggatgtctattagctgactcctacccccagaaggagggcacctccagttctggtttcctcccacttctagggaagcattgtttccaggtaggtgtgtctgtgcctgttgggtttttctgcaacacttagacacagatgcaaaccttttctccaccccctccaccaccaagaaaaggatgttcctggcatatgtcatgcagcaaaacagtaagtcaagcacctacaagtcttagttctcttttttgatgactagattacctaacctctcaagtaaagcaagcgatttgaaggaggaagagtgggaaaggctgaaatattaaatgtatacacacatatatattatatatatacatacattatatataatatgcataatatatatatgtgtgtgtatacatatttagattgagaaggaaaacctaccaagaggagataggaagactctaaagaaggtatcaatagaagaagaaaaaactttgtgttataaaaggaaagatagaaatggcattgcaggccaggagccatggatcttgcctgtagtcccagcactttgggaggccgaggcaggtggatcacttgaggtcaggagatcgtggccagcttggccaacattgtgaaaccctgtctctactaaaaatgcaaaaattagccaggtgtggtggtgcacgcctgtaatcccagctacttgggaggctgaagcaagagaattgcttgaacccgggaggtggaggttgcagtaagccaagatcatgccactgcactccagcctgggcgacagagggagactctgtctcaaaaaaataaataaataaaatgaataaataaaaataaaaaaagaaagaaaagaaaaagaaatggcatagcagaaaatatgtagaggttgacagttaaattaaaatagaaaaaaaagatgggggaaaaagattcaaaataggaatgagactgggaggagttttagaacatgaaccacatttctaaaccaaatcttggaacgcaaagtctagagagagtctagaatgtttgaaatttggatcatttcagaaaatctgaacctagagaattcatgaaagtcaaatcttttcaaaatttttagacgttaaccagagttcttcagtgagccagttgccttcgtaaaataataacacccccacttactcctgatattaccatatcgtcatctttggtgggttaactaaagagaaaggaaatgaatcataagaatggttaatgtcactggattaatgcaaaactttgtatctttttctttttttaaaaaaacattttacctcctttacctttttgtctcttcctggaccaactggagataaaaatcaatctttggcatctattgaattaaactgaacactctcctttacttaataagaatgtattttagaggatctggttttgcttttaattttttagtggagagactagcatccctggcccatatatgtatccccattatctggaaaggcaagtgttgaacggatgggaatactgggagctacggtgtttgccacccagcatcttggatatgctagacaaccccctctgaaattctcttgtttcattgggatttctgtagcaatgtactgagaaatagtaaacttctgtaggatttcaccaggaaaatgttagttagcattctcgaatttggtttctcagctctataggcccagacttcttgggagtaactagtctgaggattggcacacaaatcatcacatacatttaattgttctttacatgttaactagtatattcattaattgtggaaaatatctgagaactaagaactagggctggtcatatgtaaaatatatacatctcttgatgagaaaacaagtaattataaaaggaattataattttgaagagtctcagataaaacaatgggaatccaataattctcactggatattttcaccagactgtaaaagaaagtatcatcccccaaagaacaaacatagcattgaaaataaaacataactagccctgcatctaagttctctgctttcataatatagttacttctttcatttttttatttcaatacaatttttattaaaaaatatgttggactgagattaaggagacatggtttctaattgtgccattaactattttccacttcctcgaaccactgggtgccttgatttttccattggtcaaatggcaaaaataaggcatgctctacctatccttaagattaagccaatgaattgtttttaaaaattaggaaaatgcttcacaagtaaaaagtaggatatttatataaatcgttttctgtgattgttacaaatagtgtcgtacattatttggagcacagaaacagcttgtagatccccttgagcttttaatctaacagactattcttctctggcctctgtttgctatagcttcttccttctattctttggtttccatttagtattattttattctgcctacacagagttaagatttctcctttacagaacccagaatccagacttggaacattagtatagtcctagatccttaagttgacctaggagtatagccagaagtttataacatctctataggagatagcccatttatagtgcacgttctaacacaacctatattaaaagtagacattgccttctatttattcagttaaaaatggagaaactcttttttgccaacttatatgaatgttagtaagttgtaaggagtaccagtttcttaggaatttgcaaataatcctttttctgtctttaccccagagaagatttacctgcttactaaagaatgtatttcccaaagcaaatatcacatggtttatagatggaagttttcttcatgatgaaaaagaaggtaaggaaactaatcaatggaaataagttcggtacaaaaagaaagaaaacaaagaacattagaaattgtcattgcccaagttgatcttggcatttaagaatgattctcattccaagaaaaacatcattctgcctaccaaatgtcattttctgatgcttcatctgtttcttccaagggggtggagtgtaacattttccagaataaaagaaatacaattgatttagacaaacaacatccaaatattttatttaactagcagtaaaaggaatatcttaaatgaggacaaaaagtttaagtctacatatatttattaaaactttttctgcctttataacatagctacctgtttttccatgtctttcttatttcaatacaatatgttcaattaacttagcaccgctgctttaaatcagccaataaataatttctacctttttatgtgagaatctgaggcaggtgttggtggagcactagagaaagcctatgtaaaagagttggctccttgacaaggtacatgttccccaggaggattaaaagttcctggaggaggaacacacatcaagacaagctcaggtgaaaattcacaaagccatgattttatagatagtaaccatgacagcctctaccagaataatctcagctgtccctgcctgaacaacagctattctcctttctcctgagtcgtttttcctccaagttcaatctgtcttcaataataactgagtcacacaactctttctgaattatttttattttattttattttattttattttgagacggagtctggctctgttgcccaagctggagtgcagtggggcgatctcggctcattgcaagctccgcctcccgggttcacgccattctcctgcctcagcctcccgagtagctgggactacaggcgcccgccactacgcccggctaattttttgtatttttagatgagtcggggtttcaccgtgttagccaggatggtctcgatctcctgacctcgtgatccgcccgcctcagcctcccaaagtactgggattacaggcttgagccaccgcgcccagccctttctgaattatttttaaatgataaaattgaaagcttatgttaatgagtgtattgatcacttgatgcattttgagattattattggttttattagtttatttttaaaaaaaattcacccacaacaatgacagaatgcaattctaaaaatataggttaaaagttattataggccaggcgcagtggcacacacttgtaatctcagcactttgggaggccgaagggtgtggattacctgaggttaggagttcgagaccagcctaactaacatggtaaaaccccgtctctactaaaaatacaaaaaaatagctgggtgtgatggtgggcatgtgtaataccagctacttgggaggctgaggcaggagaatcgcttgaacctgggaagcaaaggttgcagtgaaccaagattgcgccattgcactccagcctgggcaacaagagtgaaaccctatctcaaaaaaaaaaaaagttattataaatttattctcctgttaaataagccctgcataggcaaagcacccagatttcaccaaactagaggctagattttgtggtcagaattgcactggcacacaactgcatttagctattactttggtaagtaattacatcagaattggtgttaagaatctgtaatgtgaaaaagctgtaagaatccagaaaattctgacatatagtgatagttggttttacattaattttctgctgccaagtatgctatttggaggttgtactaacataacagtttaaaacagagtttgatttctaaagaagactcacaggacccaaaatgcaatgcttacaaatctacagcttatttcaagaagaggagacaacatagcaaaaagattacaatatgcagcatatcctatcctacacttacagccaggagtccagagaagtcagatatgagctccttcgtccttcctctctaagggccacagccagacacacttcctcgctcagatcagagactactgatatatacacagaagagctcagaagtgggtagtccaaaacggagtcccaactgagattgctttatattttactggtcacttaggtatattcctgcaacataaccagattccacagcagagctctcccaagatccgacctagactaggtataaattatcagtctcacagttgtcaacacacaatgctgatgagctgggataatctgccccaaaacattttggacacatggtcacaaacaaagcaacactattagtcaacatattttataccctgaccatggatcaatgacatgcaggagcttgagcaaacagctcaagttaatttcagatctgctgaaattgactctcactgcagagaagctgccatttgaccactttagactctacattaccacaaattgatcatgccatgccttggcattattgtatggctcatacataaaatgttagtgttgaaccatgttcgtatctgtctggcaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggtgagttgtctatttaataagatcaacaagagtttgctaagactgccataaattcaaaatatctttaatgggaagattatcacttccataacgttttaatctcagaaaactttttatgtaactcaaaactatttcaagttatcaaacatttttgacaagtaggactccagtgaaaagaattcttcaactaaaaagaaaatagttgattcatgttttcacaagaatttctgctgcatacagaaaattttttgttccaatttaattcatcataactcttaattagttagcatttttgttaatccatcacatattgaaaattaatactaatactgatgatcaagaaagatttaaaagacctaaaattccttctgcatcattagaaacattccattatgtacaacatatatacttttaatatttaggaatggataaaatgtgtacaataaaaataccataaaaatagggattgtatcttaataattgtagtatccctaggttcaagcactatagttagctaatagaagatttttatgattgaaaattgatatataggattactctagttattatatcatttgactaaccagagtatttactaccctgaaccagatggaataatggagattttactacataaaagatgaactaatacctcaataaatacagtgacaacagatatgcctgaagaaaaatagaagcaatggcaactgtcagatattcatatttaacagtaatcttataaaacgtaaatagatttgcaaatcattattacaactctataggagcattgacctcttaaaccacatcctattttcagagatatcataatctataacatactcataaaaacacagaataatttaagaaggaaacagtttttctttgttacaagggcacaacccgcatcttgggttctgtccagctccttcacaggtgcagtggttggttatgaagaaaagtgtacccagcataaatctatccctactactcagaagcaggtgtgattctgatgccggggcactggcatcgctcccgtagccttgcctgtgtgtctgtgtatatgtatatgtatgaacacatcatcctgtgtactttgagttaatcattcagaaattgtgatgtatttacactaaaatagccttactcaacttcatctaattccctcaggaataagtcagctccttcctggaaagctggacataatagggctgcagtcttggaacaatgtggaggtagctgattctcacatagatttgtcagtagctttggcagaatctaaggatgtgagctaaaggaccctaaaagctcaaattcctaaaaagaaccctattcccattataggtagaaccatgtctgtaaaactaatattttctgatgttaaaacagtgcttgatttcagtatcagaaaataatgaatacctttttaggtaataggaagaacactgattctgatactgaaaacataccataattccaattgtatagggcagagcttgatctagtataatttggggctctgaacaggtggttaattttaaattgccaaatgagtctttatcctttatgatcaaatattaaagacaattaatctttaggagttcagtttctcaaaattatagcttacattctcatcccattctggcatatatctatgtgactgacttagaagatgtagtcaaggctctataaagcagtgtcatcactgtattatgtctccctattgttgcaagctcttaaacacttacttccacacaggctgtctgtctgtgatggtactgccggatgctttatgaactccggagtaaacttctgatgtgtggtgcaagagtcattgccttaccaagctatttattgttgacaagatactgagatgaagacacagaagaaaaatctgccatccctgagtgctagattagagaaacgctaagaatattacacatcaggaaagagttttagtgagacaaggggagaagttttgctctctttgatcccttttgcttccagaaaagggtattaatgttggagactgtgaggtaacagccctttgaggtgattccttctccacctacgcccagtctcccaagtgttcagtgatccctattctagaaaactcagacagggcatgggattagggttagggtgatcagtgactcttcaggcagctatttgtgcactaggacctgcagaattcccatgatccacagtaactaccactaagaaaaaaaagcctttcaaaaatatcatggaccaggcacagtggctcatgcctgcaatcccagaactttgggaggctgaagcaggaggattgcttaagtgcagaagttcaagatcagcctggacaatatagtgacactttgtctctaccaaaaaattcaaaaaatcagccgggcatggtggcgcacatcattagtccctgttacctcgggaggctgaggtgggaggattgcatgagcccaggaggctgaagctccagtgagccgtgatcatgccactacactccagcctgggcaacagagcaaggctttgtctcaaaaaaaaaaaaaaatcccgccctgctagcatgtcaaaatgtctaaaatcatggcactgctgagtctatttctggcagatttgaagagctgggttttgtgggttttgttttggggagtggataggagacattttgtcttgttttaatgcaaaagttgagtgcaataccccctggggtggataatattttggttgtcatctcccttgacagagatttgtttattaaatggatttctgactgtagctgttgagatcaagacctttgggatagaaacagagttaagcattgacagttgtgtaggtgtatgtgtgtgtaagtatgcatgtgtatcttcgcatgtagaaagaggagtaataaaaagatatcttaatagtggaacaggaggaccactgcatattggtgtggaagatgccagacaaatacttcctgtttcatgacttccctcagtgcagctggcctcatacccttgactgatcctttctgagagtatcagttgagaactttaatatgcatataaatcacccagggatcttgctaaaatacaaaaattctgattaagtaaatctaggtgggacctgagattctgcatttgtaaaaagaccctcaaagaaacatattctgcttgtctatggacaacattttgagaagaaaggacctagcaagccctgggatttggcttacttctaggtggatgagataagggcttatacaagctctgaggaaaccccggaattaagccagttgccctatgggacagacccatggctgctgctgcccatgagggtggttctgagagccctgccaagcctactcaaatggacacacccaggaacagatgaagtggctttaggcggcagcttaccctcttatgacattatggtaaatgcaatgatctggaaactggcagaggtgtttctgctaaattctgcatttgggttttgggaaactgtctctcctttttaggttttaaccactcttttcatacccctgagttttgttttgaccaaggcagagtttccactttacagtctaatctaaaactagacagacatgtttaggtcccacattttatgtggaaagctatgtttcccctctgtcacaaggcaaagtgttcatctcaaaatgcacatcttacaataatatcttcttaatacactatgaggctgaacacctcagcttacaaaatcacttggtgatgaaatatggcagaaaagtatcctcaaactgaaatgttcaatcaatgaaaaataaatgtttcccattgtggaaactgagcataacgcaccaatatcttctgttccaggaactggcaaccttcttctgtaaagagctagatagtaaatatattttaggctttgtagactttttaatctctatcacaattactcaactctgtcaccttagcacaaaagcaaccatggacaataggttaaaagaaaaaaagggaaaaactgtgttccaataaaatttttataaacatgatttcactgtaggccatagtttgccaacctctattttaatcaatatacagagaaaaacatctaggcatttattttccaagccaatgtcctgtcttattaaggtaccactttggaagataatgcttatgatccaccagctgtcagacacacacttaatgctggtcttctttctttcagtgttaagaataaatttgcatgcattgattcatctacttccatttgccagaatccataaatatggtgtggagcaaaacagtgacttcccttgaggggcatatatgatgacacagtgatgaggcatttgctagggtaaacactgaggggtgatcacatcacaaagatccccaggcttcctcagcttgagaaggtacattcaggaaagtttggggtcaggaaaccacataaattaagatcaagaagtcccagaagtcacagagagaatattgtgtttcagaaattgggttgaaatattgcttattggatagaggggattatttgagagagatggaaaaaatgataagcaacatcaggaaattgggagtgtaatgacagcccaaatcataattagacttgtgtgtcatgctgaagagttcaaacttattttggatgtatgaagaaaaaggatggtcattttgttaacctattcatatacttcccatataaccgtcctccacctcctcagagattatttgcacaaaagcattcatatagtagtggatcagagctagctatgagtgccacccacagccactggcaatagcagtgctactagcaataagaatagaacatacatgcatctagcttagaaaaaccaattcctcccacggggctatgtgctatcaagtgacataatgtaagtaaaatatacttgtcccttaaagtacattacagaatagaaccaatagtttaattagtaattaaacatccaaataattgatatatatcagcagatgtgtaacactgtaaccagtaacattatatctacaaaaatcataaaatcttctaacttcaaaatcatctaagcacatttaacccacatgttcctaaagtcaatagagccttctggcatttgtaaattgtccttccaataggactatttttaaatacagtaatggagatttaaggaattgacataaatgtaaaatataagtaaaaccacattctagcctctgtttcaactccccccaacacagacacacgcacgcacacacacaaaagaaaaagttgtagccaaacaaaaatattatgacaaaagttgtcatgttagaaagcagaaaaacatcacacatttactaatgttacatccaattgggtagttgtatcattgtttctactcttgctgatataaaaatttttgtgagtttatggattttgtaaactgcatgattacttttcaaacacttgaaaatattaaatgctataatagttttaccaggtcttggtaaagtgtaactttttccagggagccttctcagacctcccaatctttatcagtgccccttcgttgtgttcctgtggccacctatgctttccactgtcatggtactcaacacaatgcttggctgcctagtttccaggccataggccctttaaggacgatcccatgtcttcctcattcatcattatatcccactgccttgaccttaatagggccccaatattgatttgttacatgatgaataaataaaggaaagtgtatttaagaactaagtcaatactttatcttttgattacaatattttgttcattataaatctctttctaatcctttaaggttctgaaatttcctcaacagaccctccactgagtgttacagaatctacccttgacacccaaccttctccagccagcagtgtatctcctgcaagtaagaatgttttcacactgagctattgatttaaccaagcagattgataacgataaaatttcagcaaacttgcatcattcatgcctgtttcttagctatgacttttttggggctgaaattgggttttattttttaacagctttattgagatataattcacgtcacattaacttgcccatttaaaatgtatgatctaatggtttttagtatgttcacagacttgtacaaccatgactacagccaatttcagaacattttcatcatctaataaagaaactcctaaacatattaaagtatcattctcatggcttcaaagagttaacatagcttccaaaatcctttacttaaagccctgggaaaatcaaggtaaataaatattcagtgaggaatttaaattctgtatttattattaaataggttaataaatgacagtcattctccaaaacaatgttctcagtggggagtttaagagattggttgtaaatggggataggccaaaagaggttgaatccttttaaatttaaatttgttctggttcaaattaatgttgacaaagttgactggtaaggactatgaattcagccctcccatctgaggcatcattaataatggaggtcagtctgggtcagcaatgctatggcaaaggagtggcagtgactctcaaaacttgtcattgatgcaacaaatcataaattcccacgtctgtggcttttgtgtctaacaaagaaccatggtgactctctaatacacaaaagcttatattctatgtaaagtagaagtatggctctcatttctcatttaattaaaactatcaattttagctcaaaatgagaactgaaaatggaataaaacaaaagcagtcagtaggaatgaacaattcctttggctggtaacctttggcatgtagcctgcagtcgctgtcacaggttgatacttctcagaaaatgaagcaagtggcagaaaagcttgcaaaccacccatcaaaagtttcatatccatctgattttctcatgttcttaatgttttgtaatttttcttttcttctttttttgaagcctctttttcttctacttttaactcactgccggttaatcatggcatttttcatttaacaagtattagcatattcaaaaataataaaaccttaaatctctctagtatcctgtgtattagttatccattgctgcattaaaaatgccccaaattttagcaaaacatatattgtcgcatatggtttctgggggtcagaaattcaggagcagcctagctggaaggtgctaacctgggttctttcatgaggtgcagtcacaccgttggctgaggcttcagtcatctgaaggcctgactggaactaaagaatctgcttctaagctctagcatatagatggtctcagttcctcagcacatggtcttctctatagctctgcatacaatatggcagttggcttcctctggaccaagtaattcaagaaacagtgtgactaagtcaaaagccatattgcctttttatggcttagtctccaaaattgcatgtcattacttctgctttattttatctactagaagtaagtcactaggtccatcttatactcaaggggatgagaattaggctccaagtctcaaagaatctgtgaacaaattaaagccaccataccctgtcatttagaagtgtctgtaaataaaaggcaatgtggtttgatctttattatgagtggtagacagagcaagcattattgttcccacttgccagatggggactttaagacactgagagcttaagtgatcacatacctagtaagtgacagtgttttgcattcacaccacagtgttatgaccaaatttagttctcaccacattagacaccattttttctccagttggtctaaacatatcgtgagaacaggaaccgtatttgtttttcctcctagcacagagtagagagtcaaaaactattagttgaataactaactgaatgaatgaaataattaataagaataatgttccttcactatgtagatgttatttaatagattatttaatgctaaagaaaaaagataaaaatagatttctgccttcagaaaggttgcagtctacttggaagagaaggtatacacacataaaaataataattcaaaatactaagatgaaaggtggtgtaccttacagaattaaaatgcccagggagaggtacaaaccagtaagtattagactttgaaagttctttgtgagttcatgggctcagaaaatgttacccgggagagatgaaataacttgacctttgaagtatgtattgtatatatttgactcagtggagagctcgaaagaacgttctaaacagagaaaacaaagtgagcatttgtgcagtgacaaagatgtttatgggcatttgagaaagcatcagtagataagtttggatcaaagaggtggtattgtgtaccaaaaaaacagggatgaaaattggaaaatgcaaagtaaacaaagccttgagccccagtttaaggactccaaatgctatcctttatgaaatgggggaaggacctcattccactttattttagaaagaaagtggtattatttattcatcaaatatttattgagcacttactatatatcaggtacctttgtaggtgctgtgaatacagcaatgaacaaaactgaaaaaaaaaatgtcctcatggcatttatattctgctagttaaaagcagacatgaatttcttctagttgcatttttatggggttagtctacatacactaagtgcttatatcagtgcttacaaacacaattcttctgtgacaaaattcaaagcaaaagaaagcagttgttacacttcagaagcctacaatttaatatagttttagtattaatgaaggaaagaaagcacagtcaagtaccatatttgtttaaaaagcaggggggaaaaatgccacctgatctactatcacactaagacgatgtagttgggaagtctgtgcagactcaaaagacctccgtaaaacaaggttccaccacattggacctgaggattgtgttagataagtggttgtcaaccagggtaattttgccactccagaggacctttggcagtgcctggagacattttgggttgtcacaatgagggtaggagggtgctactggcatctagtgtatagaggcctgggatgctgctaaacattgtacaacacagcccagaacagccctcacaacaaagaattatttggttcaaaatgtcaatagtgccaaggccaagaagacttgttttagatcaaggcttaggtgtaattacagtaggtatctcttactttacaaaatcaaatctggatttctgtcaagatggcaacaatagtttatgtttggaataattttctgtttgattttgtatgtcaataaaactcatgttaaaccagtggcagattatgtctaaataaacttatctttttggaataatcactgaattactattgaaaaatccaaattttgccttggcaaactggagggtaattgtgaaatcacacgatgacttcctgcctcagaagctggtaggattcacctttgcatgttctttgaagaaaggaagtgagatgaagtatgtcacggaaaccaacttcaaaggctgtggtttcattccgaattctaagatgtaatgagctttataatccagtcatcattacgaagctgcatgtctggctgcaagcatccaattcttattttttcctcgatgaaaggatattttttaaacaaatgttgaaggtcatgaaagcaatattctttaatgaggggaggagaacttaataactcataacaaactgtaagagttatccagggaagcccagctcaattcaacctgaaccaattcgtgtttgctgagtcccagctgcattctcagcgcagttcaaggaagacaggctgacaagctaagtggcaagatgagacaagtccatgtggaacaatcagagacaactgatgaatccagggtggggctgtacagacacaattcaggagtttccgtcgccttgaggagagagccctgtgcctttcaattcactggctatgatttggctaagagttacgtagcctaagagatgccaacccggtgtggcaatcatccaagacacttattcatgaaactcataagtatggagcgcctacaatgtgtcagggacttttgaggtacaggatacagtgatgaacaagacagacagggctcctgttgcttacagagcttacgatcctgtgtgacccacttgccttgcctcctgttttactgcccatcagtccctttggctctgcctcctattgttatgtctgcacatgacccttagacctgatgatgttgattttaatattaagccctttctaaggacttagctggtcctcactatctgggtctttctattcctggatacttagagtaaaacactaggtccagtctgcctctaaccctcagccagcaccccaggtagacataactgatcttcggcaagtggatgatcagacattgaggggcacagggtaaaggaagcaactgaccaggggatgcaacaaaactactgatttatgagtaagcatgtcagaaatggtgggggatcaacccagaagacatgtcattagatgagattagaagaaagtaaatcagaaattcggcagttgataggggcattggattctagtgttaacaggggaacgccagagagagtctgcaagacagtgagaaggctccagtgatttgtttgtgatagcaacttctgacccctttgctagtcatgccatgcctgtattcaggtgcctcaattgctgtccaatagtttctgcctttatcaacatgtatctgctgctgaaaagtaagaaaagtcagtgagtgctgggggaaaggaagggggatcagggaagtcttcatgcagggtctggaagaaaatactgactcaggtggaagaaagatgagaaatggatcttcacattcgcatcataagcaaaggcgtaaaacaaaatgagtgcaggacatgagaagacaagcaggagttctgacattgcttgttgggagagggctaagggttgattaggtggggtggaacaaggtaaagatgagcttcaactcatttagccccaattcatagcccacagcccagcatgtctcctttatgctggactgaaggtcagtgcccatgttatcctgaccacgcagattgatgaggccgattcaaatgtgtttagatgtagttgaaggcctgtattgtccagttaatgtcactactgtgtttaaacgtcaactaatgggctatgaatcggggctgtgatctgaacaacaaatagccactatggctttttttgtatgtgggaaaatgtcaggaaaacagcagttatgtatatggtaggtgatagttgcaagagcagggagaaaaaagactaaatgatatagatttaaagtggtttaagtttgttttccatgatcacgaaggtggttaaaaaaatgatatgatctgaactagaatgggcatttgtagaaatggagagtgctgcaacagaggctcaccaggattgtctgcctaaatacagggactaaaaaggttttcagagaacaatcatacaaggacctttccattttttccctagcaattacataaaaatgtttaccaactgccatgattgtataataatactaagcaataatattaatatttgttggttgcctccaatgtgtatggactgttctaaactagtaaatgtattttctcattgaatcctcccaacaacacaattacttaggtactattattatcccactttacagatgaagatactgaggcacaaagaggttaaataactcacccaaagtcatgcagaaagtagatgagccagtattgagcccagacagacttcagaccttgagtcctgctgcctcaaagagtacatggttggtgctgaataaatgtctttagacactgaataaatcccttctagtgtgaagctgttataggtcttaggaaaaggtcaaacatgacacctatgcttatattaatctctccctttttcagaccagtgttttcctgagacatgcagcatctgagagtgaagataacatttcctcagttggaaataaattagagaaacccctcctgcatctgtagcccacccccgccatcaacactattatcatataattctcactgtagatatgaatctacagaatccatacaaaactccaatgcttttccttgaatcctgggaaattctgtttattgtatctttttcatcaccttccacctggggcacacaacattctgcagactgttaaaaggatttttcttttttctacatctgtcacctgtaagtcaaggttagccttcttgatgactagtttactttgggtattcatctattcagttactccccttggggtgagattcctcagggtaaaagctatcagttgacctatttttcagtttatttcataattattgagtatctacaagctcaccacatgatgcgtgatgagctctgtcctgcttactgtcatcttccccaagggagtcctgaaaccctttctggaccagtaatccagcaatacacattattattccccatttagtcagcacatgccccaaacaatctgcctcccacatgagaaaaattttatgcagggtttagatttaggtttaggtttcacacctcatgtctcctttatgctgggctgaaggtcagtgcccacgttatcctgaccacacagattgatgaagctgattcaaatgatgaagctgattcaaatgatgaagctgattcaaatgtgtttagatgtagttgaaggcctatattgtccagttaatgtcactactgtgtttaaaggctctttgtgctgcaggtgaattgatggagagcaattacacatttgtccagaaactagatggctaagtctaagtctgtgctatgccgataggtgctatagtgatagaatgaaaggcccaatggaaatatttctatttgagacaataagttaaatttttaggttcagttttacattggaataaggcaaaaccttagatagcagagtctgactaaccagataagttaaccagcagcttgaaacttacaaataacttttacctttgtacttggttgattaaataagctaaaccggtaggttagcaaagaataatttttactttttccattcttctctgttcaaatgagatatattgaataattttttcttggcctctaaaagaaatttcagacagattatttggcttttttggtgatttccatataataaatgtcatctggtccttttcagccacaagaacagacctgtgtcaataattaaaaactcttgtcaaatgtaatgtcaaaactcaaaaaagttaatttagtccagaacttctttcctcttccttcccccaagtgtggctctaactcaacttggaaacgctgggatatgtgaggtgggggtagggaagagacagggaatgtctctgattccctgacttggcttcatcctctcctccgctcctagctgctggcttgggtccctctttatggggaatggcgtaagaagaagagggagaggtaggtaaggaaggaacttccttaataggctggatgtaatctgacttaggtgtcctctggatgaggagaataaaaattgccatattgacttcatggggcactctggcagatttttcagaaatccctgactgtcctatggctgctgtcccttggtgcaggccatgcctctcttctggtcttctgcttccttctctctgcagcctctaaacttctgaaggtcagctcctcttgggggcttctttgttcctctaggtgttcttcctgagtgagattcttttcatggcaccctattatgtctggaaaaatgtgcacctttgcctactctatgggggaagtgctcctcttcaccagtgtggccctgtctctcttctccatgcccattcagagccactaaccaaccatggactcctaatgcagcctctccagcctgagtaaggcaccatgcccctttgtcctaaattccaggacacacaggtcaagagatatgagtatttctctcagatccacacttcgcttggtctaaagtgaaggagcggattcttcttcatcttctccatgagggagggcctgatgcacaggacccttcaaaggaactcttagccagtctgctcccaccccgtcacacagctttgaggttgatgatggaccaccactgacaggtcccactccacactgcctcgcatgtcctgcataggtgggctagaaccctgctttcaacgtgaggtggcttgtgccctgtattatggttcttaacctttggaacctcatctgaaatgaaggtacaagtattccatttaaaaattttgttctgcattaaccattgaagagttaaaggaaatacagtgaaaatgaagcaaacatgatgaggtgatggttaacccactgagaggatccacagaaagctgtagttcttagcaatagtgtgatggatggaagataaacactgagttctagaagcattggccaaaggtgaggatgcttgaggaacatgaagggagacaggagaatgcagaaaagggaaagctttcacgtgggtggttccttcttctaagggtgattaaaagcaacagaagagactaagcaaacaaaataccttctatagcacttggttcacagtaagtgtcaacatgttgtattctattattagaacctctaaatccatttggaaatacagtaagaacccaaggtaggaaatagagtggctgattgaccagtctgtctttgtctaaggggtgtgtgtgtatgtgtgtgtctgcgtgcatgtgtgttttaataaaaataatctaggtttagaatgaaagcaaataatctaggtttagaattatgtatctacttgagatagatactgatgtaaacaaaaccaggctcacaaggaccaacatctagtgaggggaggagggaagtgggcagtaaagatgagcagaaatctacagttagcatgaaaagccacattataccctacttgatatatcccccacgactgccctctccctttctcttgctttgctcagccaagctagcctcctagctgtttcttcaacataccaggatttctctcatctcagggccttttaacctcacttcctatgcctgaaaaattcttcccccaaatatctacatggatcacaccctcatcttctcgaaatttttgttcaaatgtcaccttctcgatgaggtactccatgaccatcatattttaaattgcagctgcctcccaccccatttcctgttccccttttttggctgtattttctccataacacattttaacaccgtctataagttacctgtttggctcctctccacacataaaaaaagtaaatctgatgagggcagtgttttttatcttatttgtctactgatacagctgtatcacctagaacaatgataacacatggttaccaataagtattgataattcagtaaatattttttaaatggagaatttttttaagtataaaaaagaagagattaacaaaggaaggctttagggaatgcagaggatatctccctaaagaaaagccatctggctagggctgatgtctgggtagccttatgacaggaagctgaaaggtggtggtgggacaggaagctgaaaggtggtggtgggacaggaagagaagctatcaaaggcctgctattctgggtggttgcgtgctagacatcatgagtgagctcttccgtggctaggccctgatgatgatgatgcatgctgcagcaaggctaactacacttataaggctaccagaatggaataaatatagtctttagtgtcagacagccttgggttcagttgttgtctctgccacctactggctctgtagcctagagcaagtcattctgatggcagcagctgcccgactggactagctgctgtggggatgccagctgtagtgagggaggcctggctgggactgttgagcccgtagaggctgagaacaggagggagcctgccccctactgacttggcaaggcaggagccctgggctttcagggcagctgcagccacccagctgtggctccagaccctgacacccctgctctcttgagggcctgggaacacccccgcttctgcaggctcagaagggcctgcttccaccccctggactcttcccactcccagcacctgctccaatttcagagcaaagatgaggctcagcccaggcactgtcacaacctggccaggtgtgtgcacacttggggcagcactgacacaccaatcccccaccttggccccctccagactttgggcgccaaggagcacaggaaggaggcagcaggtggagatgggctgagggcagctgggtgcaggcctgcaggtgccatttggtgcaaacagcctgggctatggaaggcatgatgacagtgggaggctgactaggttcctggatggaaaggtgtaggtccccagtgaaaccccaccttcaggccaggcatggcctgaagcctgggagccaggctgccagttccaagtgaagtccatggatatgagtaataacttcatcgatgaccactgggccaattggatagtgctttttcctggcctgcctatggccatctatggaccaatcaccatgcactttctcccttctgagcccatgaaaaaccggggattcagccagactcagaaagaagtcaagactaccagctgtgggagggagctacccactatgggtctcctcatccagacaacttgcctgcagaaaggagctacccactacaggtctcctctccactgagagctggacactcattgggacagcctgcatatggaaaggaactacccacttcaggtctcctgagagctgttctgtggctcagtgaagctcctctccaccttgctcaccctccagttgtcagcatacctcgttcttcttgggggcgagacaagaacttgggacctactgaatggtgggactgaaagagttgtaacacaaacccagctgaaacacacctcccacctgctcaccacattgcaagcaatgagaaggagagaagagctgtggcccttcagggagcccagacctaaggcctcccaggccagggctgtaaaaccctctttggagctctacagttcctggcatctccaagctttctggtgccacagtgttccccttgtccagacaccagtgcctgcagcagaaactgcttgccatacatctggtccagcagcagcatcacacagagtcggcacccatgctggagcctggagattcccaccctgcctcagcagccagtgtgcctggctgtgtgcagtggccagaccccacgctcactcgttcacacaccccttgctgctctgcacctggctcacccttggcaggtgtgggatccaggctggtagcacagaccaagcacagcctgccaaaccaagtgggtggaatgagcccagaagtgtgagcaatactcaggcagaaggtgccactggccacagaatttctggctggcaaagcaagacctcaaggatcccgtgacaatttcacctctgtagtagtttccttgtcttaaaaaaatgagagtaacattatctagttcatacaattattaggagaatcaaatgtgaaagtgcataaaaaacaacaatgaagctacgactcatactgtccagtttgagaagaaatgtcatgattaagagtctagtaagcaaaaaccatctcaaaataaatcaagacctttatatgtaatttttaattccttgaaggaggaaacaatgaccaaatttatttctctcttttttttttttttttttttgagacagagtctcgctctgttgcccaggctggagtacagtggcacgatctcagctcactgcaagctccgcctcccaggttcacgccattctcctgcctcagcctctcgagtagctgggactacatgtccagctaattttttgtatttttagtagagacgggggtttcaccgtgttagccaggatggtctcaatctcctgacctcatgatccacccgcctcaacctcccaaagtgctgggattacaggcatgagccactgcgcccggcctcgctttttttttaagttaccagcttattctttatgctccacttatgctactttgcaactgctcacttgcttcttttatttggcatatagtaggtccatattaaattatttttaaaatctatgttgtttggaaaatatttcagtatttcccaaaagttaatcaaccataggtcttctagccttcctctacctttcctttctctagcagttaggtcactaggaagactggcaagagtataggttaagagattcagttctgcttaatgatgtcacatggagatgaccagaattagctcttttagaacatgtttctgtctgcccactcaattcagcactgactggagctgtcttctaacttaattgaatttccagtgatagcataaaagggtgggtttttttttattttagtgagaaaatttttaaagagttaaaatagaaatgagccaggaaggcttcaaacctcctcatgtaacctcatggccatttctgagctagtataaacaaaacattttgtgtgaagtagtgtttacctctaaatttcatcttatttcctggagacatgggtcattatagtgtaactctggatacttgcaagatttgataataataaacatttacattgaagaaggaataaacaatcagcaaacaaagccatcaactccctatcacagagtttgtcatcttacttgcctacatagtatctcatgatttagaacacactattgaatattgaagagattttgctatgttgtgaaatataaacttagccttaaaacaaaaggtacaaagcaagctttctcacatctggaaatatatgatcaatatgaatctttcaaaaacatggctatgaggaatgcaaataaaattttttaattctctgcatgatatcaagagacagtcagacatgttcttatatagttacagaatctccaggtcaggttctaagaagggattttttaaaacaaaacaaaactcctaagaaataagcagtgttgctgcacactgtgccacagtttggtcactgttctcctgctgcttttgtcttggatatgcactttggcaggtaacgccccacctagctctcacatccagttcaactcagcacatggaaaaaacacccctgagggcttgtaaaagcccagccctggaatggacaggtgccagacatggctattactaatccatgacatgtgagaccacacactgggcttttgcatggctatgccctctgcctgaaagctcccaccctccctccgctggccacaatctcccactaaattccttgggaaagctttcctgggattctgactgggctacccctgctttaatatgttctagcatttgaattggcttatgtgatcgtctggttgatgtccatctccttcatgaacttaaactccaggagagcagtattcccagtgccaagcacagtgcctgaaatttagagactctcaaatgttggttaaacaaacaaaaaaaatgtatgcagggagtatcaagagaggactatgtgaaggtttttagagatcaggtcatggaatgtgaaggggccttaaccttgaaccacagtgtaaagtgggagagagaggggtagatttaatttatctaggaactacatagttctctaaaagactttaactctgacttctacataatgagtgaggtcccatagtaaaggggtcattatcccaataacctgtcaagttggttcagaccctcaagtgaaagtctaaagaaaattcagctggagaccaataggagcgaaataactttgtgctccctggggaaagagactaggagactaggtatcattgatctttttgttccccacacttggcatgtattcagccctcaatgtactccacagcactgtgtgtgagaagggtaaagcaacatagatgtctaagttggggcagagacatagtcacacaaggattaaggcagcatgcatccctgaggcatgtttctcccccaacaaggtccctaaataacataataggtagaatcaaatgagtgagttctccttctcctgcagtaacccttgagaaatgatttatgtcacattattttctgacctccagaagagaacatttaatcagtcattttaatataaatgaaattcccaatcaagttatacttcatcaggattcctgtgattcctgccagaattaaatcacatgtcctggtcagtgccagcacccagtgtgggcaaccaggctggcataggaaagtgtctgttgcttgcaggtaagatatatttttaaaggctgctggcagttgcttattagactgagatttctaggtagtggtcatgtagtttacaaataaatattaagttctttgatgtttatttcctagatctttttcatcatcctcattatgacaattgttatcatagcaccactgttaagaacaattcctttgaatttacttaccaagtctctcagcaaatacttttggaggttaattctcagcatgagagagagaaggtaggggaggaaggaggaaagaaccatctttattcattaggaagagcctatcatatctctcagtatctcacagtgttcaaattacttatacctaatttatttattttcttctatataatttttaccttgtcttgtcccaaaaggaatatgaagtaactttaaaaatacataacaatacagaattttgaaaagaggtaactgaaggaattgctgcagagagaacaaaagcaaagtcttcttaatgacagaaataaaattataaatcacttggtgatccataggtttgtaaaatggtataacaaggcagttgtccagaagcacagccgctcttaatgcagagactgcctgggccctcctctagagggcgtggtggagcacagtcccagggactttctcactgcaagtgaacaatggcgacccctccccgcatcgtattagactgtcatctagtgtcagccaatgggaaaatcctcagtactatataagagcaattccacagtgactaggaatgtagttccaatactcagttcaaagcaatctacaaaagcatcatatatgctttaggtagtcaatcttgtgcaatttttctattaatacagcctttgatgaatggtgggaggcagtgagctagaagttacaattaccgcacaagaatctggtactgatggctcagtgggatggcagaggagaagaattgtaggtgattctgccagtgagaagttattaccctaccacaaagctaatgccccagcctactatcacactctgtatttctgactattagcccttttctagtgcaacactttggaatgtagttcttgacttgggccaggcctggggaagaaagaattagttaccttagatcaactttcttccagaaagaccaaggtaaatggggtaattgtggaactcctcaggagattcaagtggcctatagttagaatatgcttgtattatcaacatctgctaaactgcaagtgacctattttacagattctaagacatactttttagcatttactacatgtcaggcactcttctaagtattttatatgtatgactcttttaatcatgaagccacggtgtgtaagtatctttttgtagttcattgataggctgcattgcaaaaaaaggttatcattgatgacctctggatgtgaactacttataaatgcattaaccacaatgccaacttattcatttgatttgattgcccatgttctctatttaaggcatgtcctttcacataactgaggtaccaggaaagctggctgccattcactaccaactaaagcttgaggatgaatgaacatactggctatcatactgtaatgatattttataggatactttacacaattatacagcattctttttatgaagatctggggaaaagtttctttttaatcacaacaaaaagaataactatttctctagctattcataataatactgtttttatcttattatattcatcaagcacataacctatactctttatttcttagcacttcctaccagaaaggtcagaccaaatgtggggcccacatctactaagagcataagacatcaggaaatgcactttgtccactatccctgtttaggtttcaacaggactcaacataatttttctactgtattttccttgttcctattttgcctttctgcttttatcttcttgtattgcacattgatataaaccaccttaaatacattttggaccaaaagagaaatgcacacaaaatgtatttaaaatttttatttccaagagatataaacctgatttcaatggactgttgttggatattcttctttaatctaccttgctttatataatagttctaaaatatagagctattttcaaatgaatatgaatcagtctttcattttgggggagtgagggggaaggaagagaatgtaacaattatggagtataaagatggagaaatgactttgcaaactaacaattgaagtaaatatgaaaccatatttagcatgtgaagatacggttttcacagtagtatttgtgaaaattcactataaggtaagtttcatgagagcagggaccctgtcttcattgtttattactatatccccagcgtgcagaatagagtctggcatacagtagacactgaaataatatattttgaaagtatgaatataatacatttagaattaggaaaccgggttaatagcaaagaaatgatattggatattgattatttaaccacaagcatattccttttggattcggtttcatcatttataaaatgaggctgttcactaagattctttccaactctaatattccaggctcttgttaaatgtagtggcacagttaaacatacgaatgtaaatacatataataatttgggaattttattttcaaaataggatatccagctacatcttcagtgacccttgtagatgtgagtgccttgaggccaaacaccactcctcaacgtgagttcagcaaagttttcctacatgattggaaagagacaacacactcacaagttttactactgcttctataatgttgacgtttcagcaaacagctgtatttttcatttgatgtttgttaatatcttggttttgggttactctgcggtgactatatattgatatgacaatttctataatcttaaaaaataagggctggtgatttattatattgtatcttttatttgtcaagggattttaaggtaatattaaagtagtcttcacaatactctcagtgatctgagtttgtgacaagaacagaaaaagaacacaaatcagtgacaagctggcattaaacataaactacagagcttttgcttaatatgccagctagtgttcctgcatagggaagcacattttcaatttcagatttccccaaagtcacatagattaaaaattctgtgcatcaaagcaaagttaaattacagctttcgaaaaaagctggattctgaaaataattttgtctttcagccagcaattccagtatgactacccgaggcttcaactatccctggacctccagtgggacagataccaaaaaatgttaagtataatcgtgggtcccttgagtcctctggacttcagtcattcatccgacagatatattgaacgacatctatgtgctttgtttgtaataatatttgcaaatgttcacaaagcatctatcatgtttaaagtattgttgtagattctgagactacacccatggacaaaagagatctaagctccaaattctgattaaggggagacagacaagtggtgataagttatatgaaaaaaaggcacaggagggagacagtgggaatcgagagtgaagggttgccattttaaatgggcagtcttgaaaggtcttactgaggaaggtgacatctgagcaatgctataaccagtcaacccgaaagagcaagctgtgaatatatttggggaaagagcaaactagctagaaaatgcgtatcagtaataaaaatgaaaagagagagaccaacgtgagtccagaaattgtttcattcttccttttaatctggccaactagcagtagagtctgtaagtgctgctttagcagatacagacaggatctgaagaagaaatatattgcctcttagtggtattagacaacgatcagtgtggtggggaagtggtaaggaaggaggctggagcaaaaggagagaggacgatggatgccacagggccagaactctgaatttaaatgttagactctttgccacaaagcgtaatgtgtatgtccctttggaaagcatttaagttttacagttaaaacctttaaaaatatttcatatactcttgctccctcattcctgggaacttgtccttaggcaagaaagagagaaaaagaacatgaataggactgctctttgtagcattgtttatttattttatctttttgatggccctcaggctcacagatttgaattaatcataatatttaattcatgagacactttcatcattggtcgatgcatgaccctctgtaatttaacatatttcttttaataaatatgttaatgtaatagacacccatgaacccagtacccaaatataagaattgaaaagacagtattcagaagggggagcatagaaagaaatctaaaaataaatggaacttaagtgtctatcaaagatggtgtggcagattactgtgaaaagaggagactgttcagcaaaaggatctagaaatagtgattattgataagaaaaaaaattaaaatgtacccctgccatgcacattacacaaaaataactctatatagtttaagatctttatgtcaaaagcaaaacattaaaacatggaataaaataaatgtggatttcctcctgctttggagtagggaagggcttaacaaagagacataaccataaaaaatatgtaaaaattagaataaaattaagaaacttgggttcatcaaaagacgtctttaaaaagtaaaacaaaaagcaagctataatctggggaacatatttgccacacatataattgaaaatgaatcaggaatatataattgactaaggatcaaaattttacatcaagagattacaaagaatgcctacaaattaataacaaatatgacaaaataaacaaaagtcacaccacaaaacatgaaacacacgtggctagaaacatctaaagaaatgctcaatctcggccgggtgcagtggctcacgcctgtaatcccagcactttgggaggctgaggcgggtggatcacgaggtcaggagatcaagaccatcctggctaacagtgaagccccatctctactgaaaatacaaaaaattagccaggcgtggtggtgggcacctgtagtcccagctactcgggaggctgaggcaggagaatggtgtgaacccgggaggcggagctcgcagtgagccaagatcgagattgcgccactgcactccagcctgggtgacagagtaagactccgtctcaaaaaaaaaaaaaaaaaaaaaagaaatgctcagtgtctctggtaatcaggaaatataaatgaagactagaattagaaaatcattttatatgtaatcagtttacaaaaattaagaaatctgatattgccaactattgaataggatttatccagcatcctttcaacataatttcttatatgttactggtggtaccatcactttccaccatcctttggcattgtatttcaaagctgaatatgtgcatacctacaatccaacaattctattcctagatataaaaatccctccaaaattagtacatctatgcatgagatatgcacacaaatgtttggaggaaacactgttcatatagcaaaaactttaagtaatctaaatggccatagtcaggaggacagataaataaattgtagtatactaataaaatataatattaaagagcaatgaaaaacaagtgaatggcaaccatatacaacagcatgaatgaatcttaataacattatgttgaattaaaaagtaaataccaaataacaacatatggcatattttctaatgaaattttaaagcaagtataaacaccatatgccttagacgtaatatgtgatataaaattttaagctttataagtgaataataattataaacattcaggacagcatttgcttttgatggagatataagggatgagacagggagaaaacatgtataaatctgtgtacatgagtaggagtgagagggtattaagagggtgaaaaatatgttcagtaataagaaatggcaaataggatgagataactcaatgaaatactatgaagccagccaaaacaatagccataaccctgatccgttcttcttcactgggcaggacctcacagctggggcctccagccaccccaccagctgtattctatggacagaactctgatgtctccttgggacagagtgccttgtgggaggggtgggccatcaccttggttgtttggatgactcagcccttccagcctgtaggcactggaaagtccaaacggaacagagcagaggcagttccacaacacagttccccagcacagctgttttgttaaggaatgaccagactgcttctttaaacagacccagatccattcctcctcactgggagggtcctcccagccagggcctctggccagccccacccatgttctatggccaacagagttctaatttcttcctgggacagagtgcccagtgggtgaggcagacatttgctgtttgggcatctcatccagttcaggctgtgggccttgaagagcccaaatcaattgggtgctgaagagatctccaacatagcacagctgctctaccaaaatgcagccagactgcatctttaagcaggtccctgattccattcctcttgactgggtgagatcttccaactggaatctccaaccacctcctacaggcacggtcaggccagcaacaggtcagtacccccctgggacagagctttcagaggaataggcaggtggccatatttgctgtttcacaaccttcactgatgatacctccaggtactggaaaaaccaatgtgactagggtctggggtagacccgtagcaaaccacagtagccctacagaagagtgcccagactagtcgttcaaagaaaacaaataaaacacaacagcaacaacaaaacaaaaaaaccatccaaaggtcagcaaactcaaagatcaaaggcagataagcccacaaagatgagaaagaattagcacaaaaacactgaaaactttaaaaaaagaaaaagaaaaagaaaaaaaacaacaaccagaatgctccctttcctccaaataatctcaacacctgcccagcaatggttcagatctgggctaaggctgagatcactgaaatgacagaagtagccttcagaatatggataaaaatgaagttcactgagctaaaggagcacattgtaacccaatgcaaagaagctaagaatcatgataaaacaatgcaggagttgacagcctaaatagccagtacagagaggaacataaccaatctgatagagctgaaaaacacactacaaaaacttcacaatgcaatcacaagctttaatagcagaatagaccaagtggaggcaagaatctcagagcttgaagattgtctttctgaaataagacaggccaacaaaaacagaaaacagagtgaaaaaaatgaacaaaacatttgagaaacaggggattatgcaatgagactgaatctatgactgattggggtacctgaaagagacaagaatggaaccaacttggaaaacataccatccaggagaacttcaccaacctagcaatacaagccaacattaatttcaggaaatacagagaaccccagtaagatactccatgagaagatcattcccaagacacataatcgtcagattctccaaggtcaaaatgaaagaaaaaaatggtaagggcaggcagagaaaaaggccaggtcacctacaaaggggaagcccatcagactaacagtggacctctcagcagaaatcccacaatccagaagagattgggagcctacattcaacatacataaaaaagaattttcaacccagaatttcatatctggccaaactaagcttcatacataaggaagaaataatatccttttcagacaagcaaatgctgagagaatgcattaccaccagatctgctttagaagaggtcctgaaggaagcactaaaaatggaaaggaaagaccattacctgccactacaaaaaaacgctgaagtatacaggccattgacattatgaagcaaccatataaacaagtctgaaaaataaccagctagcatcatgattacaggatcaaatccacacacagcaatattaattttaaatgtaaatgggctaaatgccccaattaaaagacacagaatggcaagctggataaagaaccaagacctgtcagtatgctgtcttcaagagacccatctcacatgcaaagacacacagaggctcaaaataaagggatggagggaaatttgccaaacaaatggaaaacaggaaaaagcagaggttgcagtcttagtctctgacaaagcatactttaaaccaacaaagataaaaaaaaaagacaaagaagagcattacataatggtaaatggttcaattcaacaagaagacctaattgtcctaaacatatatgcacacatacaggagcactcagattcataaagaaagttcttagagaccctcaaagagacttagactctcatgcaataatagtgggagactttaacaccccagtgaaaatattagacagatcatcaaggcaaaaatcaacaaagacattcaggacttgaactcagctctggatcaagttgacctgatagatatctacagaactctttacccaaaaacaacagaatatatacattcttctcatcacctcatggcacttcctctaaaatttatcacataatcagaaacaaaacactcctcagtaaatgcaaaagaatggaaatcataacaaagtctctcagaccacagcacaatcaaatgagaactcaagattaagaaattcactcaaaaccatacaactacataaaaattgaacaacctgctcctgaatgactttcaggttaataatgaaattaaggcagaaatcaagaagttctttgaaaccaagaacaacaatacaatgtaccagaatctctgggacacagctaaagcagtgctaagaaggaaatcgatagcactaaatgctcacatcaaaaagctagaaaaatctcaagttaacaactaacatcacaactaaaagaactagagaaccaggagcaaacaaaccccaaagctagcagaagacaagaaataaccaagattggaactgaaatgaaggagatagacacacaaaaaacctttcaataaatcagccaatctaggagctggttttttaaaaaagattaatatgataaatataccactagctagactaataagaagaaaagcgagaagaatcaaacacaatcagaaattataagagggatattaccactgaccccacagaaatacaaacaatcgttagagaaaagtataaacacctctctgcaaataaactaaaaaatctagaagaaatagataagttcctgggcatatacaccctccaaagactgaaccaggaagaaactgaatccctgaatagaccaataacaagttctgaaattgagacagtaattaatagcctactaaccaaaaaaatcccaggattatatggattcacaactggattctaccagaggaacaaagaagaactggtaccattcctactgaaaccattctaaaaaatttaaaagaaggaaatgcttcctaactcattccatgaggccagcatcatcctgataccaaaacctggcagagatacaacaaaaaaagaaaacttcagaccaatatccttgatgaacatcaatgcaaaaatcctcaacaaaatactagcaaaccaaactcagcagcacatcaaaaagcttatccaccatgatcaagttggcttcattcccaggattcaaggctggttctacatacactaattaataaatgtgattcatcacataaacagaactaaagacagaaaccacatgattatctcaaaagatgcagaaaaggccttcagtaaaatttaacatcttaaaaactctcaataaactaaggattgaaagaacatacctcaaaataataagaaccatatatgacaaacccacagccaatatcatgctgaatgggcaaaatctggtagcattccccttgaaaaccggtacagggttgccctctctcagcgtttctattcaacatagtattggaagttctggccagggcagccaggcaagagaaagaaataaagcacatttaaataggaaataaaggaagttgaactatctttgtttgcagatgacatgattctatatctagaaaatcacattttctcagcccaaaacttcttaagctgataagcaacttcagcaaaatctcaggatacaaaatgaatgtgcaaaaattgctagcaatcctatacaccaacaacaggcaagctgacagccaaatcatgaatgaattcccattcacaattaccacaaaaaagaataaaatacctaggagtacagctaacaaaggaagtgaagagcctcttcaagaactacaagccactgctcaaagaaatcagagatgacacaaatgcaaaaacattccatgcacatgggtaggaagaatcagtatcatgaaaatgcccatactgtccaaagcaatttatagattcaatgctatttccattaaactaccattgacattcttcacagaactggaaaaaaaaaaaactattttaaaagagcccaaatagccaaggcaacccaaagcaaaaagaacaaagctggaggcatcatgctacccaacttcaaactatactgcagggctatagtaaccaaaacagcattgtactggtacaagaacacacacatagacgaatagaacagaatagagaacccagaaataagactacacacctacaactatctgatctttgacaaacctgacaaaaacaagcaatgagaaaaggattccctatttaataaattgtgctgggagaaatggctagccatatgcagaaaacttaaactggaccccttccttacaccatatacaaaaatcagttcaagatggattaaagacttaaacccaaaactataaaaaccctagaagaaaagctaggctataccattcaggatataggacgggcaaagatttcatgatgaagatgccaaaagcaattgcaacaaaaacaaaaattgacaaatgggacttaattaaactaagaagcttatgcacagcaaaagaaactatcaacagagtaaacagacaacctacagaatgggataaaatttttgccatctatccatctgaaaaaggtataatagccagcatctataaataccttaaactaatttacaagcaaaaaacaaacaaccccattaaaaagtgggcaaaggacatgaacagacagttctcaaaagaagacatacatgtggccagaaacatgaaaaaaaagctcaacatcactgatcattagagaaatgcaaatcgaaaccgcaatgagataccatctcacaccagtcagaatgtctattactaaatagtcaaaaaacaacagatgctgatgagggtgtggagaaaaaggaatgcttttatactgctggtggaagtgtaaattagttcaacattgtggaagacattgtggcgattcctcaaagacctagatgcagaaatatcattcgacccagcaatcccattactgagtgtatacccaaaggaatataaatcattctattattcaagacacatgcaagggtatgttcattgcagcactattcacaatagcaaagacatggaatcaacctaaatgcccatcaataatagactggataaagaaaatgtaatacatatacaccatgcaatactatacagtcataaaaaggaatgagatcatgtcctttgcagggacatggatggagttggaatctgttattttcagcaaactaatgcaggaataaaaagccaaacaccacatgttctcgaattttctccatgtcagcagtgttatcatttatgtgttcactgaggtggcacttttagttgccttcaataactttttctttgcattcacaacttggctaacaatttggcccaaaaggcctagctttgagcccatctcagcttttgacgtaccttcctcactaagcttaattatttctagcatttgatttaaagtgagaaaagtgcttctcttcctttcctttgaatacttagaggctgttttaggattattaattggcctaatttcaatattgttttgtctcagattaaaaaaaaaaggcccaaggagaggaagagggatgggggaaccaccagcaagtgaagcagttagaacacacacaacatttatcaattaagttctccatcttctacgggtgcagtttgtgatgcctcaaaataatttcaatggtaacatttaagatccctgatcacagattaccatagtagatataacaataatatgaaagtttggaatattgcaagaattaccaaaatgtggcacaaagacatgaattgagcacatgctgttggaaaaaaaatggcacctatagacttgcttgacacagggttgccacaaagctacaatttgtaaaaaaataaaaataaaaaaaacaaatgcagtatctgtgtctgtgatacagatacatggtcaggcacgcctgcaccaatttctgggggcttcatgggtttccccatggttaaggcataagccccatacttccaaagcttgtgaatgtcatctttgtcagcaagagtatgagggccacatttgtggaccaggtggacatggcaaaactgggcacagaagctagcatcagtgtgtgcatcctggcggcagaggtggtgctggcccagtacatattcaccttgaaaaggaagatgagatgaaaaatcaagatcatcaaaattcctgtgtccaggccttgtatctccggatattgtttgccacctatactgttgttcaaggacaaaatcgaaaacagaagaactcagaatgccttaaggagtattgaatagctaagaagttgctcatcaaaagtctgctgtgcatgtaaaaatgatgcaagaattccagaaaagttcagtttgcatcaagaaccctgcaaaaataacaaattatctgtggttttattaaaggaagatgccaaactttagtaataatggactttgatatgacactaagtagattttcctaccaagggaaaagatgcctaatgtgtcataatatgattgacaactataaacttgtcacaggtgaatgtcaaagaggttattgcaactaaaggaaaaatattttattattgaagttgaacctgttaacttcaagagaagtacccatttatggtagaatagtatgctgcccatcaatagtgtctttgttgaacaaactttaccaaaaaatgaaatttaaagaaatcgtggaagaatctgatgttatgctcaaggaaggatataataatttacttgagaagctccaataacacagtattcatgttcatattttcagcagatactggtgctgtagagaagtttatcagtcaagctggtgtttatcatccaaatgtcaaagtagtgtttgtttgtagatttgtgaaaatgtgtactcaaaggatttaaaggagaattacctcatgcagttaacgaacataatgttgccttgaagtacacagaacatttcagtcaattaaaagacaatagcgacagggcacggtggctcacgcctgtaattccagcactttgggaggctgagtcaggtggatcacctgaggtcagaagtttgagaccagcctgaccagagtggagaaaccccgtctctactaaaaatacaaaattagccaggcatggtggcacatacctgtaatcccagcttcttgagaggctgagatgggagaatcacttgaacccgggaggcagaggttgcagtgagtgcgattgcgccattgcactccaacctgggtaacaagagaaaaactctgtctcaaaaaaaaaaaaatagacaatagtaacataattctgctgagactcccaagaagactttaaaagggcatacaaattagccaaattttcacattctgaaaattagatccctaaatgatagagtggataagcattcaggaaagtattgtttcatcaaaagatgaatcactagaagtagccaactccatcttacagacgattctataaacaagcattcttcaggatgttctctcctgcaggagcaagagataccagaattgttcatctcttcatcttgctgaaaggctattttttataatatctttctggtcttgaaagtttacctttatgtatttaagtgttttcagacatgtggaatccatcaacgggaaactccattttcttcacctctctcaccatacttcccactacatgttattaacagattaaaaacaaaacaaaaaacctcaaagtcaaaattagaaaaataactccctacttttccaaagtggcttatgttttttaattttttaattattttgaggggtcttttaaaattgggaaagttagtagaagtccaaaaagaagtttcatgaaattacaaaaagaaaatggcataattttaagtgttgtaatgtttgtaatttgtaattgtgctgatggtatcaccatctcctgaaatcgtgttatgttaggctattttgcttggggaaaatcaatattgaccagaaaagcctggcactgtatacttgctgaaaactattagtgtccacacatcattaaccattacaaaatgttctatattgactcactgataataaacatgaaatggaaaatatttttaaatacccattttccttaaatggattgtgcttattcagccatttagactttagcgtaaattaatttatcccattctttcttgcaaacatactttgatgagatacaaaataaagacatcaaggtcagaaagtaagaaaggagtcaccataccatattgagcaaaaaactacaaggttattcagaacaaacttccttcttcataattttacctaaatctaggcctagtcccaattgtttttcagttagttattgctctttggaaatcaaattccggcgaatggcataatcattaaaaaattcttagtccatcatcatcaatagaccttgatattctgtctagaacaaaaattaatatgcagtatcagagagttatattgaaaataagaacagctccctgaactcagactgaaaaaaagctgtgtatgaaaccactcttacttctcaggtgaccccaaatggaaatagctatgacaaattgtcctgtaatcaagccctaaagaatggactcttacctcttctggagggcctgatcacacacctttgtcagcaactgcagctgctgttgacatctaagaagaaacaaggaaagcggagggctgagggtattgtttgttttattttgattttgctcacttgatttggtcttggcacacaagaaagcttttaactatgaacatcatttatgctaatattttaaatgaatggatgtaatatatttgtactgattacaaccgtgtattactatagttattttactttacattgcactgcaggccttttatcaaatacagatatgtggtgtctgccaaggagtgactctttcttgccagagatggggcaataaacaaaatgagttgttagatctatttcaaaagccatatgtgctgtctgagtttgctgccatccactcaaggggaaggtttgtctctaaatgcttcaaaaggactcactcagcagctgacaaggcctgtgaccccaggggtctgataattcactgctgacatgttttgttttcacagttcagcaagactgtcagctgacccacaagtacaaagtgttttcgtcccctatgcatgttctagcaaggtcttcaaagtcctattggcagcttttcttgactaaacgccgccataacacacctggaccttcattctcttccattttttttttggctcatctatggaatgagcatgacacactctggctagaggaaccccttctagtgttttctttccatatcttttcctgcttctaagtggccataattaaaaccttccccattatagacatctgaaccacaagaatcccttcaactcccactttgtttgaggacattcttgtgtatgctatggaacagtttaatgattttgctttatgtactcattaatatccttttttataattattagattaaattagcagtcaagaagtggtaatatagtctcatataggttaactcttctgatatcttcttcctttagcagtttcacggatacctagtgaaacatacagttcatccccgtcaggtgcaggctcaacacttcatggtgagtacttggggaagatttagggacactgaagctagtggtcagctttatttggacacaggtgtaaaaacaagaactgataagaagccagcctcagatagatatataaaagtacatcttgatgatgaaaattacaatgaatggaaacaaaattcttctcagccattcaaagaagatagagaccaagccttagatttttatacattttatttccaaaaaaatctacacaatagcattttttactagttatatctatgaaaaataaatttcaatttttttattggaaaatagaataattagtcaacatggatttgtttagtctaatgttgcaaatgaatttttattaaccttatcaaacacatcggtgtggagagaaattagtattttgatcagctgaacctctcataccaagagaacaggaacagagcctcacttatccacgacccccaactctggcctttttctgtaccacttacatttctcatggagattctttagcagacatcattttgttgtttggaagtatggagcttcttttttttttttttcaaccaataggaaattttcctattttcaaccaacaggaatttttttttcaaccactaggaaattttattcctttggcaattgttagacaaatctcaggatcccagccttgctataaattggttcttaataaactttacacataatatttaagggatacttagacaatttaaattgagttctttcaaataacatatgaaacccaatcatggttttataccacttgatcaagttgagatgtcttgtccagatatcccctttatatccctagacaatgtctttaccagcacagccagagcattttcagaagtccccacaactgccaatggatctacgaaaactaatcacgtccatatcactggtaagtcatttatcctattttgggggattttatgctttattcactcaataaatatttatcaagtacctgccatttgccaggcattatgccagttgttggatatacagtgaacacactggctttttgaagattataatctattagtgatcgatcatgtgtatagtaaataaataatcacaactaaatttattttgacaagtactatgataaggtgttgtcagggtcaaacaggaagttctgattttaattggaggataggagaggactctgtgaggatatacttaaattaatatctgagaaaaataaataagaatttattcttgttgaataaattgaaaagtagcaaaaagcatttcaagcctatgaaaacatagtctgagaaagaaatcattggaacaaagagtactcctataattcaactaatataatattgtcatgcaaaatgtaatccctcttttatatcataagagagcaaaagattcaataaagttaggaccctcctaatgaaggtcatgattgtaagttcacaggcataatcaacttcaggggtgttcacttgactagtgaatgccacacctaggtactcagctcattttgtgtcaaaggtcatacagtcttctgatcattggagcatcatcttgcacacgtcgtggcaataaagctgcaaactgaggcactacaaagattttaatatattggtgccttaaagagctgtctagtttagagatgggtcaaaaatggagttctgtttttccacttccattgtgaaggcagtggtctcattttctacacttggttggaaaaaaaaatataggcattgatgtaagacctctttaaaatattttgtttggcaagaatgagggatcatggcagacaggaagcaggactagattgcaactctgcagcatgcagagtcttcattgtgaattttagctccagatcaactgcaagaacaaaccagcaatcctgagaaaacccacagaccctctgaaggaagcagacagcctctgtagcacccaggagacaccccaaatactctgggaggtggatagcctcacaaattttcaagcccatctcgccctccacctggagacagactcggggctgttggcggggtggggggcatggtgggagtgagaatggcctgtcagtttgtgtaggagttcggtgaggcctgtgactgccggctttcccccctctttcctgacaacctgcatgattcagcaaaggcagtcataattctcctaggtgcacaactccagtgacctgggaatctcacccccatccccaacagcagtggcagcaagacctgcccaagaagaatctgagctcagacatgcctagccctgccccgacctgatggtccttccctatccaacctggtagtgaaagacaaagggcatataatcttgggagttctaaggccccgcccaccaccagtccctctccagactactatagctgatgctttctggagagctctacctcctggcaggaggccaaccagcacaaaaacaaagcattaaaccaccaaaggtaaggaccctcacagagtccattgcaccctctgccacctccaccaaaacaggcactggtatccatggctgagagacccatagatggttcatatcacaggactctatgcagacaacctccagtaccagcctccagccaggcagactcactgggtggctagacccagaggagagacaacaatcactgccgttcggctcacaggaagccacatccataggaaaagggggagcgtctacatcaagggaacacccagtgggacaaaataatctcaacaacagccttcagccctagaccttccctctgacagaggctgcccaaatgagaaggaaccagaaaaccaaccctggtaatatgacaaaacaaggctcttcaacaccccccaaaacaatcatcctagttcaccagcaatggatccaaaccaagaagaaatccctgatttacctgagaaagaattcaggagattagttatttaagctaatcagagagggaccagagaaaggcgaagcccaatccaaagaaatccaaaaaaaatgacacaagaagtgaagggagaaatattcatggaaatagatagcttaaagaaaaaaaacaatcaaaagttcaggaaactttagacacacttttagaaatgtgaaatgctctcaaaagtctcagtgatagaattgaacaaatagaagaaagaaattcagagctcaaaagcaagatcttcaaattaactctgtccaacaaagacaaagaaaaaagaataagaaaatatgaacaaagcacccaaaagtctgggattatgttaaacaaccaaacttatgaataattggtgtaccagaggaagaaaagaattctaaaagcctggaaaacatatttgggggataatcaaggaaaacttccccagcctcgtgacagccctagatgtgcaaatacaagaagcacaaagaacacctgggaaattcattgcaaaaagatctttgccgaggcacattgtcattaggttatccaaagttaagacaaaggacagaatcttaagagctgtgagacagaagcaccaggtaacctatagaggaaaatctatcagattaacaacagatttctcagcagaaatcctacaagctagaagagactggggacctatcttgaacctcctcaaacaaaagaatttttagccaagaattttgtgtccaatgaagctaagcatcatatatgaaggaaagatacagttgttttcacacaaacaaatcctgggagaattttaccaaaccaccactacaggaactgctaaaaggagctctaaatcttgaaacaaatcctggaaacacatcaaaatgaacctgtttatgcataaatcacacaggacctatgaaacaaaaatacaagttaaaaagcaaaaacaaaaatccaaagtacacagataacaaagagcaagatgaaagcaatggtacctcatatttcaatactaatactgaatgtaaatggcctaaatgttccacttaatagatacagaacagcagaatggataagaacttacccatcaactatttgctgccttcgggagactcacctaacacataaggactcatataaacttaaagtaaaggggtggaaaaaggcatttcatgccaatggacaccaaaagcgagcaggggtagctattctcatatcagacaaaacaaactttaaagcaacagtggttaaaaaagacaaagaggacagtatataatggtaaaaggccttgtctaacaggaaaatatcacaattctaaacatacatccacctaatattggagctcccaaatttataaaacaattactaatagacctaagaaatgagatagacagcaacaaaataatagtgggggacttcaatactccactgacaacactagacaggtcatcaaaaccaaaaatcaacaaagaaacaatggatttaaactataccttgaaacaaatggacttaacagatatatacagaacatttcatccaacaactgccgaatacacactctattcaacagtgcatggaactttctccaagatagaccatatgataggccataaaatgagcttcaataaatttaagaaaactgaaattatatcaagcactctctcagaccacagtgaaataaaactggaaatcaactccagaaggaaccttcaaaaccacgcaaatacacgaaaattaaataacctgctcctgaatgagcattgggtcaaaaatgaaatcaagatggaaatttaaaaattcttcgaactgaatgacagtaatgacacaacctatcgaacctctgggatacagcaaaggtggtgctaagaggaaagttcacagccctaaacacctacaacaaaaatctgaaagagtgcaaacagacaatctaaggtcacacctcaaggaactagagaaacaagaacaaactgaaccgaaatccatcagtagaaaggaaatagccaagatcagagcacaatacaattgaaacaacaacaacaaaaatgcaaaagataaatgaaacaaaaactagttctttgaaaaggtaaataaaattgaaagaccattagtgagattaaccaagaaaagaagagagaaaatccaaataacctaattaagaaatgaaatgggagatattacaactgacaccacagaaatacagaagatcattcaaggctattgtgaacccctttatgcacataaactagaaaacctagaagagatggataaatttctggaaaaatacaacccacccagcttaaatcaggaaaaattagataccctaaacagaccaataagaagcagcgagattgaaatggcaatttaaaaattaccaacaagggctgagcgcagtggctcagtggctcatgcctgtaatcccagcactttgggaggctgaagccagtggatcatgaggtcaagagttcacgacccgcctggccaagacagtgaaaacccgtctctactaaaaatacaaaaatcagccaggtatggtggcaggcgcctataatcccagctacttgggaggctgaggtgggagatttgcttgagtctgggtggcagaggttgcagtgagcagagattgtgccattgcactccagcctgggtgacaaactgagactccgcctaaaaaaaaaataaataaataaaagaaaaattaccgacaaaacaaagtccaggcccagatggattaacagcagaattctaccagacattcaaaaaagaattggtaccaatcctattgacactatccacaagatagagaaagaaggaatcctccctaattcattctgtgaagccagcatcaccctaacaccaaaaccaggaaaggacataaccaaaaaagaaaactacagacctatatccttgctgaacatagatgccaaaatccttaaaaaaaaaaaaaaaaaaaactagctaaccaaattcaacaacatatcaaaaggataatccaccttgatcaagtgagtttcataccagggatgcagggatggtttaacatacacaagccgataaatgtgatacaccacataaacagaattaaaaacaaaaatcacatgatcatctcaattgatacaaaaaaaaattcaacaaaatccaacatccctttatgattaaaactcagcaaaattggcacacaagggacataccttaatgtaataaaaaccatctatgacaaacccacagccaacacaatactgaatggggaaaagatgaaagcattccctcttagaactagggcaaaacaagaatgcccactctcaccactcctcttcaatgtagtactggaagtcctagccaaagcaatcagacaagagaaagaaataaagggcatctaaatcagtaaagaggaagtcaaactgtcactgtttgctgatgatgactgtttaccttgaaaaccctaaggactcctctagaaagctcctagaactgataaaagaattcagcaaagtttccgaatacaagattaatgtacacaaatcagtagctcatctatacaccaacagcaaccaagcagagaatcaaatcaagaactcaaccccttttacaatagctgcaaaaaaaaaaaaaaaaatgaaatacttaggaatatcctaacaaaggagtctaaattcctctaaaagaaaaactacaaaacactgctgagataaatcatagatgacacaaacaaatggaaacacatcccatgctcatggatgggtataatcaatattgtgaaaattaccatactgccaaaagcaatttagaaattcaatgcaatacccatcagaataccaccatcattctttgcagaattagaaaaaacaatcctaaaattcatatggaaccaaaaaagagcccacataaccaaagcaagactaagcaaaaagaacaaatctggaggcatcacatacctgatttccaactatactataaagccatagtcatcaaaacagcatgctactggtataaaatacgcacatagaccaatggaacagaataagcccaaatacttacagccaactgatcttcaacaaagcaaacaaaaacataaagtggggaaaggacacccttttcaataaatggtgctgggataattgtctagccacatgtaggagaattaaactggatcctcatcttatacaaaaatcaactcaagatggattaaggatttaaacctaagacctgaaactaaaaattctaaaagataacattggaaaaattcttctagacatgagctcaggcaaggatttcatgaccaagaacccaaaaagaaatgcaataaaaacaaagataaatagcaagcacccaaaagcaaatgcaataaaaacaaagataaaaagcaaatgcaataaaaacaaagataattaaactaaagagcttttccacagcaaaaggaacagtcagcagagtaaacagatgacccagagagtgagagaaaaccttcacaatctatacttctgacaaagaactactatccagaatctacaactaactcaaacaaattagtaagaaaaaaacaaacaaccctatcaaaaagtgggctaaggacatgaatagacaattctcaaaagaagatatacaaatggctaacaaacatatgaaaaaatgctcaacatcactaataatcagggaaatgcaaatcaaaatgacaatgcgataccaccttagtcctgtaagaatggccataatcaaaaaaaatggtagatgttggcatggatgtggtgaacagagaacgcttctaccctgctagtgggaatgtaaactagtacagccactatagaaaacagtgtgaagattccttaaagaactaaaagtagagccatcatttgatccagcaatcccactactggatatctgcccagaggaaaagaagtcattattcgaaaaagatacttgcacatgtatgtttatagcagcacaattcacaattacaaaatcgtggaaccaacccaaatgcccatcaatcaatgagtggataaagaaaccgtggtgtatatatatatatatgcactatggaatactacatagccataaaaaggaatgaattaacacatttgcagtgacctggatgagattggagactattattctaagtgacgtaactcaggaatgaaaaaccaaacatcatatgttctcactgatatgtgggaagctaagctatgaggacgcaaagacataagaatgacacaatggactttggggacttggagggaagaatgagagggggcgaggggtaaaagactacaaatatgatgcactgtatactgcttgggtgttggctgcaccataatctcacaaatcaccactaaagaacttactcatataatcaaacactacctgtaccccaataacttatggaaaaaaaaaataaaataaaaccttttgttctttcctttatctaaaactttggacgtaaaatattatatcccaccatattaccatggtagagcttagtaaattttgacttgtgtgaaacagaactttgtctagtcctgagttgaccaattgtctctttcatgatcatgctactctagtggtttgaactatgtaaactttctagtcatctgtatatacaatgtgtcacataattatgtattattggactacatgggtctccagggaaccctcagtttctactttgacaggggtgagaatcaggaagacctcgaatccctggatgtatgttgtatgaaagggaactgtcttcaacacttctaaccaatgctaacatgataacatcacatggtttcagtccaggctatgtaaaaacacagaaaagatgtgataactaatattacatctagttctttgacctgtattttttgagattttgctatatgaaaagcagtgtaataaaaacggggcaatgaaataaatttaaatccttgtcttcactcacaagcagttactacctagccgagacaaggaaagaaaaccaatccagatagctttttgcccaaatgatccatgtaatcgaaatacctaaagacctatctatcatgtataagaaatttcactggagtatcattagcaataacaaagtctggaaacaatttaaccatctaacatcgtgagataaattaaataaactggtatatccattgaactatccagtcatctaatagaatgaggtaaatctctgtgtggtgatatggaaagtattccaagaatgttttttaagaaaaagaggccaggtgtatgtcttttggcctcttattcttaaaaaaacatgtaaaatgtaaaatgttaaaaatgtaaaatgatttttaccttcttaggatactttaaaagctcaaaatcactaatcactagagaaatgcaaattaaaaccacgataagataccatctcacataagttagaatggctattactgaaaagtaaaaaaaaaaaaagaagaagaaactgatgcaggtgaggatgtggagaaaagggaatgcttatacactgccggtgggaatgtaaattagttcagccattgtggaaagcagtttggctattgctcaaagaacttaaaaaaaaaattactatttgatccagcaatctcattatattggatatatacccaaaggaatataaattgttctaccataaagacacatggacacgtatgtttatcacagcactattcacaaaagcaaagacatggaactaacctaaacacccatccacagtgactggataaagaaaacgtggtacatatacaccatggaatactatgaaaccataaaaaggaatgagataatattctttgcagcagcatggatggaactggagaccattatcctaagcaaactcacacaggaatagaaaaccatctacagcatgttctcactattaagtgggaactaaacatcgagtacatatggacacaaagacaagaacaacaaacactgaggcctactgaaggttgagaggagggtaaagattaaaaaaaaaaaaaaaaaaaaaccctacctgtcaggcactgttgattacctgggtgacaaaataatctgtacaccaaaatccccacagcacataatttacctatataacaaatttgcacatgtacccctgaacctaaaatagtgaaaaaaaagaaaaagaaatcatggacagaatagtgtgtataatatgcccccaactgtaataaaaagggtatatattcatggtacatatgtatgcttatatatatccacagaaaatttctggtagggtacgtaattaactcttaaaagttatcacctcatgtaggtaacaaggcttagacatgcccacctccagagtatgatcacagccaatgttgaagaaaatatgtttcacgtaggaaaaatggtttaatcctgttttccaaatgccaaagtttgggattaaagttcatctttctttatgcccttttcaggtattgtggtcaataagcccaaagatggaatgtcctggccagtgattgtagcagctttactcttttgctgcatgatattgtttggtcttggagtgagaaaatggtgtcagtaccaaaaagaaatgtgagtataatactaacatatgtaggaacagattaatttttcattataaaatattcatcagtacaatatattattactctatgaagttcctcccatattttaatggggaaataatgctcacagaagctcagagagattatatagctttcccagcattacatagttgggattaaatacacaactcctgactcagtatccctctctgcattggcctagtcaggctgtaacattcgtcagatagagcaagtccgtggacatgaaatgagaactgagcctcacctctcctcaaaactaaaactgatttttcttttaatcttcattattttttcattttcatgcatctttgaactgcctaggctccactggtcatagatgctcaagtgtgaaattgagtgagaaaggtaattttaagagatttccagctgctttttttaccagagtgggcttttactgcccttttctttttttcccaagcagaaaagaaagtaagcattgggttaccccatttttgtcttattgaaatattttccaaaagccttctccaatcggcagtctgaaatggtacataaggttaagcctcatttttctgacttgctattttgagtcagtctgggttgggccataactggaagggaccccagtacccagaactgatcttccacttgtcttactactactctaagataacattaaccattgtgccatatactttcctaccttttgcagagtatccttgaagactctgtaaccacatacagggagtggtgaacaaaacactaaaccagtagttagaaattctggattattttccaaggactacaatttggccaccacatgaccttgagaaactcataattccccaaaaaacaaaagtaaaacaaaagtgcatgtttcgtagaattacctattaatacatatgaagtctccattaaagcatctaaaaattgggtaatagggattagagagctttatattaaatgaacaaatgaaatctgaaaatctgaactgattttttaaattgttctgtattcaaatgtttgttttatatggagatgagaatcaatctctctatcctccttcccccactacccactctttatctctcctaagatgctatggattgccagggcatagaggtgtttgagtgatgaacataaagatgttcacagatatatttctgttgcctgatatcaagatagctagagcatttgtatagctaaattccatactaacttggctctttaatgcatttcggaaaaagagattacttgtactaacataaaatagttctttgtacaaagatgactttaagaatgttcactgattcaaacaaaagggatttaggcattatctagccagtactcggggattgagaagagctttacttcccatctctaccctatccccgcagtacatagtgagtgtttgggcaaaggctggggctagggttagcaaagaggctgtatgaaaagcttcagtcttaaatcctaggattttaagatttagtctctggaggaatattttaatccacataaaagaaacatttcttctattaggaggcagttgtcatggagagtatcagttctggtgaaaagacttgaattgttggtctggttctcttgagcaagttgtttaaaacctctgagcctcagttttatctgtagaatggtgatgcatttcctgcacacaaagtaaataatgttatgatacatttcctgcacacaaagtaaataatgttatgataaaaatgctcagttttatctgtagatggtgaggcaatttctacatacaaagtaaataatgttatgataaaaattctttgcaaactacaaaataccgtatagatcatgaggttcaaatgtgactaacaggcacagggttatgccagcaaaaatgctgaaagaactgggagagtatgtctctttctcatcaatctgtgttctcctttaaagaaacaacacatgtctgtgtgtgtgtgtgcataagactccctcaattcttagcattgaaagaccaatattttgttcctagaatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccagttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgcacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagta

SEQ ID NO: 110 - DNA, 34213 bp, Homo sapiens
gatacacatgaggtcacagatctactgcctctccccctttaaaagaaactactcagctccatttgtctcagaatctagaggaagttgacaaaggtgccacagcagcacagcacagtatgtggtggagagttctcagcttgctggcatggttccccttgcaaggtaaggacttagagttatttttgttgttgctcagctgacttaatgttttgccacatctacctatcagtcagtcaactgcatttacagaggagctgctgtagaagacaacccaggtaactgctaatactttccaagccatgctcaaatcatgcatctgagggatgttactgcgtttatttgatctctcgttcaatggctaaggagtatagaaaggatcattatagtgtgtgtctctgtgggtcctatgttacggcaagatgaaacaagcttattaggctctgtcttttaagggcataccagttgaaagagcatccgtattgaattttattttattttatttatttatttatttatgagacacagtctcgctctgtcgcccaggctggagtgcagcggcacgacctcggctcactgcaagctccgcctcccgggttcacgcctttctcctgcctcagcctcccaagtagctgggactacaggtgcccgccaccaccacgcccggctaatttttttatatttttagtagagacggggtttcaccgtgttagccaggatggtctcaatctcctgacctcgtgatctgcccacctcagcctcccaaagtgctgggattacaggcgtaagccaccgcgcccggcctccacgttgaattttaaaatttccttgctgtataaatcttagccaaacgatttaatctctttgaaactcagtttctgcatcttaaaatgaaaatgataaaaacttttgatccaccaaactccctggattgttagaaggatcaaatttcaaatgtgaaagcactttgaaaatgataaagcgctgtgcaacacttatttagctcagaggtaataatgagaccaatgaaaacttcgtgtttatttttaaagagtaagttatactttacattttactataattttcaaatttggattttagtgcttaatcctaatgtagcattatgaaaattaaggatagaagcagttacctttttggagcaggtcaaattattttctacccaaaagtgggggcaggggtgtaggaagtggctcctgttgtccctcagtctctgcttacaattgtatcagattcatgcaaaggacatccctcacaaatccactcaaaaattttgctttttgtgtgtttgttaccaaatattgaaactgtagttctgtttcatgaaatgcacctatccttctaaatctacatttaatctggaatggcatctgaaggacgctactttaaaaaactcgatttcctattttacatagtacttcaattccctattttatatacttcaattaatgccttctttttttggtccctgtaccctgaggcacttaataaggattcaattttggtaatgaataatattagtttcttcattaagtggcttaaagaatagctaatacattcaaaaagagtacatttagacagctaaaattaggatgatttcaatttttccagagtttaaagcctttcactgaccttaactttttcaggctttgagttattgcctcataaaaaataactcataaaaatacattttttaaataaatagcaaaaattatgtttcaaggtaaacctaaattacttaaatattatttatatagagaggaaaaatattgtttcatgcacagtgctgagtactttgtgttaattacacttaatcatagcggaagtactgaggtaggtactaatatccccaatttaaagatgagaaaagaagttatgtaacctgcccaagttttaaagctagaatatgacaacataaataccagcctataaagcacatagtaaaagtatttatttcatgaaacttctaattaacgtgtgtgtgtgtgtgtgtgtactagttgtgacagaaaatgtattaatgtggatcaaaagttggaaaaccactgactttcacaatttggaggattcaatattaaaaagtcctatttgaaaactcgttcaaggggccacccgagggcatctaagctcaatggcatttgagcagtggctgccacccctgacctaaccttgctcaagcccatcccagacgtaattaggaggaggtgaccatgttgctttcttgtcagcaaaaaaggcagcaaatcatcagttttggcaaagctataaactgtcagctgattttagcaaattaaattatgggaagatcactgtgactacttctacagtgttacttctatggctgccaaaaatttatggaaaaaaaaaaagtcacgtaatctcagagcctgccctcttttcaaggccactcccagaataaatagtcttaggactggtaaaaacacaataaaaatgaagcatttttcaaaattcatcccattaaattacactgtagacaatgaaaatgtcaaatccaatgaattttgaaccctctgttttcattgttttgtggagggtaggatgcagaaaacaaaggaaaattgcaaattgagtagttcttttcatactttctttgcccaggaaaaagtcacatgttagatgacatgttgagacagcttctttaaaatgtactaaaaatattccgattctgacaagtctgatttatttttatacctgcaattttctctattgattcaatctaaaaataataaaaatctttttttgtaatgatctgaattaaaacacacttttgcttaatgcctcatgacagtcatgtaactagggctctgatttgagaattaatgcattgcatgtctctggctttaacttagccctagtctttattatttgatataacagttaaagagcaaagttagcatcctattataatatttattcctaaatatatacttttactctattttttttttttttgagacagagtcttgctccgtcgcccaggctggagtgcagtggtgtgatctcagctcactgcaagctccacctcccgggttgacgccattctcctgcctcagcctcccgagtagctgggactacaggcacccgccaccactcctggctaattttttgtatttttagtagagacaggctttcaccatgttagccaggatagtctcgatctcctgatctcatgatccgcctgcctcagccttccaaagtgctgggattacaggtgtgagccaccgagcccggcctatttactcatttttatccactaattcaaccaatatctaaaattttacattatgctaaaatgagtggatggcaaacagcttttccataaggagtttgtaatctatctacagagaaacacctgtaaccaaataattataaagtaatgtgctaagtgctgtaatagaagtatatctcaagactttgggaaactaggggaaagacattatggggaaaagggaagctaaggcctgttttggaagttttgacaaaagttgtgtaatttgagttgagcctataagttgagtcttgagttgggtcttaatgttgagtcttgaaggagatgagaaagacattccaggacaagagaatatcatagaaaaagacaaactatcttctggagcctggaactttctggaaacagcaagtggacatgtacaaggactatctgaaaaggagtatcacgacatggcaaaggaggagaacacaggagtcaagtcggctggaatttgggcctgattcctataggcaatggaagccatagcaaacacttgaatgaaggaagagacataatcaaattcatgggttatatgtttgtttgtttgtttgtttgtttgttgagatggaatttcattcttgttgccctggctggagtgcaatggcacaatctcactcaccacaacctccacctcccaggttcaagtgattctcctgcctcagcctccagagtagctgggattacaggtgcctgccaccatccctggctaattttttgtatttttagtagacatggggtttcactatgtcggccaggctggtctcgaactcctgacctcaggagatccacccgcctcggcctcccaaagtgctgggattacaggcgttgagccaccacgcccggcctcaaattcatggttttaaaatgtaatcctagaaccagatgatgatgatgaattagagagaagagagactagaactaagttattacagtggtccaggaaagaaatgatggagtccttaactaaggcagcaataatagtgacaaaagaggactaaattgattaaaggatgttttggagaaagaagagtttagagcacctctcaaatatctggtgtgcagtggttggtgatgacattaatttatataagggaactctagaatggggcaggtggcatatctgtgttagacatgggtggagcatggggacagtagagataacgagttccaatgggacatgtagagtttggggtctttgcaggacaggcttgctctgctctggttttaaatttattgcatgtaaaaactaggctattaaggcaagaaaaggaaagaatattttattcttttctcagtctacatgatagtctatagtagaggtaaagattgcacatgagaacttccaaaatcttgggaaagaccaaaaaatcttacgaactgcactggttttgtctatgtgtactttggtagatggctgttactgctgcttgtccttttgtttgggagtagatcacatgtgctttggtgtaaagccatccactgataggacaattagttcatgggatttgggatggtgatgacggtgaaggtcacaggttccatttccatatataaagcagtcacaatctatagccccaggatcagctagcaatctcataacatatggtcatgcatggatggatgaattcagtcacggagataatgacaaagcccagaagtcaataatccattctgtaaacatcacctaccgtaggaagtggtgacctcacaggcgaaacaccacagtcattcattgtcaaggtctgtatgttcagcatgtggggagccgtgcagggctaatttgcagataagaactctgaagctcagataggactaggaagtaggtgtatggcactcggggtctaataagaaagcttaaaggtaaatggggatgtacatgtctctagagcctacagaggaggaagtggtaagcaaagaagatatctcacaccccatccctctgacaacaaaggtgaaagtctgactccaaacttaggtgaaagaaaagtcaaaagaagttctaatttggtttccagtggcaatgagaagaccctggggaacttgtccttggaaaatgtgccaccaaaacttaggcacagcatcctgctcttccacctttaacaaaactacagacattgaaacatatttttaagcactacagtctaagcaaagctgggtgggtctgtggcttctcactggggctattcttcccttctacagtgatttcctgtttctaaatcgaacatggggtctacatgataacactgcaagataagcagacccgtaaagccaaaagcaaggcttgttgcaaagagtaaaggaaacaacgaatattctatgcctcaaacacagccctttccatatgaaactcaggcctctacagtgtggtcaatctggttagccgcctgataccgaattctcagcaagtgcaaacattaatcttaagacatacagtactttagtgtataataaaaagccaaactatatttcatcacaatttttaaaatgttgtaagggttaaattatactatttaattcataagcatgcatcctaagaaagagaaaaatgatacatacaaccttaaaatgggagacatttattcctaaacaagctgcagataaatctcaccactcccatcttacccaatgcaggctttctgtttagaccatcattttaccaaaggtaagaacgttggcaaaacttctgtcaatgtctagtcctcaaggatgaaattagggcatgtttcttaatactactctttattctatcattgattccatgtgtaactttcttccagtagcttccttcctgtttctcagtatttttattaacaacaggagaacaaaggtatctgtcaatcacctacattatagtgccatcgtgaatactagcattaagccagtacttttcaagctcacattgtaatagtttctgtaaggaatgaattttagagaaatataaaacatagccgttgtcctctagaaacttcagtctgtttataggcatcaagacagtacacaagaactagtgagtaaaacagtaagcatcacaatgctatggaagttagacagttctggattcaaatcttggctcaaaagctgcttaacctctgagctttgatgccctcatctgtgaaatgggaataacaacaccttctttacagagttattggttttgggcctgaataactaggctatttgctgttggtgaaatctaaaataacacatttgggggaagagaatcaagagtttgtgttgtacttgttaggctttcagacttctaactgatcatcagaaaggtgatgaggccagatgagatgacctatggagtgagtatagagagtctatccaggatctgacctccgttgtgtgaagggcagattgatgagaagaacccggaaatagagctgaggagcagcagctgccagtgagttaggaagggagtcaaaaagagactgacatctagggaaccaggtaaagacactgatttaaggggcagagagtgatcatatatggcgaaggaacaccataggttgaataagatatggtctgagaatggagcattggtttgagcaatgtgaaggtctttggcaaccttggcaaagagagatttcaacgaggtagtggagttgaaaacctggtcagaaaacaaagagtgggataaacaaatatagatagttctttagaaaaatgtgtcagtgaaagagagggaaggcagggcacggtggctcatgcctgtaatcccagcactttgggaggcagaggtgggtggatcactttaggtcaggagttcaagaccaggacaacatggtaaaactccgtctctgtactaaaaatacaaaaattagtcagatgtgctggtgggtgcctgtaatctcaggtactcgggaggctgaggtaggagaattgcttgcaactgggaggtggaggttgcagtgagctgagatcatgccactgcactgcagcctgggtgacagaatgagaatctgtctcaaaaaaataaataaataaaaaggagggacatagggtagaatagggtagtataggatagtagctggaaggaaatctgacatcattttgtttatgcattttaatatgggatgaatagtatatatttgtgtgctgatgagaatgacagttttttttcttaattttttgtaaagacaaagtcttattatgtttcccaggctggtctcaaactcctggcctcaagtgatcctcccaccttggcctcccaaggtgctaggattacaggtgtgagccaccacatccagccagagaatgatacagctaaagagaaaaaaaacaatgatggtagaattatttttgtaccaaatcatcttttgagagatggagcaacacagaagggaattccttgtgtaaataaatgagatggaaactagtgtccaagtggagataccgggtacccactccattcacagcaatgtagggcacgccaagtatgcaggatctaaaagcaagtagatgtgacttggggatgacattgagaaacacatatgcaaataagttagcatttcaatagcaaacaatttatgtgatgaagagaagagagaagtgggaaaacatattattatttaatttaatttatttttgagatggagtcttgctctattgcccaggctggagtgcaacagcatgaactcagctcactgcaacctcctcctcccgggttcaatgattctcctgccccagcctcctgagtagctgggattacaggtgcccaccaccacgccaggctaattttgttcgagaccatgttggtcaggctggtctcgaactcctgacctcaggtgatctgctcacttcggcctcccaaagtactggaatacaggagtgagccactgcacatagccataaattttattatttcacagagttctaacacctctgtctgtctgtctgtctgtctctctctgtcttttcatcaaataatgattgtgtaccatgaactgagtggtatgattaactacacctttggttggaatctaaggtccaaaatgaaaagaactcattatcaccatttgctcctcaaaacctttaatccttctgaactgttccaatttagatttactgcgactggaactgcttcttccttaatgtctactaggacctaactgcttcttccttaatgtctactaggaccttagaatgtttaataataaatagtcctgtaacactggggaaggagatccctagtgaagagctgcagagctacaaggctttgtcttttgacactgactctttccacttttctttgtaaagcaagagtcagttcagcttttcaaataattattaagcactatataccaagtaaaagaagaatgtcatgcttactatggactaagtactacactaggttctttacatatattttttaattgcctcaatgactctatgagatgaatactattgtttttcctgtttttatggtaaggaaattcacacacttaaattgcctaagttcgtgctgttagtagtggaggagccaggattccaacccagtcaatttggctcgtgtgcgtgtgtgttaccattgcatcatatgccacccaggttagggacacagagatgattataaacagctcctcggtgcaacaggttcagatggtacaaagcctaggggtctattgacagataagacaatcaagagccagaatgttctcagaaagcttgaaccctcactccaaacttaccagataagactgatgtagggagaatatgaaatctgaactttggttccaaaatgaaatgcatcatgaacacaggatagggagacgtgatgtgacacaaattctctgaagaagatctgggtgttttgggtgactgcctcaacaggagcctagtgagatgttacagctcaagagtgaaaccctgggcttaatagaacaaggaagtccagagggtgggtggtgatgcaagtgaatgtccccctatgctcttgccagctctgatgacacataagtcccctgtcccatgcaaaggggcatatttttggaggaacatggacaaactacagtatattcacatgtggctgttggcaagtggtgaacaaatgataatgaaactagaggcatagcttctttaattatttgaccttatgctatggaaaagacttttatcttcagaagacccagtctgactaagggcataagggcttggacgcagtggtatggtagaatgtcttctggaagtctttgaaagtgagattgatactcatcttcctgttccatgtggtttctgcagcagcagagagttggtcccaagtatctgaggagcagccacagggctctggaattttattcattacactgcaactgtgggctttgggaataggatgctctgaacactcaggcctggggtcagaagaactgatgcgtgggccccaccacgaattccgagttaattagtagtgaatgaggccaggacacaaactccctgagtgagtctaacatactgccaaggtggaggaccactggctttcctaccttcttaatatggatgtcatgagaacacaaaatagggactcaatggcttcttaaatctttattatcagcaaaaatcccttagaagaaattctattgtcattctctattaatatcatccttattactcaattatggattgatgtcacagaggagaatatttccaaatggccaaacctaagcagaattctggccttatgccccagtgctttttttggaaagcacagatctctttttattacctccttgttgttcattatggtattggtggatgatatgggtgtttttccattagaactccagcaaacagtttcccgtgaaagcttatatgaatccaatacaataattctgggttatttctgctagaggctagattcaaattaatgacctaggaatggaacaaacaaaaaagtagacaccaattaattcccagagctctccaaagcacttttcctaatacttgaaatttatcacaagaaaatatattctcctggtttcttttttgttgttgttgttaaggtttaagatgatgccgtaaaacttgttacatttgctattcataatttataaccccatggtattcttctgtttataaaagtggtttataccttcattgataagaattgccttttcctcaggacaaataatttaatttataatatgaaggaataatgaatggcaataagcatgccaaatcatcaggaatgccagtttatttttcatcaatttctttttttggggagataaatgtgcagctacttagaacaaattgttcatcattctctgggggttgtgattcggagaaattagacttgtgtttgtctggagaaagctcggctgtggaatactgaattgaatgaaatcttagaacatcctccctctggtgtagaaactctcggacaggtggggctcagccacttgccctgaagggtaactccgcagttcaccagagcaccacgattataacattctttcttagaattctagacacacaacttgaaggtactagatgctcttttataagctgaggccagaaaggttgcattttctggggccttgtggcttagataggctgatgtagttacataaacacggcctttgccatccacagccctgggtacagatcccagctcaatgacctctgttaccttgagcctctattccctcgtctgtaaagtgagcacaattcttcctttctagggttagtttgaaaattaaattcgggttgggtgctgtggctcacacctgtaatcccagcattttgggaggccgaggtgggcagatgacttgaggtcaggagttcgagaccagcctggccaacatagtaaaaccacgtctctactaaaaacacaaaaactagccaggcttggtggtacgtgtctgtaatcccagctatttgggaggctgaggcatgagaatcgcttgaacccaggaggcggaggatgtagtgagctgagattgtgccactggacttcagcctgggcaaccagagtgagactttgtctcaaaaaaaaaaaattaaattcaatacaggtaaatggcctggtacagttcctggcatatggcagagcaatcgcccaaaacctgttgaactgtagtttgaccttccctgtcttctgtcaaaatcctaccccttccttcagacctgattccagggtccccttcttcaagagatatcattactgctcctactctcagttcttgcctctcccctcccattttgtttgtatttgcttattttttggtttctagaagaaatagataatacatgattgaatgaatgaacgagacaaaatccctgagacactgtggacccccggcctgatcatccccatttctcttcctccacagaggcctctctgactaaccacacagaaaccatcaccgtggaggaaggccagacgctcactctaaagtgtgtcacttctctgaggaagaactcctccctccagtggctgaccccctcagggttcaccatttttttaaatgagtatcctggtaagtgaaagaaagaaagaaaaaatgccaccagaccttaacctgagggtttttccagccggacagtttggtgggacagaaagcctgcatgagtcacccaaggggtgggctcagcccacctactgttacacatgaatcacgcctccaaatcctgttattttacacgcagtggcttgctgggggcaggaactgtgaaatggaaaccccaccagaatggttgttaaagggggttcagattacaaagcacatttccatgtccccaccccacactcacaccactttttcactctcagtaactatcacacaaccacagcacaatgacagacaggcaaccaactgactgggagcccgatcctcatgcaaccaccaccaccccagataagaagccagctgcttcgttttccatctgagcaatccaaaggcacattacaaagctcctttccagatagctcttcttctcctgttggtcttaacataaaatcaagatttttaagcaatagaaatagacaggatgtattaatttggaaatgaggacagtcatttctcttttcacaaacacacatgaagaaagtacaagatgtctgagatggaaaaagactcttaagaatctcttgggttcatctctttgacgttaggcagggttttactaaaccctagatcattttatgtctccatttaatattgctaactgccaaatacttggaaaagtctaaaacacatttcagtcttatttataaagcagagcctcttaaagcatatcatgctggctgggcgtggtggctcatgcctgtaatcccagcactttgggagactgaggctggccgatcattttgaagtcaggagttcaagaccagcctggccaatattatgaaaccctgtgtctactaaaaatacaaaaaaattagctgggcgtggtggagcactcctgtaatcccagctattgggggaggctgaggcaggagaatcacttgaatctgggagatgacagttgcagtgagctgagatagtgccactgcactccagcctgggcaacagagcaagactctgtctctaaaaaaaaaaaaaaaaagttatgctttgaaagcattattagatactgatatgttaacataaagaaatatattatttcaagctaaatcaactagaagtaaatactaattgttaaaagttctgagagaaaaaaattttaaatagagataattctgttacataatgctttttgttgttttgtttctggttttggtacactgggagaagagggactctctcggatttctgcagcagaatggcttgatctagctcagtggttccccacccggaatgatcttaccttcccgtggagataggacaatgtctggagatagttttgattgtgccaaatgtagaaagcggggcagtgcttctggcatctactgggtagaggccaacgattcatcggatatctttcctcataacagctctatttccctcttgtacagctttaaaaaattccaaataccagcttcttcatcactcggccaatcagctctccatcactgtgcctaacgtaaccctgcaagatgaaggcgtgtacaagtgcttacattacagcgactctgtaagcacaaaggaagtgaaagtgattgtgctgggtaggtacctgcaagtgaacccagtaggggagcaatatggataggaacacgatatgtcgtttttaaactgaaccttttagtttaaaaatgttgcctagagcaaggaattgcctgggacacctctgccatcttttattgaaaggaaacagaagagagcattttgagaagcaagaccaagattgaactgtgaacttgtgaaatttgtctttgacagcaactaaattttctctccagggaactaaaagaaaagaaaaattgatatttgatgagctgcgactatgcgccaggcaccatgtgaggttctcgggaatcagagatgaattaggcacaatctctgcccataaggagtttgcgcaccagctcaggaagaaaaacatgtatgcaaatgaagtggaacctcatgacagcaaatcctaagatagaatgaattcagatgtagctgcactgcttgatctgctcaaatcctctctgccaaacaattcctcttttctgtaggagggcgggattgggaggtgcggataggaagtgacagcctcctaattacctgggacttactcagttctacagatggtcaactgtgtccagtatgtctatccttacttgttttgttttttgtggcagaacagatcgattaaaaacattgctttttattgatctctaagtaacatcatctcacatatcacacaaatgaatgtcttagacttctcctgttgaattactgcagtgtggtgcctgccatacggtaaaggcatgatgggaaagtagctgagaaggagtggctctcggggaggggtttgagaaccattgtgactcagctcagcgttgtctttttgtaagggagcacacatcctggctcagctgcttgtgtgcccttctgggctctcataacaccccatgtatactctgtcattgctctcaacacataatcttttcattaacagtttaggggctgaagccacaccagactattagctccttgaatcatacctttttcatcttcgtattgccaacaagtaacacatctaatgtatatttggagctaagaagtgcctttataaggtcttgatggcagatgggtgagttaagtaaatggggaagagctcagttctggactgaagtggaagtagaatgggaaacaggaagaagcaagcctaactaaaaagtatttccaagacagaagtataaagaaaaaggacgaacatgccctttataagataaatgcacctttttttttttttgatggggtcttgctctgttgcccgggctggagtgcagtggcgcaaactcggcttactgcacacaacctccccatcccaggttcaagcgattctcctgcctcagcctcccgagtagctgggactacaggcgtgcaccactatgcccagctaatttttgtatttttagtagagatggggtttcaccatgttggttggccaggatggtctcgatctcctgatctcgtgatttgcctgccttggtctcccaaagtgctgggattacaggcgtgagccacctcgcccggcctcatataccacattttaagaattgttgctacattgcttgttcgggaattttcagagactaacaacacactgagtaatacacattctggcttcagccaaagtagctttgcaagcacatgaaagccctttaacatgactgtattctggaagagattaagttaaaaaatatgggccgggcgcagtggctcacacttgtaatcccagcactttgggaggtggaggcgggcggatcaattgaggtctggagttcgagaccagcttggccacagagaaatctcatctgcactaaaaatacaaaaattagctgggtgtgatggcgggtgcctgtaatcccagctactcaggaggctgaggcaggagaattgcgtgaacctgggaggtggcggtttcagtgaggcgaaatcgtgccactgcactccagcctgggcgacggagactaagtctaaaaaaaaaaagaaagcccattaattagagtataccctataacaatcacctacagattattagcctctgtgctttgttgagatatgcagactcatatctaattaacacagaaaaatccattttgttctagcaactcctttcaagccaatcctggaagcttcagttatcagaaagcaaaatggagaagaacatgttgtactcatgtgctccaccatgagaagcaagccccctccgcagataacctggctacttgggaatagcatggaagtgtccggtaaggggagaaatggttctctttgtcttccttcctactcaaatttccaggggatttttaaatgttttggcaccctctagtggcagacaatgccagaagacatcatttaatatttcatcagctcttttccagacaagttattcttacaaccaatcaattttatgccttaatcttgaaaggctaatcatagatattgaaaatgtttttgtttaaaacaggtaaaaatctaaagtgaactataatgacttcttaaaatttcacaaaattgtctaaaataagtataatacagaagtataatatctcaggcgaggcacaatggctcatgcctgtactcccagcactttgggaggccaaggtgggtggatcacctgaggtcaggagttcgagaccagcctgaccaacatggagaaacctcgtccctactaaaaataaaattagctgggtttggtggtgcatgcctgtactcaggaggctgaggcaggagaattgcttgaacccaggaggtggaggttgtggtgtgagccaaaaatcacaccattgcactccagcctgggcaacaggagcaaaattctatcaaaaaaaaaaaaaagaagaagtataatatctgtgagcataaactttttcccagatataaaatcgaaaatatatttaacataatacatataattggaacagatatgatcttccctatattgtatagtactatattgtgtcatacccacaagaacagattaaaaatattcttgtaacaaagcacctaaaggttgagcctttgaaacagaataactaattaattatggtgtctgggtactgtttatagtttgcttacatttcaacagacattacctttgatatctatgtaatcaaccatcttttttttttgagatggagtctcactctgtctcccagtgcagtggcacgatcttgactcactgcaacctctgcctcctgggttgaaacgattcttctacctcagcttctggagtagctgggattacaggtgcatgccacaacacccagctaatttttgtatttttagtagagacagggtttcaccatgttggccaggctggtctcgaacccctgacctcaggtgttccaactgcctcggcctcccagagtgctgggattacaggcgtgagccactgcgcccggcctgtaatcaacattcttagagttgcaaaggaccctttacagttgagaacactgagggccaaatggagttctagagagaaaagacctaaacccagatctgattcccagggcagtgccaattctacttcattataagacttccctttaattcgccttattcatataaccagaataaggtcttggatctttgtgtttcataacaacatcaagctgtccttcttaagctttgaatttttttttccagtagtgaaaagtttgtagaaaaccatcatctactctcattcatctgtttgcctttgtgaccagaaccaagcctatacaagggaactggctgaggttagaatgaggttagaaatctaatgtttgccatgaagtcaaggccattggcctctaatagaaccaacctcatccagtagcattaaatagccataacctcttcaaattgctacataggtggaacgctccatgaatttgaaactgatgggaagaaatgtaatactaccagcactctcataatccacacttatggcaaaaattcaacggtggactgcattatccgacacagaggcctgcaagggagaaaactagtagcacccttccggtttgaagatttgggtaagaagaactaatgattctcttgaataatttttgatttactttaatattacactatcaaacaaaattaaatgcagtgggcagagtccttcagattaagattactgccaacaaagctttcctaatagcaaattcctgtactgattgaaatttctccaggtgagtgacggaattccaactattccaatgttcaaaagaaccccagttgagcagaaagcctagcacagcgccatatgcaaatagtgtcatgcttgctttttgataatgactttaaatcgttttattgctgttgtgtttttggagtaatcatatgaatcatactgcatctttgtacttgacccagaaggagataatgttagctgaaataaacctaaattgtcaatatcattttatgtgaatatgaaacacacagatacatgaagacataattcctgtttagatttattttattgttataattgctttgaagattttagtttaaccatgttaatattctgagttgaacaccattttaaacatccaatattaaatgtgaagaggagttgcctccattctcagaacctctattctatgattctttccccaaaagtccaagaaataattttaaaactgtacacaactctttgagccaagaggtatcctttaagatgcatgagtcctgtaagaagtctgcaattagtaggactctgagtttcactgttttacaaggtacttctctgtgtaatcaaatcctaaagtataaggaattactcacatcagtgaaagaggaaactgttggatgacaatgcatttattgaaaaagctcttttatcagacgaaatcgctgatgctgaaaggcaagcttgcttaggagaacctcactgtgggaaagctgccgtgatgccctgtgggggctgtggctgcggttaacaggccccctctgactaccacaaactttccatgggtcactttctcaccaaaccaaaagtagtcattgcagaagctgcactgtaagactcatggacctacagaccgagctgtacagtaaccttacacaaccacccccacccctctgtgagtcatccccaccccacgcctccacctccagcagtagaactgaagcatagggcatgtgggggatgagcctgtatctaaaagcttcctaaagacattcaggttcttcaataggagaaccaacaatgtcgaaaaaaatgcattcttaattttcagcaattgttcaagccatctacaaaaattactatgaagggggaaatggcagttctccacctttacggctatagctctgtatgactcaaaattatagctaaagatgtttttaataataggctaaggccaggcgtaatggctcacgcctgtaatcccagcactttgggaagccgaggcgggcagatcacctgaggtcaggagttcgagaccagtctggccaacatggcaaaaccccatctctactaaaaataaaaaaatcagctgggcatgattgtggacgcctgtaatcccagctacttgggaggctgaggcacaagaatcgcttgaacccgagaggcggagtttacagtaagctgagatcacgccactgcactccagcctgggcaacagagcgagactctgtctcataataataagaataataggctaagacttaatttttatttgtgatctatttgctgtactcattgccagatctccaaatagtattcaaagagaaacgccagcatcagctgttgatagcttccattagttcattgtttcttccatttggctagctgctactatattgacatatagatgttacaaacattttgttcacccaattaggtaaaaaatattactagctgaggatgctttaaaacacatttacacataagggttctgacccctttcattcctgtgctctgcatggaaggacctgggtaaagtgagggtcatgccagcaccaggactagggtggtcctgaggaaagaagtgccttcctctgaaaaagccacagtgtgatgcttcgagaaagagagtagagcaacaggaattgatttttgaataggctatctttgtttttatgttttgttttgttttttgagacagggtctcactctttcaccaaagctggagtgcagtggtgtgatcgcggctcactgcagcctcaatcttccaggttcacaatcagtcctcccacctcagcccctcaagttgctagtactacaggcatgcaccactacatctggctaatttttaaatttttgctgagacggggtctccctatgttgctcaggctggtctcaaaactcctaggctcaagaaattctccctctttggcctcccaaagtgctgggattacaggcatgagccacctcacccagatttcagaattatcatttatttatttcttttcttgagacggtctcactctgttgcccaggctggaaggcagtgacacagtcttggctcgctataacctctgcctcccaggctcaagttgatcctcctgcctcagcctccggggtggctgggagcacaggcatgagccaccacgccctgctaattttcatatattttgtaggtatggggtttcgccatgttactcagcctggtcttgaattcctgagctcaagcgatccctcaacctctgcctgcctcccaaagtgttgggattacaagcatgaaccaccacacctggctctttttgttgttcttgttgagacaaggtctccttctgtagcccaggctggagtgctgtagtgcaatcatagctcgctgcagcctctacctcccagacttaagtgatcctcccacctcagtctcctgggtagctgggactacaggtgcacacaccacacctggttaattttaaaattttttatagagacagaatctcattatggtgcccaggctggtctgaactcctgggcttaagtaatcctccctcatcggccacccaaagcactgggattagaggcgtgagctactgcacctggtttatttcatctttttagtatttaaaatgcggaatcttggttttctattacttacctggggataggattttttaaatatttgaaaaacagttctcaaacttttgatttcaggacctctctacaatcttaaaaataatcgagaaccccaaagaacttttacttatataggtgatgtctgtcaatatttacctattagaaattaaaactgagaaattaaaaaaatatgtatctgtcaatttattttaaaataataaatctgctacatgttaacagaaatggcatatttgtttttattttattttttgagatggagtgcacttattttttgagatgagtgcagtggcccgatctcagctcactgcaacttccgcctcctgggttccagtgattctcctgcctcagactcctgagtagctggcattacaggctcctgctaccacacctggctaatttttttgtatttttagtggacatggggtttcgccatgttgggcaggctgatcttgaactcctgacctcaggtgatccacctgcctcggcctcccaaagtgctggtattacaggcgtgagccaccgcatccggcccagaaatgacatattttaatgaaaaaaaaagtatattttgtaacactgaaaagattagtgtgaaaatgtcatttttttacattttgaaaatctcataaatgtctagcttaacggaaaacaattaggttcttgtaacttttgcattcgatctcttccaaaatgttattttgctttaaataaatatataaaaattcaatctcacacaaatatataattggaaaagggtagaatattttaatagctggttcagataattgtggctattcttctttgatgttacaccaaaactcaacaagtagtagtttcttaaagattagttgctatgtggactctgggcccatgtcaatgaacttttcatactgttatattaaaacccactgaactgtcttacactttgcttagaatttttacccaggcatgatttttctaacattatgttttagtcatttggaaaatactgattcactaagttctacagaactttccaatgttgatatatttcagcatcaaaatcacattcattaatatcatcaccgatctcatcagaaatctttaagcatttggaggttgtcaaactcacagtggtggatacaagttgtccgaaatttgaactttaagtgtgactattgcaaatgaggagctattttattttttgagatggagtcttgctcttgtcgttcagactggagtgcaatggtgctatctcagctcactgcaacctctgcctcccaggttcaagcaatactcccacctcagtctcctgagtagctgggattataggtgcccaccaccatgcccagctagtttttgtgtttttattagtagagtcaggtttcaccatgttgaccaggctggtcttgaactcccggcctcaggtgatctgcccgccttcaccttccaaagtgctaggattacaggtgtgagccactgcacctggcctaaatttttaatatattttcattttaattaattttaatttaaatagtcgttggagctagtgcataccatattggatagcagaggtctacaatattctgaccaactaggggggtagatcatcatgtgccagtatccacccaattaaaacaacattcagtctaaatgcaatagtttgctagcttgttaattaacaggataaatcaaagtaaatacagagtctagttttaaatatgtatagataaaacttgttttgtacataaacataattttctgaattcacatagtatatactatgttagaagatttaaatcactattgataaattttattctatatgtccccagtgatgtccttcttcttttttaaaattttgagacagggtctcactctgtcacccaggctggagcgcaatggtgtaatcacggttcacagcagcctcgacctctctgggctcagatgatcctcctaccttggcctcctgagtagttggaactacaggggcgcaccaccatgcccagctatttttttgtagagatggggtcttgccatgttgcctaggctggtctcaaactcctgggcttaagcaatctgcctgcctcggccccccacagaactgggattacaggcatgaaccattgtgcccggccccatattcttcttaaaatttattcccagtacttctatttgactagcattccagcttttccctcttttcattgccagcagctctcctctttcttcaattttctctggcacctgtgtggtcagagttcattttagccttatagtctatactattatctctataatgtttccttagtaattctttctttcctcagagcccttacacacaattcaggtatttttatatttttcatacagtttgaatgtttgattaaccagatatgttttcaaaaccatggaaaattatttgattaaataaacaccaagaagcactcacaaattttataaaaacatgaaccacctgtgacgtgtcagtatatatatatatacacacacacacacatacatatacgtatatatatatatatatatatatatatatatatattttttttttttttttttttttttttttttgagagggagtctcctcgctctgtcgcccaggcttgagtgcagtggtgccatcttggctcactgcaacctctgcctcccaggttcaagcaattctcttgccttagcctcccaagtagctgggattacaaacacacacacaccaccacgcccggctagttttttgtatttaaagtagagatggggtttcaccatgttgaccaggctggtcttgaactcctgatttcaggcgatccacccacctcagccttccaaagtgctgagattacaggtgtgagccactgtgcccacccgacatgtcagtgttagtatttgtaaagtgacaggcacagttattacatgcttcctggatgtggctggtaaaacctgttcaatgactggtaaaacctatactaggctgaccctctggaaacattcctaagcattgattaatgttatacaataacatttagcactgtgcttcataaatagctaggcattgtactaaacatgttatataaatgaacttactaattctcacaaaacactcgaagaggtaaatgctgtcagtatctccattttacagataagagaaaaaaaagtgctaggtcgggtatcttgtccaactcattcaggagcaggtaaatagcagcactggaattcagcccagtctgaggctgattccaaagccatctaataggtagatagataggtggatgggtagataaacagacagagggattgattgatggatagaaggacacagatagaaacagtgaatactctttgcctaccactgccaccacacagaggtccagcatgctgtgctttaagccaggcaggtgagcagatggacactcagtgggatacagattcaaaaaccagagcaggagccacagaacacacagttctggggtttctgcacaacctctacaagcaggtagccgctaaatatattctccaatctcttttactgagcacaatgtgggtaaaactgctctctatagtagcagaattttgtttttcccctttcctagttactgatgaagagacagcttcagatgctctggagagaaactctctatcctctcaagacccacagcagcccaccagtactggtaagtgtcaaaatcattcaaacttgtttttaaaaaatcacgtttccttgggaaggttatttttctcattctaagttttaagaatattttttgttttaatttttactaagaccatacaggcccctccaactggctccagctttgtaccatcctagagaagaaccacatcaggcatcggaatacttagtgggatgggcttcaggctgacataaagctttgcaagttcagttctagtttgcctgagatagagatgtacacatgtacacacacacattcacgactgtgacatttgaatttcctctgcagtaaaggacaaagttgaattcatttatagagagactcgtttctttgttttcccatctgaagcacaccaaacacaaaacacagacttggtatcaacaaagagaaaagaagcagaagctggagatttggtgttgtcattgaataacaaaatcacctctgaaggcacatcaattacttgattgtcaataactcaggtcatttttgatgatgggattgaactacaaatacagaataatttagaaagcctggattataattccaattttttagacagtgaactcactagaggttaactcagagcaatgattgtatatctaatttaactttgtattttacctagcatagtatccagcaatagcagcttctcagaaaatgaattacgaaagaaagaaagaaagaaagagagaaagaaaagaaagaaagaaaaagaaagaaagaaaaagaaagaaagagagaaagaaaagaaagaaagaaaaagaaagaaagaaagaaagaaagaaagaaaaagaaagaaagaaagaaaaagaaagaaagaaagaattggttatggtgctttgagcaagactattagcctcatccagaaaggcataaattcctacatattctctttccatttcatgtaatgtgtcaataataatttcatttgttggaataagggctttcagagcattatcatgttcatagttctgagtatcagatcatatttttaaaaatttgtatcctaaataatatttaaaagtaaatgtttgggatttctaaacactgataaatacaacatgtaccatacaattttttgaaggacaatggaaattgaaaatattatgaagtggaacagccacatcacttgctttaataatccaatatttgtaaacgtgtttagaatctagtaatctttaacggcttgctactgagcaactcaattttctgctctgctttttcatatataagacttttaaaatagggtttctaaaattcctttcagctttccatttctacgattttattacatttaatacccattttcaatagaatgggaggcttcattcccctcggggtccacatagtggcgctgtgcaatggactaaaaagcaagaaactgcagagagaaaaaaggaaattggaaacatcagcagtaaaatctggaaaaaaaaaccacacagtttctgattttttataatttatcttatctagaaaaaacatcatagtacatcccacttctaatggggaggcaagcagaggtttgaataactgaagctatatttcaacataaatttcaggctgtaggttttctataattaaagcttggaatgccgttcctcggtgttcagttgttatcttgaagcatcctaaagaccttctccctaataggcctgattcaggatggaaatatgaaataatggtttaaatgctgggctctagagttaggtaaaacagagtttatgtattggctttgccacttatttgctacaggactttaggtactttacataactgctctaaacctccgttttctcagagctgtggtgagaaataatatataccaagtgctcagttcaaggccaggcacagagtaaatgcccaaaacatttaccttaaaaaaataaggcaaagtgagcctagccatttgcaattatgtttgcaagaaatccatagttcacaaatgatctcagtactgtttttaaatttggcttcccaagctgctctgggaagacttacgtaactacagttgtatgtagtcacatgtatataatgcatgcatagctcatgttttatcttctttcactttagtctcagtaacggaagattctagtacatcggagattgacaaggaagagaaagaacaaaccactcaagatcctgacttgaccaccggtaagtgtcacccactgcatttagaataaacactcgacattttaacctcttaatcgataaattcaatggcctttgtcagtcctcccttttcttgacctttctgccctttaggacatgattggttaatcactcccttgtccctccttgatttagttacctctcggcttcttgacatacttttcctggttctgttatttgttgctaaccactgcttctctgtatccattaattaacttatcttcctcttctgacttcttaaatgtgtatgtacttctgattttacttctccatcttttgttcttcccttttttttatatatatatattttttttgtgagacagagtttctttcttgttgcccaggctggagtgcagtggtgcaatcccagctcactataacctccacctcccgggttcaagtgattctcctgccttagcctcccgagtagctgggattacaggcacacgccaccaccccagctaattttgtatttttagtagagatggggtttatccatgttggtcagtctggtcttgaactcccgacctccggtgatctgcctgcctcggcctcccaaagtgctgggattacaggcgtgagccaccgcgcccggctgttcttcccttattttttaaagagtttactcattcccaagatggttcctgttgccactaggcaaaagatttctctcttttttttttctggttttgttttgtttttagagacagggtctctctctgtctcccaggccagggtgcaggggcacgatcatgttcaccgcagccttgaactccagggctcaagagatctcctacctccacctcccaaatagctgggattacaggtgtgagccactgtgcccagtaagcaaaagatttctatacctatatttccagaacatcctcctcagcattgctcccaatttctttccattttctatgtatctgtagctgaattttctgtgatttccccaaactcaacattgctaaataccaaacagcaccttctcccacaaaatcagcttgtccaaagcatcacacaggccccaaagcaacacacgggtcccaaaccttggtgttatctatcactcctatgtatgtgtacaaatatatctatgtgtatatgtatatgcatatgcacacacgtatataaaatcagtcaatttccaagaacttttgagtcttgtctttcaggtattttgtccattgtcactgttaacgtcccaatccaggctctcatcatctcctgcatggagtattataacttcagtttctcctcctctggttcacttttagcaccctaccatcaaaatatctctttatctgcatacctgtgttctaaaaccctttatagcttcctgaagtctacaacacagagcatgagtcccaaacacctcattaggtgccatctattacctacttctgcagtctcatatctacaaagtccttatgagatacatatttttctctgaaaacatcaacccttttcaatcgccctgcccttgtttatcctcactgcccctggtggaagaggagacctcctctcacctctccttactccctcttcaaggccaatatcttcactgaaaacttttttgaccaactcaaccctcagagaccattcttgcctctgaacccctgaacacactatgatataaatacatatggatccagaatttgacatatcttacttttgtttgtttttattaatttgtttatatatagagacagctaatccccaaagcatgtgaactgtgccttctgtaggtccaagcacaatgttctacacatagctggcactccttaattattcattggttaagatgaggtgactaggacatttagcaagactacagcccatagaatcagaattctaggtttagaaagcctttttttttttttttaagagacaggtctcatctgtctcccaggttggagtgcagtttcacagtcatagctcactgtaaccttaaactcctggactcaagtgatcctctgcctcagtctcccaagtagctaggactacaggtgtgcaccactgctcctggctaattttttattattattatttttgtagagacaaagtgtcactatgttgcccaggctggtctcaaactcctggcctcaagcaaccctcccatcccagcctcccaaagtgctgggattacaggcatgagccactgcacctggctagaaatattttcacaagctcatctgatttagcccaaatgccttcctgtagggccacatttaacctaaccaagataaataaattttcattttatttggatagttttttaaactccttaacaatccctcttgctacttaactatattttgctaaaaatcattcctaaagctaatttgaatctcctgactataacttaagtcgattttctcatatgctttctgtagaaataaaaaataactagcccaatagctacgtcacttaaaaaatcttttcaaatcatcacacataattgccttgtttgttgtatgcctgtttgcttgttctcagagaatgaacaatgtaagtctctttaccttcaggggtaagctctttctcatctcttcatctgagctgtctattagcttatatcacattgtagaagtattgttacatattctccagtggcaaaaaaaaaaaaaaaacccaaagtatctaaactcctttttcattttccttatagaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaaggtcagtgggcagggaacctgacgggggctataagacgccagaacaaatggctaaaaaaaagggaaattctgtccattaaagctttctgtcagacactacataatctatttgataagtgctgtctcagataagcaattgtttgttttctagtaaactcgggtgtgaatctccagggactatagtctaagagtgtataatcaatagaaactagcatagatccagaaattggcattaaatgatagacacttctattcacagaaggataaaaatcccaggactgcctagcacagtccctacaggaatcaaaaactatgtgttgaattaatgaggtatgagttatgggaggggcatggtaagtctactattgcacagtaacagaggtattatcttattcaaatatacatttctacatgtccatggcatcagaaattagttgcttgattttctttttttgtagaaaacgaagtttcagaacacacactagaaagttacagatcaaggtcaaataatgaagaaacatcatctgaagagaaaaatggccaatgtaagtcaactgtatgacctgagatctgaacaatgaggttcattaatgtattagtcagatttctccagagagacagagacaacagaatatgtgtgtgtgtgtgtgtgtgtgtgtgtgtgtgtgtgtgtgtgtgtgtgtatgaggtgggatttattaggggaattggctcatgagattatggaggctgacaagtccttggacaggaggtctgcaaactggagaccctggtatgctggtagcctggctcagtccaagttcaaaggcctgagaactcaggggaccgccagcgttaagtcctgaaatccgaagctagggagtctcgagttctgctgccaggagagaggagggagtgtattccagctccagcagacagatcaacacatttgccttctttctgattttgttctttctgggcccccaacagaatggatggtgcccatccacatcaagggcaaatctcaatgcccacctactccactcagactcacacactaatctcctctagaaacaacctcatagacaaacccaaaaataatgctttaccagatttgaggtatttcttaatccacccaacttaacacttaaaattaaccatcgcaattaagtagtcgcctttaaaaagaaggaggctgggtacggtggctcacgcctgtaatcccagcactttgggaggccgaggcgggcggatcacgaggtcaggagatcgagaccatcctggctaacacagtgaaaccctgtctctactaaaaatacaaaacaattagccgggcatggtggcaggagcctgtagtcccagctacttgggaggctgaggcaggagaatggcgtgaacccgggaggcggagcttgcagtgagccgagatcgtgccactgcactccaacctgggtgacagagagggactccacctcaaaaaaataaaaataaaaataaataaaaagaaggagaagaatcaaaatctgattttttagcactagaaagtctcctaaatcatcctgtagaacttaaggagtctcatctgcaaaaataaatagtagcagttaagttcatgtagcagaaggtgacttccttttgggaagccatccttgactgtttgacgtcacacacagggataccccaagaccaccagaggatcctatgacacctttgtcatagaagcacgtcttcctccatattgtaatttttggtgtttttacatagctactacaatactcctttaggtggtgagtaatcagatttactctgtatcctcagattctagcacaggttagttgataaatttgtgttaaatgagtgactataggctcaattaattcaagaaggcatgtgtcaggtcctttggatgacttcattgcaattcctgagacaaaatatgtaaagaaaatgaagagaatcgggatgggaaggagattgtgtatgggaagtggaggttggggattgtattcttgataaagatctggaaggcagaagctaggactatagaaaagcaagaatattccaccttccaaccatattatttcctccatacaaactaacttattctacccgccaggagctgcaagaaatacagcgagttttgccgctctattctattggttttactgaggtttttgtaggaggcttgtcttttataacacctctgcctctttaggttttgacctactagagcgtgaactgaaaagaatgaatagatgtactagctgggaaaggaacacaagagaattgactgtgtgaaaactgggggtgggaggggaaaatgtgtgtaaataacatccaagtcgattgtgttgcaacacctgtttctaaatacccgtcatcacatactcacctggtggacaggaaaatgatgttaatatcatgtgtgagttgggttgctccctgagctgtttttcctaggcaagaagaaccaaaacagtgggagtagaattatgtctgttagctggaaaaatggaagcccttccagttcaacttttaaaacaatttttctttctttttttttgagacagggtctctcactctgttgcccaggctggagtgccatggtgccatcataggtcactgcagccttgacctttcgagctcaatcagtcctcccgcctcagccttcctagtagctgggactacaggcacgcaccaccacgcccagttaatttttatatttttagtagagatggggtttcaccatgttgcccaggctggtcttgaactcctggactcaagtgatccacccaccttggcctcccaaagtgctgggattacaggcatgagccaccacgcccagccaactttaagaatatttaaaatgagtacctgcacgactcaggggattcctccccagaaaagtacatcttcaggggtttgctgggggtttcactttctcccgagctcaagccttcactttcatcctccttgccttagcaccctcaaatctagcattttaattgtgttgttttggacatattaaaaatattctctggggccatctctagtctctttgtacagaattgcataggccttgagtgtgatctgccccgaccctatttttgcagtaagccctgttatttctagtgtgcaattttgctaaggcaatatgttatggtcagcaacagattattttacagcagaaatatctgtatattttatttcacgtttaccagtatattgtttatatagtaagacttctttaaaaattatagtataggccagtgcagtggcttatgcctataatcccaggatttggggaggctgaggcgggtggatcacttgagcccaggtgtttgagaccagcctaggcaatatagtgaaaccccgtctctacaaataatttgaaaattagctgggcatggtagtgtgtgcctgtaattccaggtactcaagaggctaaggttagaggatcacttgagcccgggaggctgaggctgcagtgggccgtgatcacaccactgcacttcagcctgggtggcagagtgagaacctgtctcaaaaaaaaaccacgaaaaacaaaaaagaatataataatgccttcagaccatttatatgcatcagtaagttttaggtttttataaagcaatatgtgaacctaaaaatatgatatccaatcaaagtgtttcaagtaaatgggtgcaatgttattcaaaataaatattcatcttcaacatgtttttctttcagcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgtttaaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgcactccagcctgggcaacagagggagactctgtctcaaaaaaaaagaagttacttccaagacagacttttaagatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagttatacttcctgttttcacgtgtgaaagtaacatgggacatgcctttcttttccgatcagtttatttaagctatacagcaaactttggcatttatgtggagcatttctcattgttggaatctgaataaaccaattacaaaataacata

SEQ ID NO: 111 - DNA, 16933 bp, Homo sapiens
gtatagcagaagctttttcacatctatgacacccgctatgtcttggtaaaccctggaagggaaaggaggacaaggttaaaatactgttccgaggacctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatgggtgagtccctgctaccacaccaccctcaggttgcttttttggctgaacaagaagggtcctcccaggcaggaagggtggggcacagaaacgtgagccaatgtggatgacttggggagggctttgcagttgaatctcctgaaaacagcaagaagtacagacctccgggcattctagactcagattctgtagacgcttccctttggccgagccaagccagggttgctcaggaactggggtccttgagattggattagattggacggaacgacacaggattgcaacgtgctgaactgtgaggaccggggtttagcttgagttccccagtctgtccacgaggtccaagcttgagatcattacggcgaccacatctcaggaggaagataggtcagcaacgcagtgacgtgctggaatagttttgaaatatttgaactattctaatgcaaactcttcttttaatgacatttcacattgcatcttgtgtcattttatttctgtagatgttgtctttccacttgacatttaattggtgtttaatttaagttgcaaatattgtgtatgtatctgagtctagtgtgagaatcactactctatgcctgtgcatcccacatcaagtaacgtttttgagtgagggagctgtgccatgctgaatctgcagcatgccttggacataagcatgtagcttgtcttctccagcttggaggagagtctcagaggaaaggtcttagaggaatgcaaaggtggaggggtcctcataatatggaacaacgacagctctgtatcacccttcttatggaaaaacccagaataactgcccatgtgttctgtgaccttggattgtggaggaacagacggatgtcgattctgccagccactccttccccagtgggcagcacatccttgccccccaaccttcctgggcacctggagttcagatactaggggaatattaatcagggtccaaccaggaaaacagaaacccttctctgcagttaacagagagggaagtaaatgcaggacggtgcccctgcattggatcccagcacaggcaaagaacgttagtggaaagatgatgaaatccaaagaaagcctgtcagttaattattgtaccagtgttaatttttttttttttttggcggatgtgctggggtcgtgtaaagcatgaacattagagggacctggatgaagggcatatgggaactctctgtacctctgcaactcttttgcaagtttaaatttattcccaggtaagaagtgtgtttaaaaaatgaattagtcggccgggtgcagtggctcacgcctgtaatctcagcactttgggatgccaaggtgggcggatcacctgaggtcgggagttcgagaccagcttgaccaacatggagaaaccccgtctctactaaaaatacaaaattagctgggcatggtggtgcgcacctgtaatcccagctactcaggaggccgagacaggagaatcgcttgaacccgggagccaagattgcaccattacactccagcctgggcaacaagagtgaaactcagtctcaaaataaatatataaataaataaataaataaataaatcagtcaacaaatacatatcaaaaaggaaccagtggccacatggaggcaaaggagcatgaggaatcttctgagcagtgaagaaaatcttggatatgttggtggtttcacagctgtcagaattcactgaattgcacagattaagtggatgcagtttgtgtgcaaaggatcctttgataaagctgaataaaaatcactaatgaagacctaaagtgaaaagaggcagggaggataatctaatgcatagaaaccattatgccagtaaaagaagagtcagaagcaggaaagtcattctcaggagccactgtgttttggcctcatgttcaatgctaagtttcaaaacaaatgtagtattccttgcaaccatgagaagttggtgagtgatttgaaatcattcttatgatgaggtggaagcttttggaatctgtacccctgcactttatccttgtcctcatgatttacaaaaccatgaaaataaagctcagttaattcatcatcatcaaggtgagctccaggttcagtattcagcttgaggctggggactccatctttctttaacttttgactgcatagccttcacttagtttttatatctcttaggcattacaaaaaattaggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactggggaggctgaggcaggagaatggcgtgaacccgggaagcggagcttgcagtgagccgagattgcgccactgcagtccgcagtccggcctgggcgacagagcgagactctgtctcaaaaaaaaaaaaaaaattaaaaaaaatatatatttttttagatggagtctggctctgtcacccaggctggagtgcaatggcacgatctcggctcactgcagcctccgcctcccgggttcccaccattctcctgcctcagcctcctgagtagctgggactacaggcgcccaccaccacgcccggctaattttttgtatttttagtagagacggggtttcaccgtgttagccaggatggtctcgatctcctgacctcatgatctgcccacctcggcctcccaaaatgctgagaagattacaggcgtgagccattgcacccggcctaaaaaatctttaacatattatattaagcagttttagttggtttattgttattttttagatggattgctgtcttatggactcacagaaaattggattagattggaaggatataccagggactgtaacatgcagaactctttgaggaccagggtttagcttgaattcccctgtctgtccacgagatccaagtttgtgatcattactgtcaccacgtctcaggaggaagactggtcagcaaggcagtgatcatgctggaatgtttttgaaacgtttggactattctgatgcaaactcatcttttaatgacatttcacactacatctcatgtcactatatatgtttttaaatttttaatttttgtgtatacatagtaggtgtatatatttatggggtagatgagatgttttggtacagcacgtgactccctcttagttatgcaaatttctccagcaagtcgttgcccagcagcctacttgaattcctcccctgaaaacggacttttcttttctaccatgtggctagtccgcaaatttttcgaacttttacactttgcttctcttttaaatataaactctacctttaggtaatttctttgctcccacatctgagcctaggttggtacaagaagccatgccacttgaacactttgttgcttagaaatttcttctgacttggccaggcttggtggttcacgcctgtaatcccagcactttgggaggccgaggcgggtggatcacgaggtcaggagatcgagaccatcctggctaacacggtgaaaccccgactctgctaaaaatacaaaaaattagccgggcgtggtggtgggtgcctgtagtcccagctaatcgggaggctgaggcaggagaatggcttgaatctgggaggcagaggttgcagggagccgagatcgcactgcttcactccagcctgggcaacagagcgagactccgtttaaaaaaaaagaaaagaaatttcttccgccagacaccctggcgtggtatctctagggcatggacagaatgcagccacgttgtttgctaaggcgtaacaaaggtggctttcgctctagttccaagtaagatccttatttccagctgagaccttgtcagcctggacttcgctgttcacatcactatcagcattttggtcacaaccatttaatccatctctaagaagtttcaaacattcccttctcttcctgtcttcctccgggccctccaaataacatgaggtctattccgttaacaaatttcaagtgaacaagacgttattgctgacgatgggtcgtatgtggtgcagcagatctctaggcctgtttgttaataactccccatttccccctcctcccagcccccgtaaccaccattccctgctgtgatgttgtgactctggtgactttgcagatctcctgtaagtgacatcatgcagtacttggtctctgcctctgcgtcgcttggcgtgatgtcctcaggtttcgtccgtgttgtcgcccatggcagaattttcttccttgtttaaggctgaatagtattcccctgtgtgtgcaccacattttctatatcaattattctatcaatggacatttagatggttttcacgtcttagctattgcgaatagtgctgcagtgatcaggggagttcagacggctctttgacatactgattttttttttttttttagacagagtcttgctgttgttgcccaggctggagggcaatggtgcaatctcagctcactgcaacccctgccttctgggttcaagcgattctcctgcctcaaccttccaagtagctgtgcccaccaccacacccagctaattttttgtatttttagtagagacagggtttcactatgttggccaggctggtctcgaatttatggcctcaggtgatccacccaccccggcctcccgaagtgctgggattacagctgtgagccactgcgcctggcctgtttcttttaaatacagacccagaagtgggattgctggaccatatggtagctctatttttaattttttgaggaacctccccactgttctctatagtgattgcccaatttttaattcctactgtggtatgcgagggatccagtttctccacatcctcaccaatagtctccttaaaaaaataatatgctttgtaggatatttttaacgtgttaaataccttgtcgggattttagcatagatcacaatattaaaaacttggggaaggatttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctaggtgagtcctggaggcagccgggaggctggaaagggggtcgggaggtctggaaaattccctgctcaagcctgactctagtccagaagattctggggaggaaagtgtcctcctcctcccaagactgccctgctgctctccctggggcctaagtctgatcagagaagatcttgtcctaaaaacaggggcccgggtgtggggatgaggtcagctttaagaagggctgggggagcaggagcctttttggaggaggagactttgggatttatcttgaaaccattttgcagcaagaaggattacatggagacagtgatgtcgaggagggttggcttggtcgttatgaaatgctgaatgccccccagctccatcgagcccccttttgacagcagccccgtaaggagactgggcactgggcatttttctcactggggcttctcttccagtgctctgcctggcccagaccatccacacgcaggagggtaagtcatgccttcgtcccatcttcccagtcccctctgtcaccccaagggcagtgctgggtgggagtgatgttgattcttagagggcctggagagatccctttaaatataccctagattgcaaactcttccaaatgtaaaatgcataaccaaccctcacccagttctctctcgcatcctccacctgtcttattttgcttttcttattttcaaaaattttatttttaattgacaaataattgcaatttgcggggtacagtgtgatattatgacgtatgtacacattgtggaaagattaaataaagctgattaacatatcagccccatcacatacttattgtgatgagaatattttaaatctccttttagcaattttgaaatatacaataaattattatgaactactgtcattctgctgtgccatagatctgaaaaattcactcgtcctggctactcgaaactttgtatcatttgatcagtgtctctcccatgccccgcacctgcagcctccaataaccaccattctactctgcttccgggtgatcaacttttcttagattccacagataagtgagaacgcgcagtaattgtctttctgtgcccggcttatttcacttagcctaacgtcctctggttcatccatgttgttgcgaatgacagaatgtccttccttttttagggctgaataatattccattgcatatacacagcacattctcctcatccattcatttggcggtgggcactcaggttcttgccaggtcttggcggctgtgagtagtgctgcggtcaccctgggagtgcaggcgtcagctccgcacaccgatttccacaatgagaattcaaacccaacacaaccaaggctgagcccggcacttttccccagacgagcccacacttcactcggcagcttcttggcggggaacatgacagtcacaaagggcagactctgaacactcatcctcttctccatcctcctggatgcaccatgtcacccagtcctggtgatttcactctaaatttttctcatctttccctctctcttcatcgacttttcctgcatcacccccaggtgacagcccctctcccctccgtggctccccgaggccggcctcagcctgtccatgccactgctgcctgctcccttcctgaccccagggactggcgatttgcaaaagcacaaccatgaccattgtactttccacagtttttaaattgtattcaaaaattttcatttaatatctcatcgtaagatgaaatctttttttttttttctcagagcccttcccctgtttatcttcagatagaatcagacctgtgcacctctctttggtctggacatgcccattttcccagccacatcctgtccctgtgacctggggctcactcatctctacattcctccaggttctttcgctttctcaaacactccatatgccgctcaatatggtggttcttctcacatgctgattttgaaaaaaaataattcattttaaaaatgaccaatgaggctgggtgcggtggctcacatctgtaatcccagcactttgggaggcggaggtgggtggatcacttgaggtcagaagtttgagaccagcctggacaacatgggggaaaccccgtctctactaaaaatacaaaaattagctgggcgtggtggagtgcacctgtaatcccagctactcaggaggctgaggcaggagaattgcttgaaccttggaggcggaggttgcagtgagctgagatcgcgccactgcactccatcctgggtgacagagcaagactctgtcagttcacagctgcagatttggacaattctttgatcaataccggtcctcccttctggaagtccacctccaaacggcaggcatcctgtgtgtgtttctcacatttgtggaattagcagcccatgaaaaacgtctttaaacagattgataagtaactgagatatggttaaaagaaagaaaaatgaacaaatgggtgggtttggggagatgctggtcaaaggatagaaaatttcgtctagacaggaagagtaagttcaggattgtgcaacacaatgactagagttaatcacaatgtatcatatgcttgaaaatcactaagagggcagattttaaatgttctcaccacaacaattaactacgcaaagtgaggttatattaattagcttgattcagcgattccacagtgtatacctgtatcaaaacatcatgttgtacaccttaaatacatgcagttttaatttgtcaataataaggaatgaatgaagacgggacgagtgaattgaagccctgccagctctctgccccgctcagggattttgctaattttgacacaaccttcctgtttcagggcgtcaaacccgcccttcctcctccaccccaagcccagttgagataaatggggtttttcaagagccttaataagaaggaaatgcaaattaggctgagaagaaagtagaaactatagaggaaaacccagaggtggtgtctccacagagatctgcattagcaatggggacctgtcacgggctgggcatctgctgtgagcagatcagggctgggggcttcaccctcaccccaccagaccctcaaaggagcctggcaacccccgtcccacactcagtcccacccggggaccggccagtgcccttcaggccccagcacaagccatctccagagccctcgcttctctgtcccttgtccttcaccaatgaccctgtcatccccatcctgtgcctccctcccacactctgtccctctggaaagtggccctgggctctgcagcaggcatgaagggctccaggctgctccgacacttcccacatgaccctgagcaaggcccaagttgtgagcaagtctcagggtcctcactgtcaactgggaaaaaactctgcagtgatgagaatcacatgcacgtagaaggtgcaggaggcgtgggaatgttctaaggttgggctgtggtcatggctgcataactctataaaattgctaaaatccctgaattgtgatgctaaaatgacgtgtgtggcatggtgacttcctacagtggacgctgagatcctgctctgcttccctcctagaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatcgctgcatctattataagccccctaaatggtctgagcagagtgactacctggagctgctggtgaaaggtgaggacgtcacctgggccctgccccagtctcagctcgaccctcgagcttgtccccaggtccctggaccctgtcccagctgctgtcctctgtggccaaccttgtcctcctcctgaccccaagccctcccctccccttcttcctctgcacacacctcccctctgccctcacacctgcttaggttcctggagccctggtctcctctggacgccacggatggcgtggacactcagctccagcatctggtgggctcagagctggctctgcttggctgggtggggagtgggttcccagagattagggggcaacccccctacaagaggatgagtgtcttttcacacgggatggatggtcccgcttattcctttccactgagccagaacctgccccaggcaatgtgcttctcctggtgtggttcatctcccactgggcagaacgcagggtccagggatggcccctgaccagggcgggacagtgctttgggaaaacctttggtatgtgaccacatgcacccctgtgtgtgctcagcccgagatgtcctggagtcaaagtccactggagaggatccaacccatcttcatgtccctccaggacctcagcagtcccctgaggtcaagaagagcttgtggtgggaggagcagagggagtgaccagccccagggagaatggggcaagcagcggggctctccccagcctcctgtcccctgccccgttttctcaggagtctcgagacattgtctgggattgcgtgatggtcatgcggcctttggatgggggctcagggtggaggagggcaggttggttgggacgggttctaaatccttctcctgcccctgtttacagaaagctctggaggcccggactccccggacacagagcccggctcctcagctggtcagtagcagggccctcagctggaggggattacaggggaatctgtgctgcggatgctgttccgggtccagccctctgccctgggcttggagtcaaggtctagggaggccacgggaaggcaccgacacccaccaagctctgggaggtcgctaatgctcacagagaccatagcagcaatggtaccgtgattgcaaccttgttccatgccaggaactgtggaaagcacttaatgcaagcaccacttaatgggggaggtactagtctgatcctctaactcctcctcctctctaatatgcaaaacataaattaaagtttcgtgcttaacggcacaaggccatgaaggggcaggggccacccacccgggcagccccaccccagacttccgggctcgcccgagctccacgctgcccccttgtgggcgtggcctcaccattcaccccgctctgcacctgatggagggacttagaactcaccttccaacctgggacacccggagagggacggggctgctcctgttggctctgtgatctccgggggaggcctgaacggtggagtaaggtcccttaagaggaggagggctccacagggaggggacgtagctgtgaacggtgaccaggatgaagccatgaggcttcccttccatctggctctgccctggactctgtgatgggattgaagctgccccaagtccctgggtctcaagttgtccatctccccctgtgatctgtgaccagaaactcccaggggaggacacggggtcataagccattcgcggccccttccccacctgggtttctatccccagagtacgtccttggacctagacccggtgactgcctgtgaggctcgggctgtgagctcaggcaggtgggaccaggggctgaagccacatggggaggtgggaggagcgatgccgtgctccatccggaccccctcagaggctcctgggctgctggggcacagcgggacatgctcctgagtcccgcagacctggttcaagtccagtgtctggtttttattagccttctgtctgcgggaatatcttgcctctgtttctctccctctcttcttctccttccttctctcttctctcaccttcatgcagtgacatataaaggtcacgaggacagaccctcctgcagccagattgctgggttcatggttcaaatcccggtggttctgccacctcctggctctatgcctgacggtgactcacccaaacctcctgtgtcccaaattcctcatgtgaaacagaggcaatagaagagctgtcctggtagaatcgtttagggcagacttgagttcaggtacacacggcgctgacatcagtgctgattagaaaaccccaaaggagggatgctcctattaatactgaggaagtattttgtcctcacagggactgtgccaggcactgaagcctccggatttgatgcaccaagaatgaggagaaatggcctcccgtcttgtgaacttcaatggggagaaatagttagaatgagcaatagaaatgcactgattcccatacatgcatatacagataaaaatatatgatttgcaatgtagaatttcagacctataatttaaattatattatatatgtttacatcataatatatatatatattatatatatattatatatataaggaagataattatataataaaacatgttagtgtatcactacatatgactatagtgtatattatatattatatgaaagatatatttacaatatatagtataataaatttcaagtgttatagttaataaataaatataggtattaatgtaaatatattatctattatgtatacattatgtataactataatagaaaaaatattttatatttaatcataggtttatatcaaatataaattatacattatatattatagtgaatatatgtaacatatattataagttataaatcatatacaattaacattatatacattaaattatatgtatatgtcaagattacataattaaaaatatatttgttatatattatacatttgcataatacatgatacatataactataaataatataaaaactgtaatattgcacatatataatacatatgtaattttaaatggtggcaaatgttatgaagaccaagcccaggaagtcatggtgtagaataacgggtggtgtcctggaccttagaccgtggacgaggcaggagggaaggacattccaagagagaatgtctgcctttcttgaaggatattgaagatgctgcctcagccccgggggaggggagggaccgctgttcctggaagagggacgcttggctcggaccctgggtttgggggagcccctcaggaccccatttagccacctgggaattgggtagtggcgtgcactgtgcagaggagggtgaaggttggaggagatgacgggcgggcctgcaatgcgctgcgtagggagcctgggcggtgccccacacactcgcccgctagctgcagggcttcaggaaagaggagcacatcgggacttggattcttcccacaggagggcgggttacatccccgtcagagggttgccgggagggcagataaaatcagacatgaggattcttgccctctggtgggaacccagaaggaggtcagggagggaaggtctcccttcctcttgttgcgggtggttggtctctgcctagatccgcagagggcagaaattagcgatgtctactacagcttcacgcccaggaaacgcgctgtatctgcaccgtccagtagggatggcatcaggcccgtggggtcactgagtcctggaggtgcagacggtgcagccagcttctcatgccattcaactttggataaatttaaatatcaatagctatgtgtgactctcatgctggacagtagatgtagaaagtttccatcatcacagaagactctgctggtcggtgctggtctagagggagcagtcagggtcctggggagtgaagggagatccccacagtggatgtgggaggactcagagccttctctgtccagctcaggactctaactcctcctccttctgattcctccctcccaggacccacgcagaggccgtcggacaacagtcacaatgagcgtgagtgatgggggccgtggagcatgaagctggtgtgtgcctcttggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattagtaagtctatgaaacgcacgtgacgtgtgtgtggtatacagtaggtgctcaataaatgcacactgctgaaatcctgtttctgtctttcttagatgcacctgcttcccaaggcctgaaagctgagcatctgtatattctcatcggggtctcagtggtcttcctcttctgtctcctcctcctggtcctcttctgcctccatcgccagaatcagataaagcagggtaggtctcaggggcagggtggggtgacctgggaagctgtcaggagaggctaggaagaaggtctccttaattcacaccccgactgtccttagggccccccagaagcaaggacgaggagcagaagccacagcagaggtgaggcccctgggaatgactcctggacctccacccagtcctcggccgccaggctgcccctgaggttcacttttatttttcctcttaggcctgacctggctgttgatgttctagagaggacagcaggtaaagggggaggaggagggacaggcctgggatggggaagtggggacttggtgccaatccagatgcaatgtggggggtggggggaagaatctttgggaacattctagaaggtcgtattatacattgggtgcaggatgtcatcggaagctgggggtgggggtctcaggcagatttgccttgcgacatcctccccagaaaactgaccatgtattttctccccaagacaaggccacagtcaatggacttcctgagaaggacagagagacggacacctcggtgagccttcctactagttattaaagtaccccaaatttagcagcttaaaaaaatctcagttccttgggttaggaattcaggagtggctcagctgggcggttccggctcacggcctgtcctgaggttgctgtcgagaggtcgcccagggctgtgtgcatccgaaggctcccgtgggctggaggatccacgtccaagacgctcacttccccggctgtgggcaggaaacctctgttcctctcacaggggcctctccacacagccggcttcccccagagggagggatccaaggatgggtggcagggaggggacagaagcaccatgtcttttggctcagcttggaagtcaggagtcttcccttctgccttgttcattgtcacgtaaaccaaccccaataccctgtgggagggctcttcacacggatgcaatttaggagagggtcctcagggcccatggagatggccgccacagccctccctccccacagcccctcgtctcaccctccaccaggcactccctcaccctgggtctctccctcttaggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacagatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccctc

SEQ ID NO: 112 - DNA, 11233 bp, Homo sapiens
tgagcccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacaggtaaggcacgggctccaagagaggccaaaggcaaatgtgatgagggctttagggcacggctgagacgggacacatgtcctgggagggggccgggggtgatggactcaggagaggagctggaccagagcctgagcttccccaggaccgcaccttggatgcccctcctgatcctgcaggcccctcccctcaccagccctgacccacaggcctgacatcctcatcctgcctctgacgctggcattgtggcatgtggggccttatgactccttgttttggggcctgtcctaggcatggccggggtttagcaccatcccaggcctctccccaccagatgccagaagcacccactccacccatgcagtgagacaataacaattatctccacacattgttaaacgtcctggggggttaagtcctccccagttgagagccttaggtctacacaaccccgtgactctctcaggccaggccagggaggaagcacttcctggcgcaaaccaagggcagcagaggcacctgagcctggacagggagactcagcacacggcccctccatctctcatgccctgaggtcctcggagatccacatttagatgctcaaaagacaggagggacctccacgatggtccagaggccgggagggcaggacctacgtgtctggtgcaggccctggtgctccagggaagcccggaggtaggaggtgggacacggtctcttctcctccctgggtgggtctctagggtctctgagcttcagggtttccttcactctgtgcagagggaaccagttcctatagcatgtgggtttgtagtttctctttcgtgctgggttgaggtctccagctcctctccagcccctctccagccccctgtgggtcccacagccctgcccctcctctccctcccacttctctgctcacacaaggagcccaggaaccctctgtctcagagatgctgctgcctctcttgtgggcaaatgaagagagggacagtcggggctgggctgagcctcatttccccacagcgtcccaggccccactgtcaagatacaggctggaggtgctggagttggtgatggtgcaggagggctagtgcgtctctgtgccctgcagtgtcctttaaccctattacaactgaactgactctagccctgtccatggatgctggtttaagaaagggatcaatatacaatggaataatccagtggccacaaacatcccaaatggaaaagtgcaggagacacggggccgattccacctccttggggacctgaagaccaacaactgctccctgagcatcagagatgccaggaagggggatttgaggaactactacttccaggtggagagaggacagataagatggaattacaaaacgaagcagctctctgtgaatgtgacagataaggcacaggctccaggagacaccacagggaaaggtcatgggggtggcagcgaaagcctgggatggggcccctgccctgggagagggctgagggtgaagcgagttgggctcagggcagaagctgaaccagagcctgagcttcccccagggctgtaccatggatcctctgtcctgatcctgagtccccctctcttcaccagccttgacccacaggcccaacatccttatccccggtaccctggagtctggctgcttccagaatctgacctgctctgtgccctgggcctgtgagcaggggacgccccctatgatctcctggatggggacctctgtgtcccccctgcacccctccaccacccgctcctcagtgctcaccctcatcccacagccccagcaccacggcaccagcctcacctgtcaggtgaccttgcctggggccggcgtgaccacgaacaggaccatccaactcaatgtgtcctgtgagtgctgagccaggacgccctggtccctgatgagggggggacgtccctgagggcagaggatggggtcagggctcgacactgggtgctgggtcccagaatctgggctggttgtgggatcaggaggacgctggctccgccttccccatttatgcagctcctggggagacagggccagtgtccccagccctcacagtgatgcaggtctccatgtctttctgtcccagaccctcctcagaacttgactgtgactgtcttccaaggagaaggcacaggtaggatggagccccctccctggggctgggggagcagggccttcagctcagggcagggccaggtccctcctcatcctggactcaccctggtgatatgagactcccttgtagttgaacccaggcctcctccccatccttagcctctgtggccacctgagcacctgtcctcttccccccactcccctcagactcttgcacacacaccctcctcagccctgcagccaggacagggggaaatacatatagcaggagcagcctttgggcctcttatcttccatctcctgaatatgccacctaactcgtctttttattttacccaatagttttgagctacgttcttttggatacatgctataatcacgtgggcaaaaattttaaattcacagtaaaatgtgtccccagaatcaaccagggtctgtccaggctgtcctgagccttggtttgtgcacctggaagatctcagaggtggtttgatgtcagcagtgagactgtttgcaccctcttctagggatgtgtgtgattccactgtctgaatagtctctgattttgtggcatctcctaatggaagatcatggcactaattttatcctacggcacgaacactgcaatgaataatgttgtatctactcccacaaggaatatctaagtgtataggataaattcctaaaagcacattttaccagtgtcatatgttctttctgattttgaaagatatggtgaagttgtcctcaaataaaggtgggcaagtttacattcccaacagtgagcggtgaacataagtatgtccctgcaccagcctacatcactctctgttccattccccagtctcattctgtatccttcctccctgtttcaatcactttgtctctttgaacctccaactttttctctacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggtgggtaagggaggggctggaggaggagaacacacctgccccaccctcatgggccacccactgcccctgagcttcaagggggagctcagctctggtctgtgctcagctgtgaggcctggaacttccctgcaacccagggcactgctgtcctcttcctgccaggaaaggtgtgtaaggcaggaagaggggaggagtgggtcttggaggggaggagctggggcctggacaggtgtgtttggggagacacgtgccttgctttccagtgcctggactagggtgacacaagcaaggcactcacttctgggcacacgactaaaaaacaaaaaataaaacaactcagcaagcaagtgaaataatattggatgtgattatctttattaaaaactaaaaattattgcaaaataatttgacagtgaatacaaatcaaaatttcaaatacaggcaggctgtgcttaccactctcatgcctcagtgacctcaggagttgtcccttcctcctccctcccattcttgccctttgtttctgggaagggggattagggtacccaagttgggggccttataggaagtgggaggagaagagacccagttcttggagttggatcaccaaaacaattccaatccatcctcaggcaaaatgaggcctgtatcaggagtgttgctgggggcggtcgggggagctggagccacagccctggtcttcctctccttctgtgtcatcttcattgtgtgagcactgaccctagggagggagggagagtcctgggggagggcggactgggagcaggatccctgaagccagagctggaagggactgcatgggtcaagagcttggggcaagaatgagctcacgggtgcgtggcaagaatttcaagagcgcccttgtctgtggggctccacatctgtggtgaaccttgggccccaccacccaggaggcaggagcctctgttttcaacactggggtctctgggactggaccaccctcctcccacctcagttacccctccagcgccccaacaggaaatacagggcaggggttggtctgcccactgcaccccgatctgaccacactgaaaggctctctggtctcttcactcagagtgaggtcctgcaggaagaaatcggcaaggccagcagcggacgtgggagacataggcatgaaggatgcaaacaccatcaggggctcagcctctcaggtgagtgatatgggcgtctccacacccagcatccagctgggacatctcccacaggatggcctccaggatttctctgcttatcatggccaaaattatctcctcatctcctcctccttcccaccatccagcttctcctgcaggattccccatcttgctgactgcatgacagtccctcctacctactttctctcgggccaggcatggaggaggagttatctcctctctgtcctccctttcttctctatagctccacattcaccaaatcttgtccatttttcctccctaagaatggctagcattgctcccacccccaccaatcctaaactctctcaatgctgaggcctgaggatctctgtcttggacttcctcacctccctgcctcttgtgtcccctgccctgatgggaggaatcattcagaagccatcactgatcagtttctttgcatctggacagctgttcccacccccaacactgtctagagcagaagccagaaaatactatctggaaaggccagataggaaatatttttggctttctggcctacacagtctcattgcagctcctcaactctactgatgtagcaggaaatcagccgtagaccatgtgtaaatgattagctggctgtgtgccagtaaaactttatttataaaaacaagctgtgggtagaatttgtcccaagggctctagtttgacaagccctaacctagagaaaaagcccaaacttcataactgcagccctgcacattctcgtctcttaaacatctacctctctagcagggctggaattagtgtgagatgagtgaggtcctggcctagcatgcaaaatttaagaaggtgccaaaaatctcagtaattgtgatagttttaaaaaaaactcttattttaggtttgggggtacatgtgcaggtttgttacatacataaactctggtcagaggggtttgtggtacagattattttgtcacccaggtcctaagcctagtaccccacagttatttttttctgttcctctctctcctcccaccctccaccttcaagtgggccccagtgtctgttgttctcttctttgtgttcatgagttctcatcatttagctctcactgataagtgagaacatgcagtatttggttttctgttcctgtgttcgtttgctaaggataatggcctccagctccatccatgttcccacaaaagacataatctcattcttttttatggctgcacagtattccatggtgtatttgtaccatattttctttatccattctgtcatggatgggcatttaggttaatttcatatatttgctattgtgaatagtactacaatgaacatttgcttgtatgtgtctttatggtagaatgatttttattactctgagtataaaaccagtaatgtgattgctatgtcaaatgatagttctgcttttagctcttcaggaaattaccatactgctttccacagtggttgaactaatttacactcctgccgacagtataagtgttcccttttctctgcagccttgccagcctctgtgattttttttactttttaaaagtagccattctgactggtgtgagatgatatttcattgtggttctgatttgcgtttctctagtgatcagcgataatgagctttttctcatatgtctgttggccaaaaatgtctgttcatgtcctttgctcactttttaatggggttgtttttctcttgtaaatttgtttaagttccttatagatgctggatattagacctttgcctaatgcatagtttgcaagtattttctcccattccggttgtttactctgttgatggtttattttgctgtgcaggagctcttaagtttaattagatcccatttgtcaatttttgcttttgttgtgattgctttggcatctttgtcaggaaatctttgcctgtttatccagaacgatattgcctacattgtcttccagagtttttatagttttgagttttacatttaagtttttaacccatctcgagttgatttttatatgtggtataaggaagcagtcccactcaatcttctgcatgtggctagacagttatcccagcaccatttattgaatcaggagtcctttccccattgcttttttttgtcagctttgttgaagatcaaattgttgtaggtgtgtggctttatttctgggctctctattccgttccattggtctatgtgtctgtttttgtaccactaccatgctgttttggttactgtagacttgtaatatagtttaaatttgggtaacgtgatgcctccaggttttctttttgcttaggattgccttggctatttgggcacttttttggtttcatatgaattttaaaattgttttttctagttctgtgaagaatctcattggtagtttgatagaaatagcattgaatgtataaatttctttgggcagtatggccattttaatgattttgattctttttatccatgagcatagtatgtttttccatttgtgtcacctttgatttatttgagcagtgttttgtaattctcattgtagagttctttcacctccctggttagctgtatttctaaaaattttattctttttgtggcaattgtgaatgggattgtgttcctaatgtgactcttggcttggtagttcctgatgtatagaaatactagtgatttttctatattgattttgtatcctgaaactttgctgaagttatttatcatttaagaagcttttgggctgggactacgaggttttctagatatagaatcatgcatctgcaaagagggatagtttaaattcctctcttcctatttggatgctctttatttctttctcttgcctgattgctctggccagaatttccaatactacgttaaacaggagtggtgagagagggcatccttgtcttgtgctggctttcaaggggaatgctttcagcttttccatattcaatatgatgttggctctgcgttcaccatagatagctcttattattttgagatatgttcctttaatacctagtttactgagagtttttaacacgaagcgatgctgaattttatcaaaagccttttctgcatctattgagataatcatgtgtttttgtctttagttctgtttgtgtggtgaatcacatttattgatttgtgtatgttgaaccaacatgaagccgacttgatcatattggattaaccttctgatgtgctgatggattcagtttgcaagtattttgttgaggatttttgcatcaatgttcatcaaggatattggcccgaagttttcttcttttgttgtgtcttcgccagattttggtatcaggatgatactggcctcatagaatgagttagggaagagtcagtcttcctccgtatttgggaatagtttcagtaggaacagaaggaggctcagatctgacatttattgtgtgattgaagagccttccaggcagagggaggagcaaagcaaggcccaggcacaggaagaggaaaggagaggagccatgggacatctgtgtgattagacagagggaggcaggactgagagcaggaaatgactttggaggagttgagcctatgtgaattgtgtctgactgcacaggctactgtgagcatttggagagttttgagcagaaggacatgatcagacgagattgggtccgttcagggtggtatagctgtagaccagaagaacatgatcaactttcattttcatgggattcctctggccactgtgtgcagaagagaccgtgtgtgtggcaggggaaggagagagcataggaggtagacaggaggctggtgaacatcccaggcagaaggtggtgttggctggaaccaagatagcagcagtggtagacatgactgtctcccagatgaattctgcagtggaacctactgggatttgttaatgaattggaattagaatgtgagccacagaaagggagcaagaattacttccagatttttgccctgagcagtgggaagaatggaggtgccaatcattgaggctgagaagattgcagaagaaatggatttgggaaagaaaaggaggagttcagattgaataggttgagttttgtgtgtctttggacaagaacgcgggggtttgaattataccactggatcaaagactatagtcaggagaaaggagtgggctgggggtacagatttgggagtcattagcctattgatggcatgaagccaacacagtggataagatcacaaggcaaaggtaaagaagaaaagaacccggggctgctctgatatttaaggtcagggagacctgaagcaattggcaaagaggttgccaagaaggtgaggtggacccagaaaagcatgatgtcctatagttgagtcaagaaggccttctgtgtagggaaggtgagcagctgggtcctctgctgctgaaaagtccaggaaggagaagactgcaaggtggacatttagactcagccacttaagtggtagtcacagtgaccttgatagtagcagtgcttagacttggtatgtgtgtgaatattaatttgagtaatcaagagagaatctggcaagcaaaatcactgacagttccatggagcatcttctgcacaggggagcagcagggaagggctgcgatgaaggaggaccctcccaggcagcctctgtcactctctgctgtgtgagtctgtattagtttcctgtggctgctgtgacaaattaccatgcatttcctggcttccaacaacacacatggattaaagttctgaaggtcacaaccccaaaatgggtgtcactgggccaaaatcaaggcattggcaggcagggctggttccttctggaggctccaggggaggatgcaatttctcaccctttctggcttctagaggcacctgcattccttggctcaagtcccttcctctgtttgcaaggcaagtagcctggcatcttccaatctctctaagccctcctcctttcacttgtaaggactcctgtcattccactgggcccacccaaataatccaggataacctccccatgtcaatatccttaacctagctccatctgtaaagtccctttagcaatgtaacgtaacagattcacaggtttcaggggattagggtatggacattttggggagcagttatacttcttatcagaggatataatttctttgactgagttgtcctccccataccaccgaactgtgagcttcctaagagcaggtgccccatccaaatcaaggccctgtaattctctctcacttagcctcttcctgcccatcttataattcacacatagatattcgtttgtttgacagtcatttttgccaaattccctcaattaaaaagtgagtttcaggaggtcagggccaacacctactgtgtccaccacagtccatccagcacccggatcagggcttcacacacagagggccccagcaggactccaggctttggggtcagaaggaagggactggattgggtcccggcataacagggagtttgggtacgctactttcttcatggagttgttgcgggaagttaataagattaataaacaccaaacaagttgctcaataagtgttaaatattgcaggaaagtataaatgaaggagatttctataaaatgaacgtgggatagaggcaggaactcatgaagtttaattctatacagaggaatatatccgaaccaaccaaccgatcaaacaacttgtgactctccctgccttatcctatttccactgctctgctctgactctcttctctctctccattcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 113 - DNA, 16141 bp, Homo sapiens
tagggcctcctctaagtcttgagcccgcagttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacaggtaaggcacaggctccaggaaaggccacagggaaaggtcatgggggcggcagggaaaggctgggatggagcccctgccccaggagagggcttagggtgaagcgagttggctcagggcaggagctggaccagagcctgagctccccccagggctgcaccatggatcctctgacctgatcctgagtccccctctcttcaccagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctgtgagtgctgggccgggacgcctgggtccctgatggggtgagcgtcaagcctggacactgggtgctgggtcccggaatctgggctggtggtggggtcaggaggacactggctctgccttccctgtttatgcggctcctggggacagacagggccagtgtccccagccctcacagtgatgcgggtctccatgtctttctgtcccagacccgcctcagaacttgaccatgactgtcttccaaggagacggcacaggtaggatggagctccctccctggggctggaggagcagggccttcaggtcaggatggggctggcttattcctcaacctggactcactttggcaaacagggatgtccttgtgggtgaactcagggcccctctgtatccttaggccccaaggccacttgttcccatcctcccatcacctcccttggactcccccacacacccccccctcagcctcaaacaagaagagggtggcattcacacagcaggaccaggctttgaggctccttctcatgtatctcctgaatacatctccacccttatctgtttatttctgatagttctgatctaagtacttctggacaggtgataaatgtccatgggcaaaaattcaaattgcagagcaaaggctctcctccgatgcctgcccccctccccagaaccaaccactgtccatccaggctgccctgagtctcggtttgtacacctggaggatctcagaggtggtttgacgtccgtagtgagactgtccgcaccctcctctagggctgtgtgtgagtccactgcatggatggactctgattttgtggcatctcctaatggaagatcacggcactaatttcatcctacggcaggatagaacaatcttgtatctacttccacaggaatatctaagcctgtgggttaagttcctaaaagcaaaatgtagctacattatatgttctttcttattttgaaagataagcccaaactgttctcgatgaagcggggagaagtttacattcccagcagtgagtggtgaaagtgtgtgtttccagaacttcagtctatgtctgtgtgtcagttgctgtcatcagtctctttctgtatccttcctttttctccagatctatgtatctctctgaccctctgtctctttttctacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagtgagtgcaccagtatgctggggaggggctggagaggagaacacacctcctccacccttagtaactgctgagcgtggaccttcagagaggagctccgctctggtctgtgctcagctgtgaggtctggaacttccctgggacccacagcaccactgtcctcttcctgccagggaagggttgtggggtggggagagggcaggagtggatctcagaggggacaggatggggccggacaggtgtgtttagggagacaagcgcctttctttgcagggctgaactggagtcacacaactgagatacttgctttgagcatcaaattaaaaaaaagaaaaagcccagcaagtcagcaatcaaatgaaatcatattgcaatgcaataatcttttaaaaaaagtaaaaattgaatgcaaaacaaattcattaatggataaaatattaaaattgtgaaaaaaaaccccaaaaggaatggctggcacttgcacgcctcactggcctcaggaagagtctctccatgtcctgctctctctcattcctgttctttgtgtctggaaaggggaagtggaaatagaagtctaggaccctacaggaagtgggaggagaagagacccaattctctatgatatatcacaaaaataactcccatctgtcaacaggcaaagccacatcaggagtgactcagggggtggtcgggggagctggagccacagccctggtcttcctgtccttctgcgtcatcttcgttgtgtaagcatggaccctagagagggagggagggagagccctgggggaggacaggctggaagctggatccctgaagccagagctggagggacctggatgggtcaagagcttggggcaagaaggaggtcacaggtgcatggtgagaattccatgtgggcctgtgtttgaggagctttgagtctgtggcaaaccttggtacccactgtccaggagaagagagcctctgttctcaaccttggggtctctaagactggaccactgctttcccacctcagtcacccctgcagtcccttaataggaaacacatgggggtacctggtctgcccaccgcaccccaatctgaccacactgaaaggctctctggtctcttcactcagagtgaggtcctgcaggaagaaatcggcaaggccagcagcgggcgtgggagatacgggcatagaggatgcaaacgctgtcaggggttcagcctctcaggtgagtgatgtggactctccacagccagcatgtagcctggacacctcccacaggatgacccccaggactaatcagctgggcgtagccaaagttacctcctctctgttcttcctttcttctctgtagccccaaatcacaatgtttggttggtttcctcccctaagaacagcttttattgtctctgctccctatcctgacccttcattgctgaggcctgaggatctctgtcttttgttccctcacctgtctgcctgtctcctctcctttcctgcctggggggactgtccagaagacatcatcgtccagttcctctgcatttgaacagctgttcccccacccctcaataccgtttagagcagaagccagcaaatactatctgtcagggacagatagaaactattttcggcttcatgggccacacagtctcattgcagctcctcaaatctgctgttgtagcaagaaagaagccatataccctgtgtaaacaaatgaatatggctgtgtgccaataaaactattcacaaacataaagagtgggctggatatgactcagatactgtagtttgacaacccctgatctagagtaaaaatcccaaactctatagcctgcagcagtgcacattctgactttttttgtttttttttttttttgttgttgttgtttttgagacagagtcttgctctgtcgcccaggctggagtgcagtggtgcgatctctgctcactgcaacttccaccttccgggttcaagccattctcctgcctcagcctccggagtagctgggactacaggcgcctgccaccacgcccagctaatttttttgtatttttagtagagacggggtttcactgtgttagccaggatggtctcagtctcctgaccttgtgatctgcccaccttggcttcccgaagtgctgggattacaggcgtgagccactgtgaccggccacattctgaccttttaagcacctacctctccactagggcaagaacaagggtgaagtgagtgaggctgttgcctcaagtgcattttttcgtttgtttgtttttgttttttgagatggagtctcgctctgtcacccaggatgtagtgcagtggcacaatcttggcttactgcaacctctgcctcctaggttcaagcgattctcctgcctcagcctcctgagtagctgggattaaaggtgcacaccaccacacctggctaattttgtatttttagtagagacagggtttcaccatgttggccaggctggtctcaaactcctgacctcaggtgatccgcctacctcagcctcctgaagagctgggattacagatgtgagccaccgcgccccatcctcactgtctgctctgactcacttctctctcccatgtctcaggggcccctgactgaaccttgggcagaagacagtcccccagaccagcctcccccagcttctgcccgctcctcagtgggggaaggagagctccagtatgcatccctcagcttccagatggtgaagccttgggactcgcggggacaggaggccactgacaccgagtactcggagatcaagatccacagatgagaaactgcagagactcaccctgattgagggatcacagcccctccaggcaagggagaagtcagaggctgattcttgtagaattaacagccctcaacgtgatgagctatgataacactatgaattatgtgcagagtgaaaagcacacaggctttagagtcaaagtatctcaaacctgaatccacactgtgccctcccttttatttttttaactaaaagacagacaaattcctacctctctgtaccttggtttcctgctctgtaaaacaggaatgagaagccctacttgcaaggttgtggtcaccattccaggagtcacatcccgttagagctcctggcacaggtgtatgccgagcactgatggatcgctgtgctttgaacacaaaggtcctgctgggaacctctcctgattctggtggcaactagtacttatatgtctgtgtcacttgcctgcaaaatagcgattctgcaactttccaggaaataacctcagcctgcaaatcaggtctaggtagcatctggatcctgcccacctcttcagcctcatctgcccaccctgtgactgctaggccgccttactctctgcagtctacgtattgtgcacagtccagtgggaatctttaggacacactgagctctctccgcactgctcacagcccatccatggctcctggatcctgaacctcccatcacatcctcttcgtgacatcactctcccacttcagtccactcctccatcttcaccacttaacccactggtccctctggtcttttccaaatcatttgcaacatgccctgttggttcatacctcagtccttgcacactggggaccctcctcctagaacgccctcctcctgggccttcttctgtctctgtctttgaaaatggagttcaaggattggacttctgggttgagctgagggagagagtgaagcagcagctcatgatctccctcctctaaagccaaacccagggaatgagaaacgtttccaaaggggcacaggatcatctggcaaattaaacaacatgatccaaaaaaatttacctacatgcagcacccgaacgaggaaagggacatctcacaacaatcactttatgcagtagccctgataggaagaaatcaaaggactggaggaagcactaaaacttccctaaatctagactcttgcccatttacggcagcatcaaaaaaccgtaaagtaccaaggaacaattttttaaaaatcatggccgggcacagtgtctcacgcctgtaattccagcactttgggaggccgaggtgggcagatcacgaggtcaggagatcgagaccatcctggctaacatggtgaaaccctgtctctactaaaaatacaaaaattagccgggcgtggtggcgggtgcctgtagtcccagctactcgggaggctgaggcaggagaatggcgtgaacccgggtggtggagcttgcagtgagctgagatcgtgccactgcactccagcctgggagacagagcgagactccgtctcaaaaaaaataaataaataaataaataaataagtaaaaaatcatatccgagctgggcgtggtggctcacgcctgtcatcccaacactttgggaggctgaggagggcaaatcacttcaggtcaggggttcaagaccagcctggccaacatggtgaaaccccatgtctactaaaaatacaaaaattagccaggcgaggtggcgtatgcctgtagtccttgctacttgggaggctgaggcaggagaattgcttgaacccgggaggcggaggttgcagtgagctgagattgtgccattgcactctagcctgggcgacagagcaagagtctgtgtcaaaaaaaaaaaaaaaaaatcctatgctatggtttggatatggtttgtttggccctgccaagcctcctgttgatatttgatgcccagtgttggcggtggggccaaatgggaggtgttcaggtcccgggattggatccctcatgaatggcttggtgctgtcttcaaggtaatgagagagttctcactctgttacttcctgtgagagtttctccaagagctgggtgttaaaaagacattggcacctcccctccccagcccgtgcttcctctcttgccgtattgtctgcacatgcagacttccttttgccttccaccatgagtggaagcttcctgagaccctcaccagaagcaaaggctggtgccaagcattttctatgtggtgcagaactgtgagccaaataaactgtggggggtgcacggcaacatattcaagcttatgtacaaggcatttgaggtcgaggcatggaaaaatactgaggcaccgtgtgcgtgttgtttgtgcatgagattgaaactccttgaccctgaaaacagggcaaggaacggaatgtgtgataaggagcgcggaaagcagcctcctgagactgtagtctgagtgtttttaccaggccatatgtgtctcatgacccgaccgcaaaaggccatctggtggacattttggtttaacaaaccctttcgagaaacacttggcggacggattctggggcggcactctttcagagatgctgctgccgccgcatcccgctcagctggaattgtctgagtgcttcattcttggcgttcactgcagctacaagctgtataaacctcttttctttataaattacccagcctcagatattactctatagcaacacaaatgaactaagataacacggaatgcttctgtactgatgaatatagaacatttttgagagacttaaggaaggcccaaatgaaggaagaaatatatcacgttcatggattagaaggcaaaaatggttaaaatgtcagttgtctgcatattgatttaggtaatccctgtcaaaattcctatatatatataaaatatatgtatatgtgtatatgtatgtacataagtatagatgagtgtatatgtatgtatattgtaaatataagtttatatatatacatatatagttataaattgataagttggttctgaaatttatataaacacataaaaacctagaataaccaaatcattgtgataagaaacacatttagagaaggcagactttaacactagagtaatacagagagtgtggtgtggactagagtacagtctacaaatggacccacacatatacagtcaactgaatagcatcaagtctattcaattgggacaggaaagacttttaataaatgttggtaggtggtcgggcgcggtggctcacacctgtaatcccagcactttgggaggctgaggtgggtggatcacttgaggtcaggagttcaagaccagcctggataacatggtgaaacaccatctctaccaaaaatacaaaaaaaaaaaaaaaaaattagctgggtgtggtggcaggcaactgtaatcccaggtactagggaggctgaagcagaattgcttgaacccaggaggcagaggttgcagtgagccaagattgtgccactgtactccagcctggcgacagagtgagaccccatcttgaaaataaataaataaataaaaaataaatgttagcggaacaagtgaaattagggttggtaaaaacgagtgttgagctgtttctcacatcacacgcaaaaaattagcctgaagcgaatcataaacctaaaagtaaaagcggagactataatgtttgtacaactgtgctgtttgatatggtaaccactagccacatgtggctactgagcacttgaaatgtcctacatttagtgagaaaataatataaaaatctaagtaattaatatttaaaattgattacatgtttccatgtaacggcataatactcatcaatatataataacaatatataatacatgcaatagcttgaataaattttgaaaacatcttgagtcaaagaagccagatgcaaaagaatacatgctctgtagtttcacttatatgaagttcaagaacaggccaaactaatctacaaagacagaaattcataacagtgactgcctcaggttgggagtgggatttggggattaacgtgaatggcacacaggggaactttctggggtcctgggaattttatttctttcttttctttttttttttttttttttttttttttgagaaggagtctagctctgttgccgggctggagtgcagtggctcactgcaacctccgcctccagggttcaagcgattctcctgcctcagcctcctgagtagctgggattacaggcacgggccaccatgcccagctaatttttgtatttttaatagagatgaccaccatgttggccaagaccaccatgttggccaggatggtcttgatctcttgaccctgtgatccaaccacctctgcatcccaaagtgctgggattacaggcgtgagccactgcgcccagccagtcctaggaatagtctatgtcttaactgggatagtaattatgtggttatgaatcaaaacacattgaatcacgcaaataaaatctatgtattttactgtatgtaaatttacctttcatgaaagagaaattaaaaactcttaaatgatgaaagcttttggttccctcttttttattagactagctagtgatctatcaatcttatttgttctttcaaagaaccaactttggggtatactgatcttttgtaggaattttcgtatctcaattttattcatttcagctctgattttggttatttgttttattctgctagctttggggttgacttgctcttgtttttctaattcctctaggtgtaatgttaagttgctaatttgggatctttctaactttttgatatgggtattctggtacattgcatctttactttcctggatgctaggaccaaactggactagagtaaattacgtggttccttctgtcccaaagaaagatgtatttttaactcaggagctacatcagccccatctggctacattaagcatcccagtctcctctgcgtctcatgctggactctatgcaaaagggacagccagcgaaagcattattgatatgtcaatattgagatgtgagaatttgatcctgtcattatgttgttagctggttgttatgtagacgtgattgtatagttgcttcataatgtcagtgggttatacacttaaccacttaacaccactttctgtggtgtcatgtaacattctttcacttctgtgtttggcactcacttaaggacctcttataagtcaggtccggtggtaatgaatttttttcagtttttgtttgtctgaaagggattttatttatccttcgtttatgaagcttagtttggcagggtatgaaaatcttggctgaaatttgttttctttaagaatgctgaatataggccccgaatgtctttggcttatatgatttctgctaaaagctcttctgttagcctgatggggttccctttgtacatgacctgcctcttccttttagctgcattgaatattttttctttcatgtgaaccttagaaaatctaatgactctgtgtctgggggatggtaatcttgtacagtatcttcctggggttctctgaatttcctgaatttatatgtcaacctctctagcaaggttggggaaatttttgtggatgatatcctcaaatatgttttataagttgctgcgtctctctttttccaggattccagtgggccgtaggtttggtctctttatataatcccatatttgttggagggttttgtcattttttttaattctttttttaaaaatttttgtctgattgggttgattcagagaactggtctttgagctctgagattcttttctcagcttaatctattctgatgttaatacttccgcttgtattatgaaatttttgcagtttttcagctctaacagatcagtttgattctctcttaaaatgattattttatctttcagatcttgaatcattttattggatttcctacattccttggactgggtttcgagtttctcctgaatctccgtgatctttgttgccatccagattctgaattctatgtctatcatttcagtcatttcagactcattaagaacattgctggggagatagtgtggtcacttgaaggtaaaatactctggcttttggatgtgtcagatttctttcactggttcttcctcatctgtgtgggctgatgttcctttaatctttgaagttgctgttctttggatagggctctttgcttttatattctctgatgcccttgagggtttcacagtggtataacttgggcttagacaactgcatttgtttctggatgatttcaaggggcccaggctcaactcagcactcctgagctgcatgctctaactacagggacctgggacctggcccatggcttttttttttttttttcctggcccttcaaggttaagcacctcctatgctggaatggccaaggtgttccgggtccactggcaacaacgctccaataggggttgctgacaaagcattttggcagggtggccatgggtgatgggagttcctgcacgtggtgtgcatcagctgcagggtggccgtgggtcttgcaaatctgcttgctaatgttatgcctaagatcacgttataaaagactaacttgtgcctcattctctctctcgctgtctcttgctttctcactttgatgaagctggaggccatgttgtgagctacctatggaaaagcccatggtttcataacaaagctgattgagtagcaaatgttattttccaggcaaaaaaattaagtggtaagttcttctgaatatgcaaggcagaaataattccagtgtttcataaactctttcaagtatgaaagacatatcagccggggtgactctggggagttttttgctttctctgttcctcactgagatctacatggaagggaagggaaaaacactcgtctctaaaaacctcccacctctggcacccataagtctgaagttgcacttatgtgaggaactaccactttgcccctacccactggcttcctgttggggttactcttgtttttccaagccagttcttcccacgccgagggaacttatgatgagacagccccaggaaagtgcctgacacgtattccctgggctgccccttcccttccacatgcttcctgagtgagcacgtccaccttgtggctcagctgtgagccctgccctgatgtctcccccactttctgccccttgagcctcttcttggacatggtgcctccatcccccacccccgactcttcagttatcccagtcaggacccaggacttattccagttgcctcctgttttcaaccaccccatgcatgagtcaggggttcctgtaaacttcacttccccaaaaatgtctgccatcatgcccttcctcctccctccattccctgtctcctcccctctatctgcatggccaggcccttttcggtcttgacgattgctccatttcccacccaacatcccggtctgcagcctctcgcctccatgctgtggccctcgcagcacaagccctgaaaaattttcctgcatccagagctgacactgcctcttccctgctcagggccctctctggttccctggaaccctcagtccaagctgttcagctgatcatgtcccagcacctccaatttccccctggaagaccccacacatatttgcagggcccttcatctgcccggctgtctcatggcctgtgctttttcccctccacctgaggtgcccttagccacctgttaatatgaccaactcccccactagtctcagctcagcctctttccctgcggggtctttcagctttttgaactcctggatttgcattcgtgagtatgtgtcacacagtcaggtgtctcctctttctgtttttgtggggttgtgggagagacagcctctcagctccaccctccccgctctcactgttttcctcactcaaccctgaagaccctgagcaatggcacctcgcttcctgtcctggagggtcagtccctgggcctggtctgtgtgactgacagcaactcccccgcctcactgagctggtctcaggagggaagaacactgaatctctcccagctctcagcaactgggatcctggagctgccccagaaagggactggaggtgaaggcgacctcacctgtgaggctcagcacccactgggctcccagcacatttccctgagcctctctgtgcagagggagctgctggacgggtgctggggcaggcagcctggtcaggtgttgggctgtgagaggggcctagacctaggaacaaaacctcaccctcttctccccactcccaggaagtccctctgggtgcagatgtgcgagtgaagatcaggagggctcccagcccctggttctcacctaatcaaggggcgctcatgggcactggtttttccttcacccgtggcctcacctggggctactactccaggtgagcagggctgctcttttctagggaagccgagggattggcccccgagttccagatggggctgagctgtcctgtcccgcctgagttagaattgaagtggccgatgctaatctgaggccggtgttggctctacaggtgtggaggcccccaggggagcagggctgagaggcctgactgagcccctcctgctcaagacagaactcagatgaggacacccagccctgcgggacagatgcaggacatcactgtcagccatggctcagcccttctgaccactgagatgctgcaacttcccctcctgggagggagcgattgggcaaacacttaccctttgctggaaatctcaaggcacagcacgggtgctcacaatctgaatacagaacgaatgaatgaatgaatgaatgaatgaatgaaatgtctttccttatctcatgtgagagacttgacagttctttcactctccaagtaacatcagcttcccctgtcccagcccagtctgtcctgggcagacaagattaattaagtggctcctgggcagacattggtgcaggagacagggcccaggagacctgtgtgatttgggcaattcgctttctatctctgtccattcatgctgctacaacaaaataccataaactggccagtttataaacaacagaaattcatttctcacagttctggaggctgagaagtccaagaccaaggtgccagcaggtttggtgtctggagacagtttgcttcctcatagatggtgccttttccttatgttctcatgtggtggaagggctgtgcaaattcccctgggtctctcagatgaggggactaatcccattagactaatcccagagtcctcatagcctaatcgcctcccaaatcattataccttctaatactatcacatggggattcaaatttcaacaaatgaattttgaggtgacatattcagaccatagcacttgtcactgtggaccttgatgtcttcctctccgaactgtggaagtgggagtagagggcttgtcagctcccctgggtcatatgtggttcacaagttcctcctttctacagattctgtggcttccttaagtctctccttcccatttttttttctgattttaattgcaaactggggactgtgggaaagagatgggccatggtctagcccttctgaggcaggaggagcatagaccaatggggcaggagcatagcaaagagaattaaaagttggataaagggcagaataagtaaaagcagagagcagaagcaaggtgaggggacgggtgagcaagaagcaagaggcagaagttgagcagccaaaacaaaaagtaagatagagaagtgagcaaggacacccgtggccagcaggatctggaccaaaccagtaaggggcagttcttcagagctatgcatgtgcattagagagaaaaagtatccttaacatgaccctgtatgataatcagctcattaaagttcatgcatatggactgcatattatccatgtacttaaaattatgggatgggtcaaagtaactaagcaacatacttaaccatcaaaaaggcaggcactggccaggcgcggtggctcacgcctgtaatcccagcactttgggaggccaaggtgggcggatcacttgaggtcaggaattcaggaccagcctggccaacctggtgaaaccccatctctactaaaaatacaaaaattagccaggcatggtggcgggcgcctgtagtcccagctaccagggaggcagaggcagaagaatcgcttcaacccaaaaggttgaggttgcagtgagccaagattgtgccactgcactcaagcttgggtgacttcgtccccacctcaccaccaccccttccccccgaaaaaaggcagacactggatagagatttggcagccttgggaagcgaagaaaaacaaaaaaacaaacaaacaaacataaaaagacccaaagtaatgctgatctcacctcatagagatcagttcgctctccctctccaagagtgtgatactgtgcttaataaactgctgcttcttgctttgctgtctgtgtgtgtctcatccaattctttgtttaagacaccaagagcctggaactgcatggcaccatccggtaacacttctgcccactgagatactgcaaatatccttatggggagagagtggctgggcaaggaggaggcgcccaggaggcagattggtctgcaggatgagatactagctgcaaatgcagggattggaggtgagggcggggagtggcttcggacgcccaaacccagcatcttcctctctcaatcgttacagccaaatgatctctaggttatggacaattaggggacagtgtgggctgagcagatcaatgcagttgtatggaagaaaacagactgggattttctatgtatacaacatcttcaggaaaacctacgtgaagttagaattttcaaggcagcatgtgccgatgataaaactacatagaacagcaggaagactattatcattaaagtgaggctaggggctccttcaggagggagcgggggcatggccaataggaaaggggaatgtaagg

SEQ ID NO: 114 - DNA, 49055 bp, Homo sapiens
acttggacgcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtgagtccccgccgcggtccctggctggggaagagcgtgcctggcgcctggagagggcagggagagagggggacacggcgggggtgcgtggcccgggtcgcctgcggccgggcatgtccgggcaagacgcaccagtcgtcggagtcgggggaagagatgggtccccgggttgggcaggagcgacctgggccgccagggaacagagcgcgcgctccacttggtgtaaattcccgaatccagtgggggagggcgacaaggagggaattcccgagtaagctgcgtgaagccacggagaggtcgtcggactttgattttgttttctttccttactttctgtttctttctctttttctctttcttcctttctttccctcccttccttcctcgctcagttcctgccttaatttctttttcttttgcgccttcgaatgaattcctaaaggcgctcattgcagatcgctttgaacctgcggccggcgaagaactcccctgtggtcgctgcggcccagtggttccgttccgtgcgcgggagtcgtcgcgggcgcagctggagaggccccttcccctccttagcggctgcgcccctacgcgtgcggggccgctcatcgccaatgccattgtttggggttccttgggaaaacgagatttaggagaagggagttgtggcacttggggcctgacctgcttgataatagcagctgcattttggcctgggaagagcctttcttgccacctcttggcaagtatccgtgataatggggaagggacaaagagtcggctttgtagggaacagcatggtgtgctcagcgcctggaactgcgcttggggccaggagaggttctgaatcatcacattttacagaggaagagaccgcagctcagagtggggaagtgtgtgggcctagacctaactcaagactgtacagaggggctggaagggagaggaggaacagtgaaaggaaggtcaagagaatgctggtgttgacctagaagaatgtcagtgtgaagcattggagtttcatgggatattgttacacacctcatgttttcactgtttccgccccacaccacagtatgtccttggtctcacctctgagtggagggaggacctaactgtcctagtgaggagagtgtacaggggcctctgcctccccctcctgctgtggtttctgtgggcctaggtccccagggcatcttgcctctctttgggtggtggatctttggtctctggctgcttttaaagatttttcttagcactggtttgcagtgatttggtttgtttgctctgttgtggggttttttttttatctctataaagaattttttggatttttggctttagactttcatgttctttctacttggaagatttttctgtaaagaaagccacaactgggttgtgttgaatttcttggatttggggttttagagtttatgttctccttggagacttttctgtaaagaaagccacaacagccgggtctggtagctcatgcctgtaatcccagcactttgggaggccgaggcgggcagatcacatgaggtcagggattcgagaccagcctgaccaacatggtgaaaccccgtctctactaaaaatacaaaattagctgggtgtggtggtgggcacctgcaatcccagctacttgggaggttgaggcaggagaatcacttgaacctgggaggcagaagttgcagtgagcagagatggcgccactgcactccagcctgggagacaagagcaagactccaactcaaaaaaaagaaagaaagaaagccacaacagagttatgttgaatttcttggatttggggttttagagtttatgtttttgtttgtttgtttgtttgttttgagatggagtcttgcctctgtcgcctaggctggagtgcagtggtgggatctcagctcactgcaacctctgcctcctgggttcacgccattctcctgcctcagcatcccgtgtagctgggactacaggcatgcaccaccacgcccagcgaactttttgtatttttagtagagacggggtttcaccgtgttagccaggatggtctggctcgtgatctgcccgcctcagcctcccaaaatgctgggattacaggggtgagccaccacgcccagccgagtttatgttctacttggaagattttcagccattatttcttcaaatactctgtctcttctggtgactgagatcttattatatttacgttagaatgttagattttgtatcagagctaacttagtatctgttcttttttttcccccatcattttctatgtttcactttggacatttccctgtgagggctcttcaagttcattgatctgcttctgcagaatctaacctgctgttaatctcatctactgtatatcagatatatattttttgaactttagaagttctcttttggcatttttaatatcttccatctatttcctggtcatctttgtgtttttcttttttgagacagggtcttactctgtcacccaggctggagtgcagtggcacagtcagagttcactgcagcctcaacctcttgggctcaagtgatcctcccacctcggcctcccaagtagctgggaccacaggcacttgcaaccacacctggctaatttttgtatttttagtagagacggggtttcaccatgttgcccaggctggtctcaaactcctgcgctcaaggaatcctcccaccttgtcctcccaaagtattgggattacaggcctgagccaccgtgcgcaacctatgattttggtggtggtgttttttgtttttctgttttttaaatattcttgagtatatttgtaagctttagatgacctgttttaagttatttaatctatcaacaccattatatctgttattacggccactgtttctgttgattacattttttttcctgcccatagggactttttttttcatgcatagtaatttcttattgcttgacattgtgaattttgctttcttgggtaccgaacatcactgtgttctttcaaagtctattgggcattattctggtcacagaaaactgaggatcagtttgctcctctgatactagcttttatctacatataactatataccttgtgttcagttgccttattcaggggctcatttagttaactactaaagttatagtggttgacttctgatggtaactcgccagcaccctggcatgcgttctgtccactgtgggaaggggaacatgcagatctcccagccctgagtggtccacaatctagtctctccttccctgggtggcttcttctcaggcacctagagtcagtctcagcagacactggacatgtcttctgcaaggatccagagtcctccaggcagctgcttctcccagtctctgccctgcacttggcctctgggagttcctgcctgtggttctcaacagagactacagagctctacagggtcctctgcccctgctgtagctggaggctgtccttacgcagtgagctgaggccacagctagtctcactgcatgtgcttggcggcggggacaggagtgattcattcatcaggtagaggaggaaccctttactctgggaaaatctgtgcctgggttggggaaggacaaatgagccctgtgtgaatactgactactccctggagcccacagtctggtggagcaggtgacagcagggacctaaataactatcaggaagcatgaggtcccaccactgtcacctcccccacctccagagtggctgtgctggctccagagatgtcatccctccatatttgactgacagagggaggctgtgcagtcccaaggctccaggtcatggtagtttggccaggataatatggtttgcttaaaatcaacattgagggtaatgatcgtactaatcagagcatgtgtttaaagttctgtgttttaagcactttccatacatattaacactttcagttcacacaacaacctatgcaggaactgtgattatcctgggcagttttaaggatgtgggtgactcagagaggaaagaagaggttactcgggttaatttttgacgagaaatattagcaggttttatgctcaaacttggtgtaaagcaaggagcctgaatcacaggtgggtgagtcacaagacagggaaaccccgccaatggctcatgtccgggaggaggcagggtccctagaattcaatgggacaagaactgaaataagccaaacccctgacctcccttcttcttgttttccttctctctcttaaccatgcccatggacacccccatgagcccatttctgtggcccaacacagctgtgcatctctggccacacgcccattctccctcaatcagagaggcccacggacggcacagcctcgtcctgcacagcagaaagagtgaatggtgatgaatggatctatattatttcaactctcctacattttgtaatcatattacaatattaattcagcagtacctctcttgtttttactcccctcccccattacactggattcctgtctgtctgggattctgtctgtgtgcactctttcctctatgtccactactgtccctgccaccgatggcatttgtcacctctgcctgggcagcccctccagactctttgcaagttcatggactttggggttaatgatggctgtgcctcagctcctgtgaatggaaactgtgctaaggaaaggaagggccgtgccatgttcccgatactccacggctccttgcatatgcggtcgccaggcgcctacatgccttccatgaatgaatgaatgagtaacgtggattctaggaagctgcactaacccagacgttgtgtcctcagcctgctcatagagtgtgttaaacgtgagaggtggggagtgtggcaggcaggctgaggacagaacagaggatctgaatagagtacggaggatcacccaagtccagagtcaccaaggccattgtcaagttttccccggggacatccctcatcagatccacccattaaagatcattgttcacccagtggagagtggactaggtgggtgcactcaggtgtggcctggacagcattcgggatgggtcctagtggttagggtgagggtcaggttgcattatcgtgaaggaggcaagtggcagctgaggcagatctgagggaaatgatgataacgcaggccggtgatgcaatgggtttggtaagaagaggaaagaggtttgtggtggattctagtgtttctaatctgagacttgggtgaggtcattaccaaataagaaagagtaaatgggcataaatggctttaagaattaggaacctgaatgtgctattggagacagtatgggcacgtcattgctcatagacctgcagtacacaaaatgctaaaagatttcaatctgaatagagatgaaatgaaatggaaacatggatttttttttttttttttgagacagtttcactgttgctgcccaggctggagtgcaatggcgcaatctcggctcactgcaacctctgcctcctgggttcaagcgattctcctgcctcagcctcctgaacagctgggattacaggcgcttgccaccacacccagctaatttttgtatttttagtagagaccgggtttcaccatgttggccaggccagtctcaaactactgacctcaggagatccaccgccttggcctcccaaagtgctgggattacaggcatgagccaccttgcctggctgggaacatggatcttaaggaaagaaggaagatcatcaggaatagaaatatgaatgcacatataaagaatgattatttcctcttaatttcttgaaaatattcactatcaagtaatataacactttgtagggtttgtaacatatgaacatgcctgagacaactatagcagaaagaatgagtagtggagatgaatcaatctgtattatttcaagtctcctacattttataatattaccatattaattctgccatacaactcagtaatgaaaaggaatggagtactgatgcatatgaaaatatgaccgaatttcaaaataattatgctgagttaaagaaaccagacagaaaagcatatatagtatctgattccatctatgatatttatagccagaaatggtttaattaaaaaagaagaaggatcttaaatcaacgagctaagtttacaaatgtaggaattagaaaaagaatgaaccaaacctagagttagcattataaaggaaataattattagaagagaaataaataaaacagagaatagaaaaacagtagaggccggatgtgatggctcacgcctataatcccagcactttgcgaggccaagacaggaggattgcttgaagccaggagtttgagaccagcctggatatggcaaaaccctgtctctacaaaaaatataaaaagcagcctggcccgggggagcacacctgtgatcccagttactcgggaggctgaggtgggaggatcacttgagccccggagatgtaggttgcagtgagccaagatcacatcactgcactccagcctgggcaacagagtgagactctgtctcaaagaaagaaagaaaaagaaaaaagaaaaaccatagagaaaatccacaaaaccaacattgattcttcaatactattaattaaactgacagaattcactagtgaattctaacaagcttttaatgaagagctaataccactacttctcaaactctttcaaaaacttgaagagaagggaacctttcttgactctttctgtaaggccagcattgctctgatacccaagcagataaagatattacaagaaaataaagctatatcccagtatccctaactgatgcaaaaatcttcaacaaaatactatcagagagaattcaacagtaccttagatggattatacaccatgaccaagttggatttatttccggaatgcaagaatgtttgaacaaatgaaaactgaacaatgtaatacattgcattaatagaatgaagggggaaaaagacacatgatcatctgagttgatacagggaaagcctctgataaaattcaaagccctttcatgatgaaaacacccagcaaactaagaatagaagaaaacttccacaacatcataaaagccatgtaagaaaaccccacagctaacatcatactcagtgttgaaagacggaaagcttttcctttaagattaagaacaacataaggatatctacccacctttgccactcagcatagtactggaagttctagccaaaacaggcaagaaaaagaaataagagcatctggactgtaaaggaaaaagtaaaataatctgtgttttcagatgatatgatcttactggtaaaaaatccaaaagatttcacaaaaaattaaactgccaaaaataaaataatattaaatttttaaaattttgaaatttattgttgttcagtaaaagacagtacagattgcaatctgggagatttcaaaccaagtggtaagaaacttgccttacagcaggtatagtacaggctataaaggaggatgtattttgacaatttcatgattgacttataaatttatattctttttaaaggcaatcagagctgtttaagctgatttttctatagctgcttgatttaacttcactgaaccatattatgtcatgatgaaggtgtaaaacttatattttgtgggattttttatgattatagctaatgtttcagggatatcaggatgtcttaagttttggctacatggttatgggtaattgccgtggggtatatctaaactgtgtttttaatttttatttagtagtactaaaatgaattcatcaaagaagcggaatacaaaatcaactggaaaagtcaattgcatttctatacactaccaatgaacaattcaaaaaaagaaattaggaaaaaatccatttacaatagtatcaaaaataataaaataggagtaaactcaccaaggaggtggaagactagtacaatgaaaactataaaacattactgaaagtaattaaagaatacaaaaataaatggaaagatatgccatgattatgaattataagactaattatgtcaacatttcctaaagtgatctatacattcaatgtaatctctatcaaaatcccaaggacatttttgcagaaatgaaaaaatgtatcctaaaattcatatggaatttctagggaccagaatatccaaaacaatcttgaaaatgaataaaaatgtagtaggattcacacttcctgattttcaaaacttcctacaaagctgcagtaatcaaaacaggatggtactgacataaaagcagataaatcgatcagtggaatagaatagaggagccagaaataaacactcacatatatggccaaattatttttcacaaggatgccaagactgttgaatggaggaaagggccgtcttttcaatgaagggggctaggagaaccggatatccacattcaaaagaatgaagtgaaccttagcctaacattgtatttaaaaaatagctaaaaacaaataaaagatgtaaatgtaagtgctaaagctatagaactcttgaaagaaaatataggataaaaattctgtgacattggatttggcaataatttcttggatgtgacaccatggacataggcaacaaaagaaaaaataaacattttggacttcttgaaaatcagtaactcttgtgaatcaaaagatactattaactggataaaaaggcaaaacccacagaatgagagaaaatattttaagttatatatctgataagggcttaatatctaaaatatataaagaattcctacgatctaacaaaacaaaaacaacccagttaaaaatgggcaactgatttttataaacatttctccaaagcaaatatacaaatggtcaataagtatatgaaaagatactttaatcactaatcattagggaactgctggtcaaaacgacagagataccatcctatacccatcaggatgactattataaaaaacacacacaggccgggtgcggtggctcatgcctgtaatccccacactttgggaggccaaggcaggcggatcacgaggtcaggagattgagaccatcctggctaacatggtgagaccccgtctccactaaaaaaaaaatacaaaaaaattagcccggcgtggtggcaggcgcctgtagtcccagctacttgggaggatgaggcaggagaatggcgtgaacccaggaggcggagcttgcagtgagctgagatggcaccactgcactccagcctgggcgacagaacgagactctgtctcaaaaaacaaaaacaacacacacacacaataagcattagcaaatttgtagagaagttggaaccctcgtgccctgttaatgggaatgtaaaatggtgcagccactatggaaaacagtatgatagttcctcaaaagtaaaaacaggattagcagatgatccatcattcccacttctaggtatacgtccaaaagaattgaaagcatggtttcaaacagatatttgtacacccacgtttatagcagtattattcacaatagccaaaaagtggaagaaactcaagttggacagatcaatagataatgtggtatattcatacaatggagtattactcagccttgaaaaggaaggaaatactggcacatgctacacaatggatgaacattaaagacatgctcagtaaaatgccattcataaaaggacaaatgaaataggattccacttgaggtacctaatgtagtcaaattcataaaaaccaacagtagaatgttggatgccagcggttgtaaggagggaagaatgggaagatgaaataacttctgaggatggatagttgtgattattgcacaacaacattaataaatgtagtgtcactgaactatgtattttaaaagattaaaagataagtttcatgttatatataatttaccttagttttagatttaaaaaaacagcatttattttagtcactataacaattacacataaaatggaaatattgttgatttaaaaagccaatgcacaagctgggcacggcggctcacacctgtaatcccagcactttgggagggtgaagcgagcagatcacctgagattgggagttcaagatcaccctaaccaacacggagaaaccccatctctactaataatacaaaattagctgggcattgtgatgcatgcctgtagtcccagctactcgggaagctgaggcaggagaatcgcttgaacctgggaggcagaggttgtggtgagccgagattgtgccatggcactccagcctgggcaacaagagtgaaaatccatctgaaaaaaaaaaagccaatacacaattaaaatgggattctaaaacatactcaattaacattaaatatacaggtaagaaggaacaggtaaaaaatagaatggacaaaaattggtaaaattatagaactattttggctatagtaataattacactaactgtaaatccaccaaacactataactcaaaggtagatatggttagaaggatgaaaaagcaagacttaactacataatgtttataagagatggaatttttttttgagacagagtcttggtctattacccaggctggagtgcagtggcgagatgtcagctcactgaaacctcctcctcctgggttcaagcgattctcctgcctcagcctcccaagtagctgggattacaggcatgcatcaccatgcccggctaatttttgtatttttagtagagatggggtttcaccatgttggccagtctggtctcgaactcctgacctcaggtgatctgcccgcctcggcctccccaagtgctgggattacaggcatgaaccattgtgcccagccaagagatggaatttaaaagcaaaatgcaggtatagtaggagcaaatggatgaaaatagatataccattcaagtaataagcctaagaaaactgctgtggctatcttaatatcatatgaggtggattttaaggtaaagaatattataagacatgaaaagggacctttgtagtgttaagagagttaattcatctggtagacataataatcataagatatatgtcctcaataatagagcttcaaaataaatgaagcaaaaatttacccagcactttgggaggccaaggtaggcggattcacctgaggtcaggagttcaagaccagcttagccaaaatagagaaacttgtctctactaaaaatacaaaaatcagccaggtgtggtgtcatacacctgtaatcccagctactggggaggctaaggtaggagaatcacttgaacccaggaggcggaggttgcagtgagccgagatcatgccacagcactctagcctgggcaacagagtgagactccaatctcaaaaaaaaaaaaaaaaaaaattacagaattcagaggaaattataatacactgttctaagcaattaatggaatggtttgacaaaaatattagtaaagtcataaaagggccaggcgcggtggctcacgcctgtaatcccagcactttgggaggctgaggcaggtggatcacaaggtcaggagattgagaccatcctggctaacacagtgaaaccccatctctactgaaaatacaaaaatgagccgggcatggtgggtggtggtgggctcctgtagtcccagctactcgggaggctgaggcaggagaatggcatgaacctgggacgcagagcttgcagtgagccaagattgcaccactgcactccatccagcctgggcaacagagtgagactccgtctcaaaaaaaaaaaaaaaaagtcataaaagatctgaaccaccttgacttaattgacatttataagaggacacatgcatctactgaaaactcattctcttctagtgaagatggtaccctcactcattttatagcccatattctgggctataaaataagtctaagtaaagtctcttttaaaaaagagaactcatatatgttctctgatctcaatgaaattcaattggaaatagataacaatgtctagaaagacctccaaatttggatgctaagcaacacacttataaataatccatggttcaaaggagaaattaaaagctaatacaaaaatatttcaaaatataatgaaggtttaatgcatcaaaacttgtgggaagctattaatatggttctcttttttttttttttgagatggagtcttgctctgttgcccaggctagaatgcagtggcacaatcttggctcattgtaacctccacctccctggttcaagggatcctcctgcctcagcctcctgagtagctgggattacaggcatgccccaccatgcccggctaatttttgtatttttagtagagacagggtttcaccatgttggtcaggctggtctcaaactcctgccctcaaatgatcgcccgcctcggcctcccaaaatgctgggattacaggcgtgagccacacttaacttcacatttcataattcctgagtcttatcaggcaaaaacaagtcctgaaaaaacaaagtaaatctacttattatagtagggcagataatacaaagttgggcattaaggtaatatcgtatttatagttttaaagctgatgactctataaggacagtatgtgcttcagtgaaattataaacatgaaaactctgctttcagttcttttggatacatacccagaagtgggattgctggatcatctggtaattctacttttaattttttgaggaacaaccatactgttcctggaccaaactgagggtcgggctgctatttcttgccacccattaatgagatgccaatgaactgggaagaaagagtttttatttctgtagctggttacagggagaaggcctggaaattatcgccagaccaactcaaaattacaaagtgtttcagagcttatatcctttctaacctatatgtctacatgtaagtgtgcattcatctaaagacataagtgattaacttcttttaatctataactaaggtctgagtcctgaagaccttcctgtggagcctcagtaaatttacttaatctaaatgggtccaggtgctggggtgattaccctgctaaaccatggaggtttggggagttccttcaaacctccaatacccttgtttgtggaggcctggggagtttcttcaaaacccccaataaaacttgtttaatcctaaatgggtcctgttatgaattcctccattattttgtcatgctttaaggcccaggaaaggcctaagcaaaactcttgatgggcttttgttacattccagcctttgtataagggcactggcttttttttttttttttttaagcatttaatagttaacttaagcacttgattagtactgaaacagttgtgatggaggcctgcattagtgaaacctggcctgctacaatccccactgtcaatttgcgcatgatttctatcatgcttgtgtatttatttatcatgagaatcgtagggagatggggtgtcataatctttctggctactttcagctgagagagggtcattgttatggggcaccaaatgcagtactggagtggaggaggttgatttgttcccggtagcactgtctattttaggggcttagagagagtgcctgctgaaacacctagttttcagttcacagggctttaagaaagcaaagcttaggtttcagtgatttccagttagggaaaatggagaaaaaggaaaagaaaaaggaaaaaattgaaaacattttgagacttgcagccagaaaaattagaatttaatccaaactgtagaaaataataaaaactgaaaaacatcgaggaagactagaatttaacaggtgtaactataatttttgaaacataatttttctctcttgtttcccatttttattaaaagacaaatcatggtaggactggtttgctttattatacttggcctaattacttatataccgtgcagcaagaataattattttttacataggcgttttaaatgggctttgatggaactttgttccatagcaggaatctgagataagacctttttaaagccgagcccaaccatggatttataccatcaaatacctatgagttgggtgaattcctctcttcttgaggttccaagataacttggggttcctggcctgtcagaaagtgacattctttacttaccacaggtcagaaaccctgtacagggtctatgtacacaaattatgaggccagtttccaagggctttcttggcttcctaagtcaagtttgattccttaaaggagagcaaagtcaaagccttggtaaaataaccagtttttccaattgtgtcctgttacaaaagaaaacagattcttactgcacttatgcaaataactatattgccataacttaagaatactcacagtttcgaaattctggagaaaatcaggtagagagaaacaaatatgctccaaattttgttcataggagtatactgtacttaaatgttaaaaggtgttaatagctcaaaagaaaagtttccttgcctctgaaaagcaaaacaaaggattagcaacattttaagccgaaagtcaaaaagatcacttcagtctcctattagttcagttcatgcagttaattcctgtcctgtttgatattaatgaacattttaactcttcaagagtcatcaacgtttttcctctattttgatgtcacaatctccaaagttatcagaaacctgcattcaagagcacctgttagagctttacagctgattataaaaccaccttctaaagaggaccaaaacaagacagacaacaattatttatggaggacaaaaggttttagggtagccatagttaaagacacaattgatgacaagggtatctgttacctctgtggcacacaataattttaacataacaattataattattaatgataacatacactaagatatatcagaattataggagtcttccataactttggaacacataccaataatatatttatgcacatacagcccaaagaaagccaaacaccatttcatgtttgacaatgcttcctgtataattttatatcaaataagccacatttcacctttacattagtgtactattaatgttaaatccaatttttaataaaaccttatagacacatttacccaattttaatgtttgaccataaagtaagagttttatagacctttcataactctttacaatttttgttaaacagaaggttagtgctctaagagaaacccattgtgcttttattttaatgctcaatttacagaaaaactggatgatatccctttaattttagccaatacatttacacacagaattgtctttacaattacccttccacagcttgcttaaactttcatttttattttatccaacttaaaacaatcctttaaccttttaatctagtaaaaaatatccacattctcatgcctccttataatctttttaccaaaagtatattttactttccttacacaacttgcatgtaaactgttttttcaatagtcttaaatacacattacattgttaattcttagcaaccttttcttttggtgaaaaccttggtaaatttgggattttaattatatactaggtatggagcctacgacctagacagaaatgcaggtaaggtctgacttattctagcatctagctccatgtgtcctaggccttacctagctgcaaagcaggcaagttgtacagctaagagtcatagtggcattttataaagcatttaggaggcctaatcacctttaaattgtacaacatttcttgcataaatttcctttcataaattctttcacaacttacacagacaatctctgacatgccttgactttctgacttgttctaaacatccctctctttaaacaaccagttaatttactttaggacaagaatttaccatacaggagcccttcttgtataaattctcttttctttaaaactttttgcatagctaggggacatggctaatttcacatgtccccaggccgtatctagaatttaacagtccaaaataaattgaacactttttaagtcaaagaagcattttatgacctaaagcatttagcaaacctagtatttgacctgcataatttagaccaactatttacatttttgaagatacttttaccaataatctttaaaattctccttatttttataactttctgtatatctctcttatttcctggtttcttttaccttgttttatatataacctttaaataagctttgaataagacaacaattagttacccttggccaggcgtggtggctcacgcgtgtaatcccagcactttgggaggctgaggcgggcggatcacaaggtcaggagatcaagaccatcctggctgacacggtgaaaccccgtctctactaaaaagtacaaaaaattagccaggcgtggtggtgggcacctgtagtcccacctactcgggaggctgaggcaggagaatggtgtgaacctgggaggtggagcttgcagtgagcagtaattgtgccactgcactccagcctgggtgacagagcaagactctgtctcaaaaaaaaaaaaaaaaaagttaccctttaaaaaggacacaatctttagaaagaatgttttcctacgatatatttttattagaaaatacccaaataattagatatctgttgtttaatataactttagattctaaattatgacaagtttacttatgagtatgtatcccattacatttatctaattatttattttaatcatttacccagattatatatgaaaactgcgatagttgtcattaaagttaggaaaccaccattgcaaaattatgaccgagacagtgaaaatgatctgacctaactgactccatcttccttctaacctacaaggtattcttgtttattaacttagtttataatttagctttgaaacaaatgtgataacagtcctttcccagaacaaacttccttcatgtctgtggactagactgcttaaggccagaagattagaagttagggtattttggccaggcacggtggctcacgcctgtaatcctagcactttgggaggccgaggtgggcggatcagaaggtcaggagatggagaccatcctggctaacatgatgaaaccccatctctactaaaaatacaaaaaataaccaggcgcggtggcgggcgactgtagtcccagctactcgggaggctgaggcaggagaatggcgtgaacccgggaggcagagcttgcagtgagccgagatcgcgccactgcattccagcctgggcgacagagcgagactccatcttaaaaaaaaaaaaaaagagtattttactaaataattcaagatgtaactatcttcattaaaacaatattaatgtttcatttatttaaaaattacacatgcaaagattattctgtttgcactgaattatagttttgtagcctctatgccagattttgacaccttataatatttggcagagataagtatgaaattgcttgatcaataaatgcaaactaaaatgtatgctggaaactcttaagacatttctaatattactttaccaataatttttaaaaccagcttacttattaaagattttaagtcacataaacttgaaaaagcatttgactagtctttccttttttctgttattcaagtgcttttttctttgagccatttaattagacctcttttgtatatcttcagtagtgaaacatggtgtacacaagacaaatacataagtgtattatgcatgccaatagaagtacattttatagattcgtaagacctcatttttcagtctccctctactgcctaggccagagtacagtggcatgatctctgctcactacaacctctgcctcccaggtaaaagcaattctcgtgcctcagcctcccaagtagctgggattacaggtgcctgccaccatgcctggttaatttttgtatttttcttagagatggggtttcaccatgttggccaggctggtctcgaactcctgacttcaagtgatcagcccgcctcggccttccaaagtgctgggattacaggcatgagacaccacgcccggccttaactggatgtttgagctctgggtggagcccatactgaatcctgggttttcaaaaagggagaattattatgaggctagaccatgtgatgcttttacagtgcacttaaacaattttttcccaaagacatttctaagtgtctaaattacactttttctttaaaaccccagagtagcttctgtttaatagctattaatgaagaaaacagaattcagtcaactgagaagaaaaaaagttttgctcaaaaagataaggccctaggagagagagaaataaaaccaaaaacacgaaggccttttaaaggccttcacgcccccgtgcgcacacacacacatatgcacatacacattttggatgttagcttttaattaagctgactcccaatcattgagcttcaaaaaatctttctccttcccagaggcctctcagcagagatggacccaatacttcccattttcaagtttacatggtatcaaaaggaacaagacagacacacaaacaaatggaaacatttcagaaaaacccaaggggaagtgcactacggcaaaacagactctcaaaactaacgcaaaacctgatatcaaccaaagggaaagtgggtgtatgagccagccctgttgcttcccttggcagtaccggataaatggcttaaccagcccaaatgggaaaacaataggctcctggcctaagatcccattgactcaccctttgagcacgtccgctccttatctctgttcttccccagtagagaaagggacgtgtagatttgcacataaacagccctctggagggtcccctggggaaacctcacctgacagctgctgggatcctcctgaagactgtctcatcgcaagctaccagccgctgaacgcggcactgtccttatcttctggctggcgacttttttgttcccagaccaaactgagggtggggctgcccaataatgagatgcaggtgaatctcgctgcccaataagaagatgcaggtgaatctcgctgcccaataatgagatgcaggtgaatctcactgcccaataatgagatgcaggtgaactggggaggaagagagtttttatttctgtaactggttacaaggagaaggcctggaaattatcaccagaccaactcaaaattacaaagcttttcagagtttatatcccttctaagctatatgcctacatgtaagtgtgcattcatctaaagacataagtgattaacttctttgaatctataactaaggtctgagtcctgaagaccttcctctggagcctcagtaaatttacttaatctaaatgggtccaggtgctggggtgattacccttatcttgtctcctgctaaatcatggaggtttggggagttccttcagccctcccacacacttgtttttggaggcctggggagtttcttcagacccccagtaaaacttgtttaatcctaaatgagtccttgttaagaatttcttcattattttgtcatgctttaaggcccaggaaaggcctaggcaaaactcttggtggggttttgttacatcccagcctttatataagggcactggctttttttagcttttaatatttaacttaaccactcagtcagtactgacacagttgtgatggagggctgagtgaaacctggcctgccacgatactgtttttcccagtgtgtgttttacattcccaccaacagggcacgaaggttccagtttcttcacacctcaccagcacttgttattttccatgctgttgtttttaatatagtagacgttagtggtggtgagcatcttttcatgtgcttatgggccatttgcttatcttctttggagaaatgtctttcaagtcctttgccctttttaaaattttttaaaaatttttattgtaaattaagaaattacggccaggcacagtggctcatgcctgtaatctcagcactttgagaggctgaggcaggaggactgcttgagcccaggcgaacgttcaagaccagcctgggcaacatggcaactcccaataaattgtatgtatttatggggatttatagggtacaaagttatgttatgatttatgaatacaatatggaataattaaatcagctaatatgtccaacacctcaaatacttaacatttttatggtgagaacatttgaaatttattcttttagcaattttgaaatgtacaatatgctgttattaactacattcattgcactgtgcaacagatctcaaaaatcttattcctcctgtctaaccaatggtttgtacctttgattatcatctccccattcccccgtgcccagactctagtaaccaccattctattctctgcttctgagttcagttgtttttttttttttttttttgacacaaaaatttcacttttgttgcccaggctgtcgtgcaatggtgccatctcagctcactgcaacctccgcctcccgggttcaagtgattctcctgccttagcctcctgagtagctgggattacagatgcccaccaccacgcccagctaatttttgtatttttaatagaaacagggtttcaccatgttggccaggctggtctcgaactcctgacctcaggtgatccacaccctaccttggcctcccaaagtgctgggattcaggcatgagccaccgtgcccagcctcgttgttttcaatttcatgtatgaaaacatacagtatttctctttttgtgcctcacttatttcacttagcatgatgtattccaattccatccatgttgtttcaagtgacaaaatttctatctttttaaaggctgaatagtattctgtattgtctacataccacattttctttatccatttatctgttggtggacacaggttgattgcataacttggctgttgtaaatagagctgcaatgaacatggaagtgcagatatctccttgatatactgatttcaaatctttttggtaaatacccagaagtgggattgctggagcatataataattctatttttagttttttgaggaagctccatactgccttctgtaatggctgtactaatttacattcccaccaacagtaagcaagggttcccttttctccatatcctcaccaacacttgttatcgtgcatctttttgataatggccattctgataggtatgagatgatatctcattgtggttttaatttgcacttccctaatgattcgtgatgttgagtttttttttttcaaatatctgttgaccatttgtgtgtcttctactgagaaatgtctactcaggtcccttgcccattttgtaatcagattattttttctctttgaatagaattatttgagttccttatatattttagatattaaccccttatcagatgtatggtatgcaaatattttctcccagtctgtagcttattgcttcactctgttgtttcctttgttgtgcagaaactttttttttttttttttgagatgaaatttcactcttgttgcctaggctggagtgtaatggcatgatcttgactcacggcaacctccacctcctgggttcaagtgattctcctgcctcagcctcctgagtagctgggattaccggtgcatgccaccatgcccagctaattttgtatttttagtagagatggggtttctccatgttgatcaggctggtcttgaactcccgacctcaggttccgcagaaacttcttatgttgatataattccatttgtctatttttgcttttgttttttgcactttaggggtcaaattttaaaaaatgttgcccagataaatgttgtgtagttttagcccctgtgttttcttctagcagtttaatagtttaaggtcatatatttaagtctttaatccattttgagttgatttttgtatatggtgtaagataagggtccagtttcattcttgtgcatatggatatccagctttcctaacaccatttattgtggagacttttttttcccactgtgtattcttggcacttttggcaaaaatcaattgaccatagctatgtggattcatttataggctctgtattttgttccattggtcaatatgtccatttttatacccgtgccatgctgttttaattattattgctttgtagtatagtttgaaatcaggtagtgtgatgcctccagcattgtactttttgatcatgattgccttggctatttgtgtttttttttttttttttttatggttgcatatgaattttaggattgttttctctatttctatgaaaaatgatattggaattttgatagtgattacattgagcctatagattgctttggatagtatggacattttaacaatattagttcttccaagtcatgaacatttattttcatgcatttgtgtctctttccgttttatttgtctcttctgttttgttcattagtgttttacggtttttaacatacaggtctttcacttccttagttaaatttactaatttttttttgtcattgctcttaataggtttgttttcttaatgtctgtttcatatagttcattattaatatatagaaatgctactgattttcatatgttgattttgtatcccacaaccttactgaatttgtttacaaatttctaacagttttttggtggagtcttcagggttttctatacagaagatcatgtcatcggcaaatagacaattttacttcttccttttctatttgaatacctaataattcttttctttttcttgcctaattgctctggctaggacttccagtaccatgttgaaaagaggtggtgagagtgagcatccttgtgttgttcctgatattaaaggaaaagctttcagcttttcactgctgagtatgatattagctgtaagcttgtcatataaggctttttttgtgttgatacattccctttacacctaatttgattagagtttttatcatgaaagaatgttgtgttttgtcaaatgctttttctacatctaatgaggtgatcatattgtttttgtcctgcattttgttaatatggtatatcacatttattgattttcatatgttgaaccatctttgcatcccaggaacaaattccattttatcatggtcaatgattcttttaatgagctattgaatttggtctactggtattttattgaagatttttgcatctgtgtttattagagatattggcctataattttcttttcttacagtgttctattctggctttggtatcaaggtaatgcaagccttgtaaaataagtttggaagtagtccctcctctgtaatttatttgggaaagtttagaaaggattggttttagttcttgtttaaatgttttgctgaattcagcagtgaagccttctgggtcctgggtgtttctttgataggagacttttcattactgattcaatatccttaatcattattggtctgttcggattttccatttcttcatgattcagtattggtaggttgtatgtgtctagaaatttatccatttcttccgggtggttcaatcctttggcatataattgttcataatattttcatatgatcctttgcatttctgtggtatgcattgtaatgtgtctcatttttttttttatttgagacagagtctccctctgttgcccaggctggagtgcagtgtgacaatctcagcttactgccactttcacctcccaggttcaagtgatttttgtgccccagccacccaagtagctgggattacagatgcacacctccatgcctggctttttttttttttttttttttttgtattttattagggacgaggttttgccatgttggccaggctggtctccaactcctggcctcaagtgatccatccgtctcggcctcccaaaatgctgggattataggcatgagccactgcacctggcctcctcattcatttttgatttaatttatttgtcttctttcttttttcttagttagtctagttaaagtttagtgatttcatttattttttcaaaaaactaacagaattttgataatcttttgtatttttttcagtctctatttatttttgctctgatttttattatttcttttgttctgctaactgtgggcttagtgtatcttttcttctatttccttgaggtacaacattaagtcttgtatttgagatctttcttcttttttgatgtaggcgtttattgccatttcctcttaaaactgcttttgctgcatcccatacatttggttatgttatgtttccatttcattttctaatatactcttaaaattcccttttgatttcctctttgacacattggctattcaggagcttgttaccattcaagttctttgttcatttcttaatcacattgttggctttttgttgttgttgttgagttggagttttttatatattttagatattaaccttttatcagatatacaactagcaaatgttttcctcttcctgtgggttgccccttcactgttgatcatcattggatgcacaaaagtttttaatttttacatagtgcaatttatctactttttttcctatattgcttgtgttttggggatcacattcaagaaatcattgccaaatccaaggtcaggaagaatagttcctatgttttcttctaagttttagggttttcacttttatgttagattttggatccattttgagttaatttttgtatacgtgtaagttaaaggtccgaggtcattgttttgtgatgagtcaatgtctagatttcccaagaccatttttaaaaagattgtcctctcaattaaatggtctttatacctttgccaaaaattacttgatcatatacagtcatgcaccacataacaacatttctgtcaacaacagactgcatatgtgatggtggctccatgcaattatgtaacatgctacacaggtttgtagcctaggagcaaaaggctataccatataggccaggtgtgtcataggatacaccatctaggtttgtgtaagtacactcttctgatgttcacacaacacaattgcctaatgaccctttgctcagaacaatgttgagcaatacatggttgtacgtgcaagttcatttctgggctctctggtctatatgtcaggcaccttttaaatcagaagttcactatttaatgtttgatcctgtatcccaattttttaagtttgctatattataacccccatttataaaaatgtgtgtctgtgtgtatgtctgtgtgagagagaataagagaaagagagaaagagagaataggcatacctatggaaaaatagtggaactaaatgagacaaaatattaatggatgctatctttagctgagaatatcacgtgtggtctgtgtattcttgtaaaaactttccttgcccacattttctggaatgaacatgtttagaagagttttgcaggtgtatgttacttggccttccctgaaatatgaagggacaaacaaacactaaaggatgtttgagaggtgagagctgcaagaaagatgagggttctgtttagcttgggtgcctgggctcaagagaatgtgagtggatcctgggaggggtgaggtctggaagccactcatgcccatccctgctttgtccccacaggtctcagctgagtctgctctgatcacccaacaagacctagctccccagcagagagcggccccacaacaaaagaggtccagcccctcagagggattgtgtccacctggtatgttcaagatgggtctctaatccttgcccctcctccccttgtctccatgagcttccagtctgtttcctttgcacttccttgttctttattccacagagaggcattgggtgcctccagttcaaggctctgtccttctggagccttcctgctaggatggtatcaagacacacaaatgaatgagacagccaaagaaactgataggaaccttgagagagaattgagtgggacagagatggggctggtgaggcctccaggcaatggtgactttgggctgacatccggaggagggcagggccagaggttcagagagccaggaagagtgctcctaggagggttccactggaacaattgccagggggcaagagttggagaagatggagcaacagcagggggctgctgtggggagtggagggttaggaagttagagagacacgtggggtcagatcccacacagatgaagctggattttatttcatgagtgatggatgtccctgagaagttttcagcagagggccaccagcatcggatgtacatcttgagtgcccactcctggactgaaccggagcaagacaggaagcaggtggagggccttgagtgtgaggcgctcccctgggatgttatgtggtgtcccgtaaggtcatttgagcccccagagatgcagcaggaacctggcctgaagtgtgcttgactgttgtgttcgcctcgcacttcttcccccttttcccccatgtgtatgagttaggaattgattgctgcatgaaggtttccagggcaggcaagtgtggcaagcagtggcttttaaaatccatttacaaagttgcatttcttttccatgactaagggccacaggaaaggcttgcctgagggcaaaccctcacattgcacatgtgggcttgccaggagcagagcatggagaaggaagaacccagcgtgaagcagacacaaactcatctgtaaatgctcctattgctgtggtccagggtcaagaccaggaagcaggacgggaataggaaggactcaagacatatttggggtgtggatggatgacgtgtggggaatgaggacaatcgaggcaccaaattcaactgctcagggtaacttggcctctgaggggacagtgtgtggcagggctagcagtacacatttggggaccctagcacataggtgatgcttgaagccgctgtcttgagtgtgtccacctggaagaagttgtaaatactgaggaggggcacaactgagcccatgaggatttgaagttggagacgataggccagggagacaggactgcaatgggctgagcaggagcagttggagaacttccatcctagaggagagatggcccttccagccacagggagcaggccatagcaagtgtcaaggactgagatgtggaaactcctcgaaatgtgcatttctcttcctgtgaatgaggtcaagaatctgttcatgacacagacactgtttgtacactggttctcctaggttttcttcactcctagtaagaggttaggttttttttttttttttttttaaatcattgagtcacatgaattcttacagattagggaaattatacattgattgattgattgattgactgattgagataggatttcactctgttgcccaggctggagtgcggtggcaggatcatagctcactgtagcctcaaccacttgggctcaagcgatcctctcacctcggccttccaaagtgttgggattacaggcgtgagccactgcgctgggtccaaaattctaataaaaattcccatataacgccgggcgcagtgactcacacctgtaatcccagcacttcgagaggccaaggtgggcaaatcacttgaggccaggagtttgacaccagcctgaccaacatggcgaaaccctgtttctactaaaaatacaaacattagctgggtatagtggcgtgcctgtagtcccagctacttgggaggctgaggcaggagaatcgcttgaacccgggaggcagaggttgcagtgagctgagatcacgccattgcacttcagcctgggtgacagagtgagaccctgtctcaaaaaaaaaaaacaacaaaaaaaaaattatcatatatctttgcagtcattttgtggtttcctattttgtaattaagtcattgagccacatggacttcattttgtagtaagaggagagtgaggaagacacattattatttgacagccacctttttggttgccccaacactattattaaataatcacgtttttatcagtgacatgaatcactatgattatgtatgatacttacattattaagtaaggtttgtgtaatttggattttttagaatgtctttcaatattaataaaaataattcaggaatcttgtggctagcatataggtgattatggtctattttttgcgtttgtttttactcattctgccactctctgccttttaattgcagagtttaaactattttcaattaacatagttattgacaagaaaagatttgtttctgctcttcagttatttgttttctttatgtcttatatatattttgttcctcccttatcaccttttgaaaaaactttagtttatttcttggcatgtaccattttcactcacttcttttcttttctgcatattttaaaatatattttctgtttttcttaaatatatattttgtgtatatatatttaataaatatatattttgtatatatatatttaataaatatatattttgtatatatatttaataaatatatattttgtatatatatttattaaatatatattttgtatatatttaataaatatatattttgtatatatatttattaaatatatattatatatatttaataaatatatattatatatatatttaataaatatatatttaaatatatacttagtatatatcttaaagatacatatcttaaatatatatatagatatatatatattttttgagacagggtctgctctgtcacccaggctggagtgcagtggtgcgatctcagctcactgcagcctatggctgctgggtttaagcgattttcctgcctcagcctcctgagtacagggagtagccaccatgcctggataatttttgatttttagcagagacagggttttaccatgttggtcaggctgtctcaaactcctgacctcaagtgatccacctgcctcggcctcccaaagtgttgggattacaggtatgagccacgcacctagcctaaaacttattttcttactggtttccttgaagattacaattaccttcttaagtatctaaacaggtagttttataataccggcagaatttcattgcaatccaaatactgtgctcctgtaccactccatctctccagctttctattgttgctgtcatagatcacatccttgcacgttgtgtgaccactgacgtcgatcttaaggacatgtatgtgtatggagcaaggttgacttgtgatggttgattttatgtgtcaacttggttacccagatacttggccaaatattatcctagatgtttctgtgaaggtgtgtttgttgttgttgttttgttgttggttttagatgggattaacatttaaatcagtgggctttgagtcaagcagattacccccttaatgttggcaggtcccatctaatcagttgaaagcctcaatagaaaaaagactgacctccaccaagaaagagggtgttctgccagcaggcagccttcagacctgagctgtgactcttctctgctggcctatcctgtaccttttgaatttgccagcctccacagttatgtgaaccaattccttaagataaatctttatctctctagagcaggggcccctgacccccaggccatggaccagtactggtccgtggcctgttaggaaccaggccacacagcaggaggtgggctgtagatgagtgagcattactgcccgagctctgcatgccgtcaaatcagcggcagcattagacttcataggagcgtgaaccctattgtgaactccacatttgagagatctaggttgcgcactccttatgagaatctaatgcctgatgatctgtcactgtctcccatcacccccagataggaccatctagttgcaggaaaataaactcagggcttccactgattctacgttatagtgagttgtataattatttcattatatgttaccatataatagtgatagaaataaagtgcacaataaatgtaacatgcttgaatcatcctgaaaccatccccatgcccccaactccagtccgtggaaaaattgtctttcaggaaaccagtccctggtggcaaaaatgttggagacccctgctctagagagccctgactaatacagaatttttaaagatttgaaattcttttaaaccatacttgatctccaagtaatggaaataataagattatatttccacctaacataatacagctatcctgtatacaactgaaaacgcactaaccctttctccagaagaggatgcaaagttcttgagtggtgtttactcctttccttgataccctggaacataaatactataaagtgaacaatacttaaatactatgatataaattcaaaatatcttgtgttacataacaaggggataagagaaggaagaaaacacagatattcgcttaacatatatttacacataaacacacacacataacacaataaggaagaaatacttataatgattacagtccttatttccatagctggtcatgtcattgtagctggtatttataagaagcttctttcgctgtgcattctgtattccctgtgccctcactaagcacctcagctggtcatggctctgtgcctggtagagtgaactaacctttattcctgaagggtctgagctataagtggtcctgctttaatagggtcgtggtagttttccattgactttactcacagggcatggtaatactaagagatgccctaaggaatctcctgtattctagacatcctcttccttacgtccattgtggaataacagtccaattttcccttcaatttcccctttgtgttcagaatcagtcaatccagccagcagggtttgtgtaactggttttcgcctgttgattcagaggcatgaggaacccaaagtggccaagtggcagtcttcaagttacacagaatcactgttgtgtctcctcatggaatcattcctccctctgaaactcagagctctagcaaagcataaagcagcaaaaattttgataacaggccactaagggtaatgtggagtggggccattcctgcttccacccctagattcctggacacatgaatcctagcaatggaagaagcaaccgcatgtattggaggataattcagagcatagacagtctcctggagaaccttgttgcagcccttcaaggtactgccacccagctgacattgtaaatgagttttcaaaaagccatatcccaccatcttaccaagccagcagttttgagatggtggggaacatggtaagaccagtaattccatgagcacaggcccattatagtgggcgcttcatttgccatcaagtgagtccctcaatcagaagcaatgctgtgtgaataccatgactgtggataaggcattctgtgagtccacagaggatagttttgacagaagcattgcatgcagggaaggcaagtctatgtgcaaaataagcttctcttccagtaaaaatgctgccccctccatgatagaaatggttcagtgtaataatcaacctgccaccaggtagctggcagactgaccctctgaatggtgctatatcagagactcagtgttggactctgctgcctatagattgggcactcagtagcagctgtagccaggttggccttggtgagggaagtctgtattgttaagcccatacataacctccatccctgccaccatgcacactttgttcatgagcccattgagtgatgacaaggatggctgggaaagaagctgactggtagtcacagaacaggtcatcctatccacctgattattaaaatccttccctgctaagatcactttttgtgaagatatttgtgtcacatggggcacaaatatcttcatggtttttttacccattgagaaaggtctatccacacacctcttccccagacttccttgttatcagttttccttcagagcctctgaccctccagccaaatcattgaccacagctcatgaatcagtatataactacatgtctagccattcttccctcaagcaaaatgaacaaccaggtgtactgctcagagttctgcccagtggcaggatctcttttttttgagacggagtttcgctattgttgcccgggctagagtgcaatggggcgacctcggctcactacaacctctgcctcccgggttcaagtgattcccctgcctcagcctcccaagtaactgggattacaggcatgtgccaccatgctcggtaattttgtatttttagtagagacgaggtttcaccatgttggtcaggccagtctcgaactcctgacctcaggtgatccactcacctcggcctcccaaagtgctgggattacaggtgtgagccaccacacccggcctagcggatttcttttcaccactgtccttcagggacgtcccagacagtggatgtgatgctgcaaacatccacttctaagggttacctgtatgtggtgcagaaccatctgtaaaccttcttctggcaactgaccatagggaattcctcatgaggccataagtgcaggccaggcaaaagaaagtaatattgcaggagtggggatcatgggcacttgggccacttcttcatgtaactttcttgtgccttcagggcctatttaagcccaattttgtatatataccaattacatttgaaaatggaaatggaaactttaggctgtatgtgcccaaacttatggcttggtaggcaaaataacactcagttcacgatgagcagtcaggtcgtagagtaatttggtggcctatggttaaccattcagtctgcactaaggcccagaaacaagccaagagctgtttctcaaaaggagagtagttatctgcagaggatggcaagtctttgctccaaaacctaagggcctgtgctgtggttgacctagagtgggctactaaaggttcaaaacagcattgctgtctgccaccaatacttcaagcaccgttgggtctgctgggtcgtatggcccaagtgacagaaaaatgtctacggcagcctggacctgttgcagagccttttcttgttctgagcaccactcaaaactagcacatttttaggtgacttgataaataggccagagaaacacacccaaatgaggaatatgttgccaccaaaatcaaaataagcacactaggcattgtgtcattttcttggttgtagggaggtgggggtggcagatacaacaatttatcttttatcttagaatatcttagaagagaaggaatatcttatgtgccacatcattcaacaactaggaatttgtttcccagttgttgtccttctactgaggtaaaaggcccttgaaattttgtcagatttatttcccaccccctgacatgcaaatgtcttaccattaagtctagaatagttgctacttcttgctcgtgaggttcaatcagtataatgtcatcagtataatggatcgtcttgtgtgttatcttgtggaagggaaaggccatcaatatccctgcaggccagatgtggtggctcgcgcctgtaatcccagcagtttgagaggccaaggtggctgggtcacttgagaccaggagttctagaccagcctggccaacatggtgaaacctcatctctactaaaaatacaaaaattagttggatgtggtggcacacatgggtaatcccagctacttgggaggctgaggcatgagaatcgcttgaacccaggaggtgcaggttgcagtgagctgagatcatgccactgcactccagcctgagagacagagcaagactctgtttaattaaaaaaaaaaaaatacctgcaaactaaattatgacatagggctgcgagttgatgcatcccggagacaggatagtgagggtatattgctggccttgccaactgaaagcaaactgcttctgggagtctttattgacaggtatgaccaacaaagcatttgccagttcaacacctgcataccagggtaccagggatgtggcgatttgctcaaacaatgaaaccatatctgggacagttataactggaatcaccacctggttaagcgtatgataatccactgtcattcaccaagatccatctgtctttggcacaggccaaatagtcaagttcaatgggcatgtgatgggaatcaccacagatgcatcctggatggtggtaatgatctctgcaatccctccaggaatgttgtattgcttttgtttttttgtgctttacaggcagggtatcactctgtcacccaggctggagtgcagtggcacaatcatagcacactgcagcttgaactcctgggctcaggcaatcctcctgcctcagcttcttgagcagctaagactacaggcatgtactgtcatacctggataattttgtatgtgtgtgtacagatggagtctcactgtgttgcccaggctggtcttaaacccctggcctcaagtaatcctcctgccctgacctcccaatgtgctggaattacagacatgagccaccatgcccatctggtattgcttttgatttactattttttttaagtaaatgcaaatctggtggcttccacctggtcttttccaccataatagtcttcacttcacatgtcagggaatgaaggtggggattgtgccagctgctgagtatgtctattccaattacacatactaaaatgaggaaatcagacaggatgggtgtggggacccactggcccctttctgagatggacttgagcttagtttgagtaatgacaacataacttcaatggtatgcaaacactgtgctcctgtacttctccgtctttcctcctccatcttgttgttatagatcacatccttgtacattgtgtgcccattaacatcaatttgtaattattgttttctgcatttgctctttaaatcatataagtaaataagaggatttacaaaccaaatgtaccataatactgtgctacagactgaattgtgtccccaaaatcatatgttgaagcattaccatccaatgagatggtatttggagatggtgcctttgggaagtaattgggtttagatgaggtcatgagggtggggccctcatgatgggattagtgcctttttaagaaaagacccagacaacttgctctctctcgcttgctcgctctctctctccccccctcttctggtgtgtgcaaggaagaggttacgcaaatgcacagcaagatggtggccatctctagaactatgataaataaatgtctattgtttaagccacttggtctatggtattttattatagcagcctaagtagctgcgtaccagcatttatatttacctaaatagttaccttttccagggttcttttttttttttttttttttttttttttttttttttgagacggagtctcgctgtcgcccaggctggagtgcagtggcgtaatctcggctcactgcaggctccggcccctgggtttcacgccattctcctgcctcagcctcccgagtagctgggactacaggcgcccgccacctcgcccggctaatttttttttgtatttttagtagagacggggtttcaccgtgttagccaggatggtctcgatctcctgacctcgtgatccgcccgcctcggcctcccagagtgctgggattacaggcgtgagccaccgcacccggcctccagtgttctttatctcttcgtatgcctttgagctattatctaatgtcattacattacctcctaaaggattccttttagcatttcacagggcagatctactagtaatgtgctccattacctttcatttatctaagaaggtcttaatttcttcttcattcttgaatgataatgttcctggatatcaaattcttggttgcaggattttgtatgcttgtgtttttgtttcttggcactttaaatatgttacccactcccttctgggctctatggttcctggtgagaaattagctaataaccttattgaggttcccttgtacatactgagtgggccacttgctactttcaggattttctgttggtgttgggcttttgtccatttgactataatgtgtctcagtgtagttctcttttaacttatcctgcttggagatcattgagtttcttggatgtgcagacaaatgttttttaaaagtcttgcacctccttgttaaatatcattcctaaatgttttattcatttttatgtcattgtcaatgaaattgttttcttaatttcctttttggattgttctttgctactgcaaaacttttacgctgaaaactatcaaacattgctgtaagaaattttaaaaaagcaaaataaacaggaagatattccatgttcatagatcaaaatggtgttaaattacccaaagcaatatacagattcaatgaaatccctaccaaaatctcagtggtgttattttaaaaatggaagaacttatattcaaagtcgtatggaattaaaaagacttattgaccaaaaacaatctggtaaaagaaaagcagagttggcgggactcacactttccaattttgaaacatatcctcattccagggcagctttagtccccttttctttggatcattctttgactctatagagattcctcccgttttcttcccatggctgatggtgtgagctttaattttgaaggcttttcccattgttgtatgacttctgctcctggtgtatcttccactggctaggagctcattcagaacaggtattaggacattcttctgtgcattttaaaggtctaagatggcactgtctaatatagtagtccctaggcccatgtgattgccaatcacttgaaatatgtgaggcaggtggatcacgaggtctggagttcgagaacagcctggccaagatggtgaaaccccgtctctactaaaaacacaaaaattagccgggtgcggtggtgggtgcctgtaatcccagttactcgggaggctgaggcaggagaatcacttgaacccaggaggcagaggttgcagtgagccgagatcgctgcactctagcctgggcaacagagcaagactccgtctcaaaaaaaaaaaaaaaaatgctactgcaaattgagatgtgccatgagttaaaatatacgcaggatttgaagacgtactgtgaaaaaaatgctgtaaaatatctcaatgttttatgtggattacatatttaagtgatattatctggggtacattaaattaaaatgcattattaacattaatttcaccccttctcaccttttttaatgtgctgagtgtggatttaaatttcatatgtgggctgggcacagtggctgacacctgtattcctagcaccttgggagtccaaggagagtgaatcacttgagcccaggagtttgagaccagcctaggcaacatggtgaaacctcgtctctacaaaaaaaaagtacactaaaaattaacccggtgtggtggtgtgcacctgtagtcccagctatttgtgggtcggggggagagggagggtccgggaggtcgagggtgcagtgagctgagatcacaccactgcactccagcctgggctatagagcaagaccctgtctaaataaataaataaataaataaataaataaataaataggccgggtgcagtggctcacgcctgtaatcccagcactttgggaggcctaggcaggcagatcatgaggtcaggagatcgagactagcctggccaatacggtgaaaccctgtctctactaaaaaaatacaaaaattagccaggtgtggtagtgtgtgcctgtaatcccagctactcaggaggctgagccaggagaatctcttgaacccaggaggcggaggttgcagtgagccgagatcacgccactgcactccagcctgggtgacagagtgagactacgtctcaaaaataaaaaataaaataaataaatgtgtggcttatatttcttttggcagtgctggtttaaggtgtgtaaatgcagaattgatgaactgaccaagctaggtagaggagatttccctcttttggttccacacatccctgaaagaggagtcccccagccaccactgccagcttctgggaatcctgtggcatttcattcaccggcttttctctcccctcccaggacaccatatctcagaagacggtagagattgcatctcctgcaaatatggacaggactatagcactcactggaatgacctccttttctgcttgcgctgcaccaggtgtgattcaggtacagaacatatggaccccatgcctaaaggtggaatgcggggtgatgacataaaagttgtagctaaaatgggatcaggagacctagattctggtccaccttggtcttcatcataccatgttccatgattttgtctttgagctttttaataaataaaacaggcccggcacagtggctcatgcctgtaatctcaacactttgggaggcatcacttgagcccaggagtttgaaaccatcctgggcaacatgagaaaccccgtctctacaaaaatataaacattagccgggcatggtggcgcgtgcctgtatttccagctacttaggaagctgaggcagaaggatctcttgagcccaggaggccgaggttgcagggagccgagattgtgccactgcattccagcccaggcaacagagcaaaaccctgtctcaataattaattaaaataataataatacagaaattatttgtataatgtatgctacatggtaaggaaatcttttaaactgtcagctgcaagggggtggggccatgagccaggccaagtggacagggctggatctcagcagtggcacaggtctgctttggggccaggctctctcccctgggctctgtgctcctggcaggtgctcggcctcactcacccttcaggttctcaggcctctccctcctccccagcaggctgggccttggggaagtcccccaagggctcctctccttgcagtctctcaggtgatcccttgcacttcccttgctactggccatgcaatctaaacgatgcttgtcccctaaacggtgctttcccctaatctaatgtaataaataatgaactgtggtccttttgtatgactcaacgagtgttagtgacagctgaagggtgggtatcctgaatgagccatgagtgtgctggtgcagaaactggccctcagaactccttggcaaactgagttgagctgagtagcagggtcttggggtggggaggaagggtcaagggacacatcaggaaaacacattcccaaaaccttatgctctgtcgtcaggtgaagtggagctaagtccctgcaccacgaccagaaacacagtgtgtcagtgcgaagaaggcaccttccgggaagaagattctcctgagatgtgccggaagtgccgcacagggtgagacaggagccgggggctcccagtagctccatggaaccccaaaagacccaagtctccttgtacccctgtctctcccctgacagcacccgcaaggggcatccttgaggctgtggctgcccctcctggtccctctgcgtgtcaccacccctgccccctgcagcagcctctttccacccctccccagcacgagtccccttgaccaggctgacttgttcactgaccacagaaggccatgacttggggcccatgataattttaggggcccatgaaatgatttaatttctcttgaaataagaagaatgagtagaatgcagccaggcatatattcatctttataccaattcagcaataaaatgtattttttaatatttttatgcatgcaggggcccataaagacaaaagtgcccatggcccacaaaaggcataataaggccatgggtggagctccttcaagttcccatgaggacctgagcccacccagccggcctcacccctggcccctgatccctcagtaagacctgtcttttccctatttgggttttaggggccaagagtaatttgctcttctctggcccccctagtatttgctgtgattgggggaaatgggcagacagctggggacaagagctcacttttgtggttgactggaagaccggactcatcttgtggccacacgggcttgtgaccttcccctggagtgtgattgctcctaacgcaggcctcccctgcagcccagggaagctcagtgtgtgcccagcacagaaggctcctggaactgcagctctgaccccagagcagggaggccgaggggctgaagtgcgcatgctcagacccttccccagcctcaagaagggagcacagggggacccactgctgacacgaggagactgtccttcccctgacaccttctcagggacactggggagggagggtggctcctctttcatcccacctggccagctttccatcaagagtcccccctctccctctgtgtgtgtacccaggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtaggtgctggctgagggcgggggcacagggcactctctgccctgccccctcccaccctattcccacagacagaaacgcctgcccctgccccaagtctaagtgcctccagcctggctctatcctcctcctcgtggtcacccccatccccacatcccgtgcaccccccaggaccctggtctcttcagtccctctcccaggtctgggggtccccatatctcccagccaagtccaggagggcagggccagttcctcccatcttcaggcccagccaggcagggggcagtcggctcctcaactgggtgacaagggtgaggatgagaagtggtcgtgggattttttcagccttggtcagagcagaaccagagattttccaagtgtttgtttttactctagttccccttctcatcccccttcctcagggtgtctctgagttgtaaggccccattctgtccccagccccagggctccttgtccagtgtcccagcccccagcccagccctgcgccccactgtcctctgggaggggggtgcttcatgggcccctcccttcctgctaaggagactgcttcttttttaggtggtggtggggaccctgagcgtgtggacagagtgagttgatttctccaggagctgggggctcaggggttcaggaactgcttcctgggacagcagaacctgggtgggtgggtccccattgtcctcatggctgccctgactctctgaagtggcctgggtgctctgggctgactgtgggggacacatggccattttgagcaccacataggctggtgagccctgctgcagcccaggtgacatcctcaccccacagcctgcaccctagggatggggtgtctgcctgagcacagcactgggggcctggccccagcagcgggtcctggatgtgctgagtctgggctgcctgcggtgacctcactgagagggggtggggatgtcaggtgcagctgcatactgaggaccctgcagcgagccctaggtgtggactcctgagtcggctttttgccttcccaatgtctttttccagagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggtgagtgggggacagatcattttgtttcctggcatgctgctcacctgggatttcgtagacagtgggagagggcagtgccttagctctcctggcccaggggaaatggaacctgaaggagccaggggactgcaggggatggagcagctgcactgaggtggtgaccgtgccagtctgcaggacatctgcttcttactccctgtcctgtccttgctgtgtcccccgagcctggagctccacaggcatagagtgggggtcacagggttcattgatgagtgaataaggctgcacagtctccatcgtatgctcctaacagaagtcagtgagcccttgcttgtaacagcaggagttttaaatttactctgaaattgttattacattgaacatatttcaaagttcgtagggcagcttccaaaaagtaggattccaagtcgatgcacaaagggcttttgtattggacacacgcacacaatcagttcatatcaatccatcagttttgatgtgatattgagtaggcaggaaatctgtatatacatttattgttcattgctcgtaagcactgaaagtccttccctcgaacataagatgagactatccagtttcctgcagtgttttatttttaatgatttgatttttaacatacagcaatataatctaaacagaattgaattttcgattcaatataagctgagaaactccctgaattattctgagtctctgtttccttcttccaagcccatttagcaaccaattcttcctttttcccttgcctttgcccttttgccacctcctttgctacatgtcaaatgtttacttttttctctcttcctcttcactcttttttaaaaaaacaaacaaacaaaaaaaaactagatcttatccttgaaaatgtcaaatgtttatatgggcagagatctcttccacctagactgtttctgtttcttccttgcatctgtaccactttctttttaaataaagagaagagattttaaaaggaaacaaatgaacaatgccaatacttcctccatgcttattaatgactttgaagatttttttttttgagacaggatcttgctctatcacctgggctggagtgcagtggcaccatcttggctcattgcaacccctgcctcctgggctcatgtcatcctctcacctcagcttcctgagtagctggaactataggcatgtgccaccgtgcccagctaagttttgtattttttgtagagacgaggtttggtcatgttgcctaggctggtctcgaactcctgaactcaggcaatccaccctccttggcctcccaaaatgctgggattacaagcatgagccaccatgcctggcctgatcattttttgaaagcaggtcacccatagccacacatccaccagagtatgaaaaaacttgatcataccaagagccttctttactctttcccagccttttggcccttcttatttcaggtaactacagtggataatttcttgtgattctttgctaaactctttatgcatataccatctaggtacataaatgcatatgtatttatgtggtattgacatgaaaaggattatatcatgtacaacaccaaacaaaactgtctaatatgttttaatatcttagacagcaaatatgttttcaaaattatttttacacatcttataatttagaattagataaaatttagaattataagattttctctagtacccctcccgcccacatagtcactagactttacaaatattaatttaaattaatacatggttctaggaatgattgacatcctttcaacattcaattttattatcaaagaagataatatttcaagtcaagtgttctattatgactcaatcgagatttgggagtttatttcagataaatttttcctattcctcatcaaagctgtttctttgcattttgggtcttcttgtaagtccattttctaatttattatgtctgctgctacttttcttttctttctttctgagatgggtctcactcttgtcacccaggctggagtgcagtggtacaatcatggctcactgcagccttgaccttctaaggccaagtaagctcggacttaccggcttctgagtagctcggacgacagttttgtgccactacacccagcttattttattttattttattttatttttagaaacaggatctcgctatgtcgcctaggctggtctcaaactcctgggctcaagcagtcttcacacctcagcctcccagagtgctgggattacaggtgtgagccaccatgcctggcctctgctatgtggtttaacattcatcagggctaggtgcagtggctcacgcctgtaatcccagcactttgggaggccgaggcggatggatcatctgaggtaaggagtttgagactagcctggccaacatggtgaaaccctgtctctactaaaaatataaaaatacgataaaataattagctgggcatggtggtgcacacctgtaatcccagctacttgggaggctgaggcaggagaatctcttgaacccagaggtggaggttgcagtgagccaagatcgcactattgcactccagcctgggagacggagtgagactctgtctcgaaaaaaaaaaaaatcatcaagacatattcacttttgagtattacaaattaaaccttggggttttaaaaatatacactcctaatctaaaatattgactgctgtatcggcctccttccgagagtcttgcccctttgtctcctgtcttgttgccagacctttcagaacaatgttctggaagtgacgtgctgcaggtctcagagctggctggtggtcggggtcagtactggactgtaggactcctggctctgaccaggacattccccactatgtgttacaggaaccggcagaagctgaaaggtctcagaggaggaggctgctggttccagcaaatgaaggtgatcccactgagagtaagtgttttgctcctggagatgcagcaggaatggagggaatagggacagggtcctaactgctgtccccagaggtcagagggctcttccagagtattccatgctggaagccgtgggtcctgtgctatagaccatctggaccctaaactgtcttctcccatctcttctccccactctacctcatcctctctgcaccctatcattgaccctaatgactctgtccgtcccctcatcctctctcctcctttgttcagggcctgatgtagcccccgcctgcccctgaggacctcctgaggggctggcctgtcctgcacagcaccactaaccccagtgggctaaggagctcttgacctgtgcctcagcccaatttgcagagctgttgtgtaaactacatacgaatgccaaagacttaatgcaaaaaagagtggaaaatatttcactcataatttttgtatattgattgtatattaaattatattttaaatatattcagtaccatacattaaaatgaatgtcacttgtttctgatgttctttaaaataaggctgttggaaaacatagcctcgtgttcctgaccctgtctatctctgaggacggcgaggtgcatcatgttgcacacacgtctcatttaatccctcatcgtcccgagatctgggcagcattgctcggtctttgggttcacttcttgctcagagtctgtttgcctccacctagctctgccccagccccaggaagtgaggccgagctgggtgaaaacagaggtcccctgtcccaggccctgtgctttccacagatgcagaagtggccgccctgggacctgctcccatgacaagcgcagcccaggcagcctcctccctcctctaagctcccgctgcagccactgtctctccctccctcggactctcacgcactttactttctgcctctgtaacgtccatccatactcccctggtgggttctcagccctgtatgagggctgattctctgacgactttgactccccgcagtgccttgcgtgtgggggaggccaggcagtgtgggcgcgctctctgtggatgggaagcgggtgggcactggagcggcaggtttgcccgcacacggggctctccaggttccccgccttgggttctgggcctgatgtggaatcctctgccctttctgagtcccaactcacctggctgtctctgtggctttctccaccagctctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaa

SEQ ID NO: 115 - DNA, 33711 bp, Homo sapiens
gcaggtgccccgaaaagggggcggggtcaggggtgccctgaactccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtgagtccccaccgcggtcctgcctggggaaaagcgcgcctggcaccgggagggggcagagagagagggggacgcggcgggggtgcctggcccgggtcacttgtggcggggcatgtccgggcaggaggagcccgtcgtcggagtcggaggaagaacggggtccccggggccaggcaggagcgacccgggcctggaggcagcagagccccctcccgcaggaggctgggcccggggactccaccccgttggctgctgcctggcgcgtctccctcctgcccacacctcacgatgtatcgggaagtttcggaatcgatagagctcaagtgtgtaaacttccaagccaactcccagccacaccagctgcgtgaaggggagcgccattctccccactccctgattccctccccacccccgtccttcttttcttctcttctttttttttttttttttttttttgaaacggagtctctctctgtcgcccaggctggagtgtagtggcgcgatctcggctcactgcaagctccgccttcctggttcaagcgattctcctgcctcagcctcccgagtagctgggagtacaggctcctgccaccacgcccggctaattttttgtatttttagtagtcacggggtttcactgtgttagccaaatccgcccgcctcggcctcccaaagtgctgggattacaggcgtgagccaccgcgcccggccctccatccttcttttcttagacaaattggttaaacacgcagcccggcaggaaaaagtaactttctctcctctgctcgttgtcttccgtttcgagtccactgagcacaccggcagcagtttccttccagccactttcttgcgcatcaacaggtacagggcagcgaattgaccaccacgaggcaggcagccaggagcggggcacgcccttccttcaggaggcagcgtttcctgtgaaagcaatcactcagtctggaaaaatgccaatgccttcagttctctttcaagttcattaaggctctaccaattgttctcatccagattccttctatgttaaggaaaaacaaaacgaaagctaagtacctgaaggataaaccagtcttacaagtgtcaggaaattttacgtgtttttgtttaacaaactaaacaaaatccaggaatccaatagcattttgaaatctccaaataattacagaatttatgttttaaacgtcagtttatgttaggtggaacccacgtttgactcttatttttaatacgcttattaaatggctttctttttgacaggctagtgcgattccaggtggatgtagggctcacctgtatagacaaggtgaaacatctgaatttggtggttttggaaatgtcacagtccgttggtgtggctataaaagaatacttgaggccaggcgcggtggctcacgcctgtaatcccagcactctgggaggccgaggcgggcggatcacgaggtcaggagatcgagacgatcctggccaacacggtgaaaccccgtctctattaaaaatacaaaaaattagccaggcgtggtggtggccgcctgtagtcccagctactcgggaggctgaggcgggagaatggcgtgaacctgggaggcggagcttccagtgagccgagaccacgccactgcactccagcctgggcgacagagggagactccgtttcggaaaagaaaaaaaataaaaaagaaaacttgacgctggataattttaaaagaggcttatttggcacatggttctgcaggctgtacaagaagcatgccaccagcatctgcctctggtgaggcctcaggaaacttccactggtggtgaaggggaaggacagctggattctgcccatcaggggaaggggtggggaggatggcaggaggagggggatgagatccggaagggagacggggaggggccaggttcattctaacaaccaggtgtcatggggaactaagattgacaactcctgggggaatgtgggagggggcggttatggcaccaagcctttcatgagggatccaccccaaaccccaacaggccccaccagctacattacggttcagatttcaacgtgagccctggcagggacaaaggacccgtagcagacaccaaggccttctgccatcccacaggaccctctcatcccaccatccctcagccttcttcctgtgcatttataggcaccttaacttttaaaattctgactgaagaacaaatcgcattggatgttttctatcagtacatgcaagtatctcattctttttaacagcatcataatatttagtgcatgggtgaaacacatggcgtgaaccacagttaattttaatcttccatcccatgggcaattgttaacattatgtcctgcttttgttttttctaattccagcagcattgtagtgagaacccttgtatgtgtcatatgtccatatgtcaatgttccctgaagtatcgggcagccctttagaagaggaatttttaggtacatgagctcatcaatgtagaattttgtttggatattgctaaattgtacttcgggagaagattgtgccagttttactctcacaccaagaatacaaaagtgtggccgggtgcggtggctaacgcctgtaatcccagcactttgggaggccgagacaggtggatcacgaggtcaggagatccagaccatcctggctaacacggtgaaaccccgtctctactaaaaattgaaaaaaattagccaggcacggtggcgggcgcctgtagtcccagctactcgggaggctgaggcaggagaatggcgtgaacccgggaggcagagcttgcagtgagccgagatctcgccactgcactccagcctgggcgactgagcgagactccgtttcaagaaaaaaaaaaaagaatacacaagcgtgcccgtgtccctgcacccttactacatggaactttcattctttgctactctaagaggtaaaaaatgatagacctcaatgttgtattttttgtttcagtgttattagagattttcaaggatccaggaattttttgagactgggagtagatgacctagagactccagattagaccgttggggagggagcagggaagactgcagtcgcacctctgcacttaggaaactgtggtcggctggggccagttcctgccacccgccatgcctgtgaatggagataatgtctctgtcctcagactgtcaggatgacatcagatgagcctggagctgagctcagtttctcaccccaggtcctggctctgtcaatgctggactggcccaatctctgtgccaggtccttccacctcgtctcgtctctctctttatcaaagtaggaaatgagaaattctgatggctctgaagcttagacactcaggctatcagagcccagagattggaggctgaagacagccagggttggccgtgctcctcttcagctctgtgactctgctgtggccccagctccttcctataaactaggtggatataaaagtctgcagcggccctgtgtaaaccacagtggtctgtgttggcagatgtgtgctgtcgtgtgggaggacaaatcacatgctcagggctggtgtcagtcactcaggactctggatccccagagcacctgtcctctacccagcagaggctgcacctgctcccacctgcacctccatactggctctctgagcttggggcagaaggttctaaggaatggggtggagcgccatggggaggggccgtggaggaacagaggagccagacttcaagttaggacaaagatgtcactgcagggccacagcctggcttacctgccacgtttccttccagttgtccttctggtgggcacccggcactggttgcagtttgaagagtgagcaggaaaggtctccatccatgtggctgcagatggctgctcacccagcccctactgagaggcaacagtcccagttctggtcctctgtcctgtatccaggagtgacagggcagcaaggctttagcttccaggtcggagatggggacagtgccatgccctgagcctgtgctgttgggcagttggtgtcacttagtctggaaaaatgccagtgccttcagttctctttcaagttcattaggacaggtgccctggggatccagagtcatgagtgactgacaccagccctgagcatgtgatttgtcctcctacacggcagcacacatctgccaacacagaccactgtggtttataaagggccgctgcagattttatatctgcctagtttataggaaggagctggggccacagcagagtcacagctgaagaggagcacggccaaccctggcagtcttcagcctccaatctctgggctctttgatagcctgagtgtctaagcttcagagccttcagaatttctcaatttctactttgctaaagagagaggtgaggtggaaggacctggcatagagattgggccagcccagccagagactgcacatcttcattcagggtattttcctaacccagggatgtggggattgttgctctcattttgtctggggagaaaatgagatttaggaggaggaagtccccagcatttgggacctggcctgcttgataatagcagctgcctgttggactgggaagggcctcttccggattcccaggcaggtatctgtgataatggggaaaggagaaagggtctgctttgtagggaagagcagggtgcactcggcacctcagacactcgcctgtggccaggaggggatgtgaatcatcacattttacagaggagaggaccaaagctcagagagggaaagtgtgtgcagctcagagggggaacgtgtgtgcacctggccacaggcaagtctgtccagagcactggtaggaatgagagaaactaggaatgaccactttaaaaacttagatgaagagaatctcaaagttaagtcattggagtttgttggtaatatatttgtgtggcttaggtcatgttaagtgcatcacaccctcgcccccatgtctgctgttggtctcagcactgggtggagggagcggggacagtcctgatgaagaggagaggggagcagcaccggctggggtggggcctctgccgctgcctcttcctgtgtggtttttcagggcttaggctgcgcctctcacctggcttgtctgtggggaggagatctttgttctctggctgcttttaagattttctccttaacagtgtggtttcagcacttcgatggtggcaaaaataatctgccggagccatgtctgtagcatttttggtctccccttctgtataatagcagccgtgttttggcttctgcagggctaaagtcctctgagcagctgcttctccacatctctgccctgcacttggcctctgggagctcctagggttccttagcagagtccacaggactcttcggggtcccatccctgtgctgtagcctggaacctgtgacctgaggcggtgagctgaggccaccactgggctcacctcatgggcttggagggaaagtcactcacccaggaagtaggtgatgagcactttactctgagaatgtctgcgcctggtggtggtgggaggacaaatgagccctgtgtcagtcctgctccctgaagcccacagtctggtggaggaggtgtcactagggacctaaataactatcaggaagcatgggggccacctcccccaccccccacctccagagaggctgtgccggctccagggatgccatccctccctacttgactccagcagttgcaaggccccaggtcatggtattggtggcttagaggatgtggtttcattaaaatcaacattgaggggaatgattgtactaacaacagcatgtgctgaaatacagtacttgcgtgtgccaagctctgttcttagcacttcatatgtaaatgaacacacttaatcctcatacaaccagactgtacaggaaccctcattgtctttgttttagacaaacagcatgagactcagaacatttgttcagtagaggggctgggcaggaggatgagcaaccctcggggcagcagcagtgattgggtcactgggttctgctgacctttcccaggggagtatttggtgctttttcatgaggcctgcattcacccagcgctgggtcactgctgggggtacctgagaagtcatgtaaagccacctcttatttccagaatgatagacatgtttagagaagaagtggcttcccccagaccatgaggctggcccgagactacaagacagatggcttgcttcttaacccaggggtctttttataccaaaagaacaaagaaataaaaaagccacgaaagactcaaaggaagcagattttcgaccacagccaacctcagaacaattctgagttgctcattttaagatcaataaggcatttttttagggtgtgtatgcctgagagaggaaatcagtgtgaatatcaaacttacctctgaaacagcctaacacaatgctaatccgagaggaacaaggcaaggaaaccccctggtgaatgactcatctcaggaagaggcagggcagggtcaggagagtctatggaggagaagacctggaacaagacctctctctcttgctctctttctctctctccctctctctctctcacacacacaaacacacacacaacctcacacccccatgagcccaaatctgtgaactgagaacctcacttctctgacctcaccttccatctcccttaatcagacgcccacaaacctcagagttgtgtcccagcatcacttgttttgactgccctccccgactgccttgacttcgtatctgcctaggaacctgcctgtgtggacttttccctctatgtggacctttccctctatgtctaccggtgtccctgccaccagtggcatttgtcacctctgcctgggcagcccctcgtgactcgggttattgatggctgtgcctcatctccctgggaactggaactgtcctaaggaaagggagggtcgtgcctttttcttgataccccacgattccttgcacagcgtttctaccaggcgccgacatgccctccttggatgaatgagtaacatgggttctaggaagcccgcaccaatgcagatgtgacgtcctcagcctttcatagacatgtttcatgtgagaggtgggaagaacagctgaacagaaggctgagcactgtccaggtccagagtcaccaggagctcgttgtcaggttttcacttgctattagtagagatttttttttaaggtactatttttagtgttagaagtgaattcaggccgggcgcagtggctcacccctgtaatcccagcacttcgggaggctgaggtgggcagatcacgaggtcaaggagatcgagaccatcctgaccaacatggtgaaaccccatctctactaaaaatacaaaaattagctgggtgtggtggcatttgcctgtaatctcagctactggggagggctgaggcaggagaatcacttgaaccagggattcggaggttgcagtgagcagagattgtgccactgcactccagcctggcaacagagcaagactccgtctcaaaaaagaaaaaaaaaatgaattcatcagaaggcataataatcataaatgtgtatatgtctaatagtagagctttaaaataaatgaagcaacgctcaaaaggattaaagggagatcatgtcacccccttctcagcaactgatagaacgatcagatgaaaacagtaaaataacagatctgaacattgtcaaccaccttgacttaactgacatttatagagcatatatgcaacatctatgggagattccttctcttctatgaacatggtacttcaccaagatagaccacattgtgaactataaaacaaatctaaatacatttaaaacaaaataatataaaatatgttctctgatctcaatgaaattaaagtgttaagcaataacaatatctagaaggactccaaaaatgtgaatattaagcaacatacttataaataactcatagttcacgaatgaaatcaaagagaattcaaaatatttcttttttttttttttgaattggcttcttgctctgtcgcctaggctggaatgcagtggcgtgatcccggttcactgcaacctctgcctcccgggttcaagtgattctcctgtctcagcctcccgagtagctgggactataggcacctgccagcacgcccggctcatttttgtatttttagtacagatagggtttcaccatgttgcacaggctggtcttgaactcctgacctcgtgatccacccacctcggcctcccaaagtgctgggattacaggcgtgagccaccgtgcctggcctggagtttcttttggggatgatgatgaaaatcttcaaaaattgattttattgatggttatacacttctataaatatatttaaaggaaagaattacatcatatataaagtatatctcagtaaagttcttaaggattaaaagaagaatggtatcaaaatcaatgactcagaggtgtgcattacttacccgtaaaataagtataaattaaactcaaaggtagtaacaacatgacaaggaaataataagactgaaatcaatgaaatagaattcaaacaataaaaggaatcaacaagctaagagttggttctcagaaatgatcaacaaaattaataaaagtaataaactggccggacgagatggctcatccctgtaatcccagcactttgggaggccgaggcaggcgattcacctgaggtctggagtttgagaccagccggaccaacatggagaaaccccatctctactaaaaatacaaaattagccaggcgtggtggcacatgcctgtaatcccagctactccggaggctgaggcaggagaatcgcttgaacccaggagaccgaggttgcagtgagccgagatcacgccactgcactccagcctgggcaacaagagtaaaactccatctcaggaaaaaaaaaaaaaagtaataaaccaaactttaaaagaaaaaaagaacaacagcatgaaataccaatatcaagaattaatgatgggatgttattacaaactctacagccattaaaaggaaaatagtgggatcttatgaataactttatgccaatcaatttgacaacttggattaaatagacaaatttcttaaaaaacactacttagcaaaatagccacaagaaataaagataatttaaatattcctaaagctgtctatgaattggaattcattgtttgttttgtttgtttatttatttatttatttatttagttatgctattttttgagtcggagtctcgctctgtcatgcaggccggggtgcagtggtgcaatctcagctcactggaacctccgcctcctgggttcaagtgattctcctgcctcagcctctggagtagctgggattacaggtgcccaccaccacgcccagcatatttttagtagagacggggtttcaccatgttggccaggctggtcttgaactcctgacctcaggtggtcgcccactttggcctcccaaagtgctgggattacaggcgtgagccacggcgcccggcccccctgctcttccttttctaatttaactttctaatttaaaaaatctcccaattacagaaaagatgcaaaaattatactataccctttactttgaaccacctgagagcaagctacccacagaacgcacatcacccttatacacttgagtggatatttccaacaaataaggacattctcccgtataaccacaatacaatcctcaatatcagacagtaagcatcagtacattactaccagctaatcctcagaccccaatggttttcacttgtctttataatgtaatttattgcacagaaatcctgtcctgaataactatactgctctttcatctttttctgactctagtatttcatgggacattggcaggctgttttgggggacagtttgtaaagtgcctttttaaacctgaagttcattatttaatatttgattcagtatcctgctttttaaaaaatttacacatcacctaaccctcattagtaaaagcgtgtgtatgtctgtgtgtatgtgaacactgcccaatcacaggagaatatccatttttctcaagggtacatgaaacattctccaggacacactatatgttaggccacaaaacaagtcttaatacaattttaaaaattgaaataaaacaaactatcttttccaatcacaataaaaggaaattataaatcaatagcagaaggaaaactggagaatccacaaatatgtgaaaattaaacaacacttttttgctgttttttttttttgagacagtctggctctgtcgtccaggctggagtgcagtggcacaatctcggctcactgcaagctccgtctctcaggttcacgccattctcctgcctcagcctcccgtgtagctgggactacaggcacccgccaccacgcccggttaattttttgtattttttaatagagacgggttttcaccgtgttagccaggatggtctcgatctcctgacttcgtgatctgcctgcctcggcctcccaaagtgctgggattacaggcatgagccactgcgcccggcctaaacaacacattttaaaacaaccaatgggtaaaaaaataaatgaaaagggaaattagaaaatgtcttgggaggctgagctctgtagctcacgcctataatcccagcactttgggaggccaaggtgggcagattgtgggaggccccacccccctcaaaaaagaaagaaaatatcttgagacagatgacaggcacactaaaatctcagaactcaccactaaagaacttatccatgtaacaacaacaacaacaaaaagcagctgtaccctcaaacctatggaaattagaaaaatgtttcaaaagaaaatatcttgagacaaatgaaaacaatataccataagttacaggatatgaaagcagtgttataatggaaaatgatagctgtaaatgctcaccacattaaaagaagaaataaatgaacaatctaccttttacataatgaagtagaaaatgaagagcaaacagctgggcgtggtggctcacgcttgtaatcccaacactttgggaggccgaggtggacggatcacgaggtcaggagatagagaccatcctaacacagtgaaactctgtctctaataaaaatacaaaaaacgtagctgggcatggtggcgggcgcctgtagtcccagctactcgggaggctgaggcaggagaatggcatgaacctgggaagcggagcttgcagtgagccaagatcgcaccactgcactccagcctgggcaacagagcgagactctgtctcaaaaaaaaaaaaaaaaaaaaaaaaaaaaagaggagcaaactaagcccaaaccagcaaaaaatagatcagagataacagaaatagagaatagaaaaactgcagagaaactcaaagaaactgaaagttgacccttaagagagatctataaaatgtacaaacctttacttagatggactaagaaaaaagacagaaaacttaaataaccaaaaccagaaatgaaagaggggacatttaaaacaactttacagaaatccaaaggattataaaaaatactataaataattgcatgtcaacaaactagagcacattgataaaactggtaaattactaaaaacacactacctaccaatattcaatcatgaagaaatagagattttgaacagaactatagtaaggagatagaatccataatccaaaacttcccagcaaagaaaagcccaggaccagttggcttcaatgatgacgtctaccaaacatttaaagaactaacatgaattctcaaattcttccaagaaactgagttggagggaacactttctaactcttcgtgtgggccccgcattaccctgataatatagaagtgatgaaaggaggcctccatgtcttgttcctgatcttggagaaaaaacctttagtctttcactattgagtaggatggtagctgttggcttttcatatgtggcctccaaatgtaagatctataagaattatacaactcttgtaagaaaacagcaattttaccttggggtatatatccaaaagaattgaaagaaagggcataaagagattttgtacacccgtgttcatagcagctttattcacaatagctaaaatgtgaacacaaaccaagtgcccattgacagatgaatggataaacgtaatacatatacacacaatggaaaggaatgaaattccaatgcatggtaccgaatggatggatcgtgatgattttatgctaattgaaatatgacagcctcaagaaaaccataaaatactgtatgtctccatttatatgaagtatgtagagtagttaaattcatagaaacagacagtagaatggtagttgccacaggctgggggcatggggacaaagagacaaagatgagcacaaacaaatggttgagttttagaactgggagaaagatgcaagttctgtctaattttggaggcttgggggaatggaatgtgagattgatcttgtaatgggtgagatctggaagccactcatgccagtccctgctttgtccccacaggtcgtacctagctcagctgcaaccatcaaacttcatgatcaatcaattggcacacagcaatgggaacatagccctttgggagagttgtgtccaccaggtacattctaagactgatctctaatcctttacacctctcttttccttaccctatactatatacaaaaattatctcaaaattcatcaataacattccttttccatgttcttcaagttttctgtttcctacagtttctggttcttctattcaacagatacttattgatcctttgccaaatccaaggttatgaagctttatccccatgttttctcctaagagttttgtactttaactcttgatgcattttcagttaatttttgtaaatggcatcagataagcgtccaactgcattcttttgcatgtggctatccagttgccattcgttgaaatgatgatttttcccattaaatggccttggcatccttgtcaaaaaccaattgaccataaaggtatgggtgtatttttggactctcaattcttttccattgatctatatctgtcctctttccagtgccacacagtcttgtagtgagttttgacatcaggaagtatgaatctttcttttttgttttccttttccagaattattttgtttatgctgggctttttgaaattccatattaattttaggatcagcttgccaatttctaaaatcagctgagtttctcacagggattgtgttgcacctgttgctcagtttagaggttcctggcatcttaacaatgagaagtcttttgatcccaaagcatgagtttttttgatttatttaaatcatctctaatttttaaaataatgtttcgtagtttgcagactataaattttgggttgattttgttaaacttattcctagatatttaatacttttttatgctattgtggataaaaccttttcttaatttcattttaggattcattgtgagtgtatacaaatataattgatttttgtacattgatcttgtattctataaccttgcagaacttgtttgttattcttaatgtttttataatggcttccttaggatttcctctatataagaaaatataatttgcaaatagagaaagttttaccttttcttttccaatctggatgctttttatttctttttcttacctaattgtcctggctagagcctccagtaccatattgaataaaagtagtgaaaacagatatcttttttggagaacatctttcagttgttcaccattaaatataatgttagctgtgggtttttgtagatattctttatcaggttgaggaagttcacttttattcctagattattttgtgatttttatcatgaaagggtgttggagttagtaaaatgctttctctgtgtttttgagataatcatgtgacttttggttttcattctattgatataatttgttacatcaatttattttgggatgttgaaccaacctttcattcctaggataaaacttatttggtcctggtatataattcttttttgttttgttttgttttttgtttttgagatggagtctcactctgttgcccaggctggagtgcagtggcgcgatctcggctcactgcaagctctgcctcccgggttcacaccattctcctgcctcagccttccaagtagcagggactacaggcgcctgccaccacgcccagctaattttttgtattttttagtagagacggggtttcaccgtgttaaccaggatggtctagatctcctgaccttgtgatctgcctgcctcagccttccaaagtgctgggattacagtcgtgagccaccgtgcccagcctataattctttttgtatgcttgtggattcaacttgctagtattttgttgcaaatttttgcaacaatattcataagaatcgttagtctgtagttttctttctttatgaggtccttttctggtcttcatattaagctaattgtattagtccgtttatatggtgctgataaagacatacccaaagctggcaatttacaaaagaaagaggtttaattggacttaacagttccatgtggctgcagaagcctcacaatcatggcagaagacaaggaagagcaagtcacatcttacttggatggcagcaagcaaagagcttgtacaggaaaactccaccttataataaccatcagatatcatgagacttactcactataatgagaacagcatgggaaagacctgcccctgtgattcagatatctcccaccaggtccctcccacaacatgtgggaattcaacatgaaatttgagtgagaatgtatccaaaccctatcacccctggcccctcccacatctcatgtcctcacatttcaaaaccaatcatgccttcccaacagtcccccaaagtcttaactcatttcagcattagctcggaagttcaccgtccaaagtctcatgtgagacaaagcaagtcccttctgcctatgagcctataaaatcaaaagcaagttagttacttcctagatataatgggggtacaggcattggataaatacatccattccaaatgggtgacattgtcgaaaacaaagggctacaggccccatgcatgtttgaaatccagcagggcagtcagatcttaaagctccaaaatgatctcgtttgactccttgtcttacatccaggtcacactgatgcaagaggcgggttcccatagtcttgggcagctccgcccctgtggcattgcaaggtatagcgcccctcctggctggtttcacgtgccggtgttgagtgtctgcagcttttctaggtgcacggtgtataagttatcagcagttctaccattctggggtctgaaggacaatggccctcttttcacagctccactaggcagtgccccagtagggactccgtgtgggggctctgatgccacatttcccttccacactgccctagcagaggttctccatgagggccctgcccctacagcaaacttttgcctgggcatccaggcgttttcatacatcttctgaaatctacgtggaggttcccaaacctcaattcttgacttctgtgcacctgcaggcttaacaccatgtgggagctgccaaggcttggggcttccacctctgaagcaacagcccaagctgtaccttggccccttttagtcacagctggagtggctggaatgtagggcaccaagtccctagactccacacagcacaagaccctggactcctaccaggaaactattttctcctaggccttcgggcctgtgatgggaggggctgccatgatgacctctaacatgccctggagacattttccccattgtcttggggattaacactcagctcctcattacttatgcaaatttatgcagccatctttaatttctcctcagaaaatgggttttcttttctagcacattgtcaggttgcagattttccaaactttaatgctctggttcccttataaaactgaatgccggccaggcgcggtggctcatgcgtgtaatcccagcactttgggaggccaaggcaggtggatcatgaggtcaggagattgagaccatcctggcgaacacggtgaaaccccgtctctactaaaaatacaaaaaaattagccaggcatggtggtgggtgcctgtagtcccagctactcaggaggctgaggcaggagaatggtgtgaacccaggaggcggacttgcagtgagccgagatcatgccactgcactccagcctgggcaacagagcaagactctgtctcaaaaacaaaaaacaaaacaaaacaaaaaaagaattatataccaggaccaagtaagttttatcctaggaatgcaacattggttaaaaacaaagaaacaaacaaataaacaaaaaaactgaatgccttttacagcactcaagtcaccccttgaatgcattgctgcctagaaatttcttctgccacataccctaaatcacctcttcccagttcaaagctccacagatctctagggaagggacaaaatgccaccactctctttgctttctttgctaaaatataacaagagtcacctttgctccagttcccaataagttcctcatctccatctgagatcatctcagcctggactttattgtccatatcactattaggcttttggtcaaagccattcaacaagtctctaggaagttccacactttcccacattttcctatcttcgtctgagccctccaaactgttccaacctctgcctgttatgcagttccaaagttgcttccatattttcaggtatcttttcagcagctccccactctactggtaccaatttactgtattagtttttttttttttttttcgtgctgctgatgaagacattcccaagactgggcaatttacaaagaaagaggtttaattgaacttacagttctacgtggctggggaagtcttacaataatgatggaaggcaaggaggagcaagtcatgtcttacatggatggcagcaagcaaagagagcttgtgcaggaaaactcccccttataataaccatcagatcttatgagacttactcattatcatgagaactgcaagggaaagacctgccccacatgattcaattacctcccattggatccctcccacaacttacgggaattcaagatgagatttgtgtggggacacagccaaatcatatcagtaatattgtccttatacaatgaattggaaagtgctccttcctctgctgtctttaaaaagggtttctgaataattggtattaattcttcttgaaatggttggtatcattcagtggtaaaggcatctgggcctcaactttgtttttctggtgaaaacatatacatgtatttagaattagccagctggattcagtttagatgatcccaattttgttggcaacatccaagacatggtaatcaggagccagtcgaacatatgccttcttctctccatcaggcctaatcagggtgttgaaccttggccacataaacatcatagagcttcttcacaacctgtttgatctggtgcttgttggttttaacatctacaatgaacacaagtgtgttgttgtcgtcttctatcttcttcatggcatactcagtggtcagtggaagcttgatgatagcatagtggtcaagcttgtttctcctgggggtgctctccagagtctcagtatcttgggccaccggaaggtgggtgatgtatggatattctttttttcatggcagtggacacctttctacactgccttcttggccttcaaaacctttgcatcgcttcagctttaggaggggcaggagcttccttctttgctttcagtgccatcttgtgaaaacgacttttctttaggagtagttttgataactaagtcaaaatctttacttgctatatgtctattcacattgtctctttcatcttgattcagtttcagtagtttgtgtctttctaggaatttgcccctttcatccaaggtacctaattttttgttgtacaggtttcatagtattcttttataatttttttatttctatataatctgtagtaatgtgctctctctcatttctgattctaatacagtcatgcctcagttaatgatgggaactcattctgacaagtgcatcattgtgcaaacatcatagagtgtacctccacaaacctagatgatatagcctactgcatccctaggctatgtgatatagcctattgctcttagattacaaacctgtactagtagacaattgtaacacaatgataagtatttgagttcctaaacatgtgaacatagaaaaggcccaataaaaatatggtataaaaggttaaaaaagatgatgtagttgtctagggcacttaccatgaatggagcttgcaggactggatcttgtctgggtgagtcagtgagtggtgagtgaatgtgaaggcctgggacattcctgtacactactatggactttataaacactgtacatttaggctacaccaaatctgtaaatttttttttccttccttcaatattaacttcgtgtaactattttactttataaactttttaatttttaaaactttttcactcgttttaacacttagcttaaaaaacaaaaactgtacagctgtacaaaaaatgttctttctttatattcgtattctataaacatttttgtatttttaacttaaacttttttttacttaaaaatttttttgttaaaaactaagatagaaacacagacattggccgggcgcagtggctcacacctgtaatcccagcactttgggaggccaaggcaggcggatcacgaggtcaggagatcgagaccatcctggctaacacagtgaaaccctgtctctactaaaaatacaaaaaattagctgggcatggtggcaggcacctgtagtcccagctactcgggaggctgaggctgaggcaggataatcgcttgaacctgagaggcagaggttgtagtgagctgagattgcgccactgcactccagcctgggtgacggagtgtgactccttctcaaaaaaaaaaaaaaaaagaaacacagacattaacctaggtctacacaaggacaggttcatcaacatcactgtctttcacctccacatcttgtcgcgttggaggatcttcaggggcagacacacatggagctgtcaactcctatgtcctctgataacaatgccttcttctggaaaactgcatgaggctgttttatagttaccttttttatttgtaagtaggagtacactctaaaataacattacaatgtatagtatcaaaaatacataaatcagtaagtcatttattatcattatcaaatattatatatagaacttcattatatgtgctatacttttaactggcagtgaagtaggtttgtttacatcagcattaccacaaacacctgagtaacgcattgacttatgacattactaagcgataggaattttcctcctccattataatattatgggaccaccgtcacatatgtggttcattgttgaccgaaacgtcatcatgcagtgcgtgactataatttgagtcttattttttccctgtgctaattttttaacacaattagttgtgccaatatatcgatctatttaaagaactagattttgagttcattaatttactctgttgtttttctgttctccgtctcattaatttctgctctaatctgtattattttcttccttctgcttgctttatctatagtttgctcttctttttcgagtgtcttagagtggattattaggttatagattgagatatttcttcttccttaatagacatttaggaaggatatttcttcttccttaatagacaatttctctgtaaacttcagctacgttagctgtatcccataggttttggtatgttgtgtcttcattttcattcgtcttattttctgatttctcttttgatttctttttagaccagttggttatttaggagtgtgctatttaatttttatatagctgtgatgttccccagtttcttcctgctattgatttctaattttattccattgtggtaggagagtgtattttgtattatctctatccttttaagtgtattgaggtttatcttatggccaagcatatggtttattttggagaatgttctatgtgcactttaaaagaatgtgtatcttgttttgattgagtagagtgttttatagacatctgtccagtctagttgttaatagtgttgttcaagtctactactttcttgttgatgttctttctagatttttttggtatgaattcctataggttaaggaaactatgctttgcagtgtggttttcattgcaagtattttctcctactttgttttcatcttagtcaagatttcttccatgcagttttcttcctaattttcatatagttaactttatgcaactttttagtttctcgtgagactgagaaggtcctttctctctccaaacttgtaagaaaaatttctcatgcagtacttgtgtgatttcatactttacagttgacaccttgatagacctagtctctatttccttatagggagagcataagcaagaagctttattatttttcagcagtaaccttagttgccccagcgccattactgaataatcatatttttatcatcgatagtgtcatcatcataacacatcagcaaggaagtttttccttcacagtggcacggtggctcactcctgtaatcccagcactttgggaggccgaggcaggtggatcatgaggtcaggagatcgagaccatcctggtgaaacctagtgaaaccccgtctctactaaaaatacaaaaaattagccaggcgtggtggcacgctcctgtagtcccagctactcgggaggctgaggcaggagaatcgcttgaacccaggaggcggaggttacagtgagccaagatcacgccactgaactccagcctggtgagagagcgagactccatctcaaaaaaaaaaaaaagcctttattatttttcagtagtaaccttagttgccccagcactattactcaataaccacatttttataattggtagtgtcgtcatcgtaacacattatcaaggaagttttttttccacagtttgggttttctaagagtatctttcaatatcagtaaatatgaatcagaggagagggataaataaatgggcactgaaaggggagagtgaggtcacctgaaggggcgaagccctggaggtgaaggtcgagcctccagacatgggctcccgctggcgacagctcctgcaggctgtcacctcagtgcctggagaccctctgcaatccagggcagcatgaggtaggccttctttctgtggatcattctttgactctgtatagggaggaccctttttccttccattttcctcccatggcaggtggcatgggctgtatctgaagccttcccctcatcgctgtattgtttctgcgcctgtttgtaccttctactgaccaagagctcactgagggcagggattaggactttttgtgagtttccagggatgcaggtggcattgccctggtctctaggcctatgtggccattaatcacttaaaacacagccactttgaattgagatgtgcagtgagtgaaaaatacactctgggtttcgaacacttagtattcaaaataaaagaaaatatctcaatgttttatcttgtttacatgttgaaatgctaatgttttggatattttaggtccaaaaagtacattgttaaaattaatttgacctcattctctttttactattttaatatggctctcatagaatttgaattttgcatgtggtttgtattgtatttctgtcagcagcgccagtcagaggtgtgtatagatgcagaattgacgacaagaccaagccaagaagatgggatttctctgtctggggtctactgatggccaaaagaagagtttcctagccaccgccacgatcctctgggaactctgtggcaattcattcattggcttttctctcccttcccaggatctcatagatcagaacatcctggagcctgtaaccggtgcacagagggtgtgggttacaccaatgcttccaacaatttgtttgcttgcctcccatgtacagcttgtaaatcaggtacagaatgtgtggacctcttgtccagaggtggagtgaggggcagtgaggtgggagtggtagccaatgtgagtcagggaaccaagttccagcccaacttggtcttcatcataccctgttccatggttatgtcttaggtccataaaatgaaacagaaagaaatcatttttataatgcatgccacctggtagtgcaaactatcagctccaagagggtaggggcatcattacagcacaaagaaggcctggctgagtggacagggctgagtttcagcggtggtacgggtctgctctggggccacgctccccctgggctgtgtgctcctggcaggttctcaggctcactcagccttcagtttctcaggcgcctccctcttcctcagcaggctgggtttttgggaagtcacccaagggctcctcttcttgcagactctctcacataccatgtgcctcctttgctactgaccatgcgatctaaatggtgctttttccctaatctgatgtaataaataatgaatcatggtccttttgtatgactccaagtgttggtgacagctgaagggtgggtgtcctgtgtgagcccgagtgtgctggtgcagaatctggccctcagaactccttggcaaactgagttgagctgagctgagggggagggagttggggtggtgaggaaaggtcaagggacacgtcagggaaacacattcccaaaaccttgtactctgtcatcagatgaagaagagagaagtccctgcaccacgaccaggaacacagcatgtcagtgcaaaccaggaactttccggaatgacaattctgctgagatgtgccggaagtgcagcagagggtgagacaacagccaaggggctcccagcagcctcaaagaacccacagaagcaaggaaccctaaaaagacccgagtctccttgtacccgtatctatcagccctgaccccatggtgcctccacccccataggtgtccctgagcctgtggcgtctcctgagcctgcaacctgcccctcctggtccatctgcctgtccccacccctgtcccctgcagtggccccttctcacccctccccagcactagtccccttggccaggctgacttgttcactaggcacaggaggccatgacttagggcccacaacagaggtacatgaaatattttatcttgaaatcataagaaaataatggtatagaatccagctggggttatatttatatttaaacaaattgagtcataaaatgtaatttttaatatttgcttttaattcaagaagacagaaatgcccacagcccgcaaaaatcataataaggccatgggtggagctccttcaagttcccatgaggacctgagcccacccagccagcctcacccctggcccctgatttctcaataagtcctgtctttttcctattttggttttggaagcaaagagtaattgctcttctctggtcctccagtgtttgctgtgattgagaggaaccagcagacaggtgggggcgagggctcacttgtactgtgggttaactggaggaaggggctcagcttgtggccacacgggcttgtgatcttcccctggagtgtgattcctcctaacgcaggcctcccctgcagcccagggaagattagtgtgtgcccagcacagaaggctcctggaactgcagctctgaccccagagcagggaggccaagggggtaaagtgtgcatgctcagacccttccccagcctaaacaagggagcatagggggaccccctgcagatacgaggagactatccttcccctgacgccttctcagggacattgggcagggagagtggctcctctttcatcccacctggccagctttccatcaagagtcccccccctccctccctgtgtgtacccaggtgccccagagggatggtcaaggtcaaggattgtacgccctggagtgacatcgagtgtgtccacaaagaatcaggtacaaagcccactggggaagccccagctgcagaggagacagggaccagcagcccgagactcctgtcttttcctgtcttttctcaggcaatggacataatatatgggtgattttggttgtgactttggttgttccgttgctgttggtggctgtgctgattgtctgttgttgcatcggctcaggtaggtgctggctgagggcaagggctctgggcactctctgccctgccttcttctgttcccacagacagaaacgctcacccctgccccaagtcctagtgtctctggccgggctctatcttcctccttgtgatcaccccccatcctcccatcctgtgcaaccctagggccctggtgtcatccgtccctctcccaaggctgggggtcccctcatctcccagccaagtctgggaaggcagggccagttcctccactggtcaggcccatccaggcagggggcagtcagctcctcaactggatgacaagagtcgagacgagaagtggttgtgggatttatgtagctttgttcagagcaaaacacagagcagaaaacagtgatgttccacttgtttgtttttagcctacttccctttatgctccccgctcctgaaggatctcccgagttagcagggcctcatgtggatccccaggcccggggatctttgtccagtgtcccagcccccagcccacccctgcccaacactgccctctaagaaggagtgctgcatgggcccctccctggccactaagggaaccgtcttctcttctaggttgtggaggggaccccaagtgcatggacagggtgagttgatttctccaggagctgggggcatcaggggctcaggaactgcttcttgcccacagtgtagtccaggtgggtgggtccccgtgctctcatggctgccctgagtctctgaagtggcctggatgctgtgcattgactatgggggacacaggcccttttgagcatcatacaggctggtgggccattctgtagccctgtgcttcctacagcccaggtgagacccttaccccacagcctgtaccctggggatggggtgagcccccaagcccagcaccagggcctggccccagcagcaggtcctggatgtgctgagcatggacttcctggagtgacctcactgggagggggtggtggcagcaggtccagccgtgccctacggaccccgtggggagccctgggtgtgggcttctgagttggctctttgccttcctaaggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctggtgagttggggacaggcccctccaagaccttgtaggcagggggtgaaggccatgcctcggctctcctggtcaaaggggaagtggagcctgagggagatgggactgcaggggacggggctgcgtgggaaaaagcagccaccctcacaaggggacaggcactcttccaaatgtctgcttcttagtccctgtcctgtccttgccatgtcctcagaaactggagctccagaggaatagagtgggggtcacagggtttgttgatgactgaataaggctgcacggtctccactgtgtgctcctacagaagttagggagcccttgctcataacagcagggattttaaatttactctgaaattattattgcattaaacatatttggatctaaatctctgcccaaatttctgcatatggttgtatggaggattccaagaagaagcacaatttccaagtcagcctgtaacagtgctgcttactgtgtacacgcacatacacgcacatgcacacacatgcatgtacacacatgcacacacacatgcacgtacccacacatacaggtacacacatgcacacagccccctagtgttggtttgtaccagttcatgtattttgatttgacattgaagggctttttcttttctttttttttcttttttttgctatttaggaaaacattgttttaaacgaacatttctttgttttcactgtttttgcgtaagatcagtgtcttgtctctcagagtctttatgagaaggcctgctctcctactcatgctttttctcacattcagacagtagattcctaatttcttcttgcccctttttgttctaatattttcaggtgtagaagctttaatttttaaccagtgaaatctgtagatacttttaccttttcattgctcactactgtagaaagaccttttgccaacacaagacgaactcctctaacttcttatggagatatttttttcaatgatgtgatttttgcatataactttataatctaaatggaacttgttttgtgtttcagtgcaaagcgaggcactccctgaattgttctagtcactgtctggtttttccaacccctttgagctgccgattctcccatttccctctgctttgggtccctccttaatcacaggttaaatgctcatctagacaatgatctccttccacctagactgttccattcagttcctttcttgcattagtacccatttattctaaccaaaaatgtaattaaaaaaaaaagaaggcaaacattaaaaaggtcaataatctccagcttgataaggtgctttgacatgaacaaatagtttatatatttaaaatgagaaaatttaaactatcaaaaggtactcagtaagtaaagagagcatcctccactctgcagtgccctgggtctttttcctcaagtaactatgagatatcatttcttgtgattctttgtccaaatctatgcatcagtgtatgtgtatacaaaagacattatattattaacgaatggtccccaaccttttggcaccagggaccagttttgtggaagacaatttttctatggactgggaggtgaagatggtttggggatgattcaagcacattacgtttattgtgtactttatttctattcttatcacattataatatataatgaaataattatacaacttatcataatgtagagtcagtgggagccctgagcttgttttcctgcaacgagatggtcctatctgagggtgatgggagacggtgacagataatcaggcataagattctcataaggagtatgcaacccagatccctgacgtgcacagttcacaatagggtttgcactcctataagaatctaatgttgccactgatctgaccgggtggagctgaggtggtaatgccagcaatggggagtggctgtgagctatgtgggaccagaggtttttcaccatctccatggtgacccaagggggaaagtgatgtgctgcaggtttccgggctggctgatggtcagagtcagtactagactgcaggacccctgactcagaccaaggcattccccactgtgtgttacagggaccggcagaagctgaagggtctcagaggaggaggctgctggttccagcaaatggtgctgaccccactgagagtaagtgttttgctcctggagatgcagcagaaatggtgggaatagggacggtgtcctaactggtgtccccattgctgagagtgctcttccagagcattccatgccagaaactgggggtcctatgctatagaccatcaagaccctaaattgtcttctcccatctcttcttcccactctacctcatcctttctgcaccctattaatgacactagccactctgtctatcctcttctccacctcctctcttctcctttgttgttcaggagaacaacagccctgaggggctgccctgtcctgcatggcaccactgacttcagtgggctaatagctctttatctgtgcctaagcccaatttgcagagctgttgtataaactacatactgattccaaagacttaatgcaagaaagaatggaaaatattccactcattattttgttaccgaaacaccaggtgttgggtctaggtcttggtgctcactgcacagagggccaatcactgagacaattagtattgacaaggaagaatactttcattgagtgctgtaggcaaggagatgggagctcagtctccaattcatgtcccctgatggactaaaactaggggtttatatagtagggataaaatgtaacaatgtgggccgggcacggtggcttatgcctgtaatcccagtactttgggaggccgaggcgggcgaatcacaaggtcaggagatcgagaccatcctggctaacatggtgaaaccccttctgtactaaaaatacaaaaaaaaattagccaggcgtattggcgggcgcctgtagtcccagctattcgggaggctgaggcaggagaatggcatgaacccgggaggcagagcttgcagtgagccaagatagcgctactgcactccagcctgggtgacagagcaagactctgtctcaaaaaaacaaaaaagtaacaatgtgtaagaaaacaggaactagggaggggtaaggaagcaatcaagatgaatgaggggtccagcatcccattggatgtagtgatttgtaagtttcagttctttgatactttgagaggcctgaaggtcatttcctgaaaaaggaactcagataaaacaaatgtaagatttgagctttaagaacagaagggtcaatttctatgtttatcaaaacaacaacaacaacaaaaaaaccttttgatggacatattgggttgatttcagttctccctttctatttatcaatcccacagtcacagagagtctggtcctggatctttctggctgcttcatggttgaggaggggcatcatgggaagcttcacataccatgggtgacctcatggccacccaggaatcaaaggttaatttaatactaaaagattgtgtttcttctgaaacacaatctctctctctcggccccacttccaccaaagacaaattatagcaggaccaatgtacctgcaaaataagtttagttccatatacgtggcctgattacccacacaaagtgcagcaaaaatcactgtccacataggctctcctaagttggctttgctggaacctctcacgaggccattgcaatcaaagccctgagaaaataaccattttatccaactgtgttccattgtaaaagaaaacgttgttattaaccatatgtaagcaaacacattgccatgaattaatagtcacaaataatttaaaaattctagagaaattaggcagagagagaaatatgcctcaaattctgtttacaaaagtatactcaatatacttaaagtatacttaaaggctataaatagcaaagaagaaaaaagttctccagactggaaaacaaaaccaaaagaatcagcaatatttcaaaccaacaaaagccatacgaattatttcagtcctctattagttcagtccactcaatcagctcctgcccagcttcatgtttggttaacaatcacaatctttatgaacacatcagtctttcttctttttttgttttgagacagagtctcactctgtcacccacgctggagtgcagtggtgcaatctcatctcactgcaacctccacctcctgggttctagcaattctcacgcctcagcctcctgagtagctgggaccacaggtgtgcaccaccacatctgggtactttttgtatttttagtagagacagggttttgccacgttggccagtctggtctcaaactcctggcctcaagtgatagacattcgcctgccttggcctcccaaagtgctgggattacagacatgagccaatgcgcctggccacacattggtctttcagttactgcactggaagttttctctgtaatccaatgacaacaatttttaattatatgaaaaatttacttaaaacatcccatttacatttactcaattctttcatttttaagtttatccagattgcttctgaaaattgagatattagacaccatcatttaaagttagttaatttctttgtcagccatttttttaatagccagtgaacatcaggtgctcacctaagagcttcaaagttaaatatatagatattttcaccaataagtcagaagactcagctgttttcattaaaccaacaacattaatttaatcttacttatcaaaagcttgactcaaagatcattttgttttggttgggcttgtagtcttaagtttttgtgccaaactgatatctcaaaatatctagcaaagacaaatataagcccagacaaaaatgtatgctgacaattctgaagacacttctgttttcttattttaccaataattttaaagctgacttgtttagtaaggatttacttaagtcacatgaacttgaaaattgcttggaattatttactttatttatgagtactcttttacttataagtcaatttggtagacacaacatgtaacttaataataaatgtacatacacataaacacatctagacctatatgcacacacaaagatccaatagcttttacctttgaactctctccatgagacagtaatacaaactcaccagtctacaaatatgttcacatggctgaaatttgttagctccaatagataattcagtgaaggttgtgaacccaaattttaggtaaagcagtttccatggcagtttgatttttaaaggccaaacctctgcagactccaaacagcatcgcagagaacaccacctagaaccaactaatcaggcccaatgctgcttagaacagcaacataaaagcctggatacaggaactccatcctactttctcattcagcagcaaacttcagtttccaagcaatattggagccaaacagtattacaaaagaataccaagtttactgaattccaatttcccatgactctagcaaacacatagaaataatcaccaaaacataatacaactgctgcagcaacaaacaagctccaagagtgtccagactgaaacaggcagggtgcttcctctctccattggttaggtttgatcaacctgccaacaaaaattgctttcaaatttctcaaattgagaggagccagtcgtgctgcctggtacccacaaaagacactcacttgccctgaaacaacacacaattacaaacaagcctccaagagtgtccagactgaaaggcagagtgcttccctctcacagtcacttgggcctgttcaacctgcaaatggaaattcctttaaaaatttctcaaactgagaagagcagatcctgctgtctgggcccacaaaggacaatcacctgtctggatgcaaatgtcaaatttcaaaggcagttcttcggaagtaatcaggaatgtggttggggccggctgcagtgggacctgagagagactgaaactcacctccagccaaagttagcggggcaactgcttgggagggcttctgagtctcctggcccatggcagcagagccatgagcaacactttcccagccagggaaccaaaacctgttaccaaaacctcaggggtttggtctaggtcccgctgctcgctgcacagaaagccagtcactgagatgatgagtattgccaagaaggctttaatagggtgctgcagtggaagagatgggagctcagtctcaactgtatctccctgaccaactaaaactaagggtttatataggaggcaagaaatgtaacaatgtgtaagaaagtaggagctagaatggggcaaggaaacaatcaagatgaatgaggggtcccacatcccatcatggtctggatgtagtgatctggtgagtttcagttctttgctactttttttgagatgcttgcaggtctttcctgaggaagtaactcagataaaacaaatgttaagtttccagtcgttaaggaccagaagggtcaatttctgtttatcaaaaaaacctttctatgggacaattgggtcagtttcagtttttgtatactcattgcatattaaattatattttacacatattcagtaccacacattaaaatgaatgtcacttttttctttttatgttctttaaatgaggctgttagaaaacatagcttggtactcctggccccttctatccctgtggatggtggtgtgcagtgctttgcacacacatctcatttcattcaatccctggtagtcctgagatctgggcaggtttgctctgtcttcaggtttgcttcttggtcagggcctgcttgcccccacctagctctgccccagcctcagggagggcagaggtcccctgccccagaccctgcactttccacagatgcagaagtggccaccctgggacatgctcccatgacaagcgcagcccaggcagcccgcatcctctgagctcccgctgcagccactctccctccctccctcgggctctcacccactttgctttctgcctccgtagggtcaatccatcctccccaggtgggttctcagccctctctgagggcagattctctggtgaccttgacgcccgtcagcgccttgggggccacagaggccaggcagtgtgggtgggctctctgtggatgggaggtgggtgggcaatggagcaacaggtttgcccatgcagggggctctccaggttctctccttgggttctgggcctgatgtgggatcctctgccccttctgaactgagtcccaactcatctggctgtctctgtggctttctccacccagctctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaagagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactgga

SEQ ID NO: 116 - DNA, 54269 bp, Homo sapiens
gtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatctccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgccgcccaggctggagtgcagtggtgtgacctcggcttaccgaaccctggccccaccgcagactcaacctcccaggctcaagtgattctcccacttcagctccccatctgcgagtagctggaatataggtgcgcaccaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacaacctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagagaatattcgctcccacctcagcgtaggaaacaatgaaaccctgaaacatttatttatttattttccttgcttttcttttttctttcttttttttttcttgagatggagtcttactctgtcactcaggctggagtgcagtggcgtaatcttggctcactgcaacctccgcctcctgggttcaagcaattctcctgcctcagcctcccgagtagctgggacaataggcatgtgccgctatgcctggctaattttttgtatttttagtagagacggggtttcatcatgttggccagactggtcttgaactcctggcctcaagtaatctgcccgctttgggcttcaaaagtgctaggattacaggtgtgagccactgcacccagtcttttccttactttttattttatttatttatttatttattttttaattgatcattcttgggtgtttctcacagaggaggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtatagaacaaaatgaaaagtctcccatgtctacctctctctacacagacacggcaaccatccaatttctcaatcttttccccacctttcccccctttctgttccacaaaaccgccattgtcatcatggcccgttctcaatgagctgctgggtacacctcccagacggggtggtggccgggcagaggggctcctcacctcccagtaggggcggccgggcagaggcgcccctcatctcccagacggggcggctggccgggcggggggctgaccccccacctccctcccggacggggcggcttccttactttttaaaaatacgtttgtcttcaactattggatatcttcatctaatttctagtgttttttttggttgttgttggcttatttgatttttactttttggttaataacaaaccttttaaggagttacatagactcttatcagtttacttttctaatttgttttctcctgaattctcagttaccttggattgattgtgctttgggttcatcttgctttttcttagtggctactttcagtttccttcctcttcagtttggcaattttttcccttttcaagcaaggagctcctccctgttgaggcgtcacgggtggcgggcaatccttacccggatcctcccacagcttgctctctggaagctcacactgcaccgtaattatgaaacttttgatattgtccctgatggcttctgatgcaagctgggacagcatttgtctgttgataagtgaaaccaagttcctgagatctggctctcttttgcccttctatccaataccagcaaggccctagtttcagagcattttggggacttatgatcccttctagttacctctgcatctgtgccccttttcccctcaaattagttcatagagatttttgaagcacccatgttactcaaataggcccatttttagcatgtgggaggtaaggcctagatgtgaatccctcataagccaggcagatcaaactgtgtgtatgcatgcagatttggcccaggaacactcttctccttcagggcccattgtctacaaggacagaaaagaattcttaaggccattcactatctcacattttctgttatttttctgtcttttccttttccccctacccacagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactggataatctagaagaaatgaataaattcacaaaaccttccaatctacgatgactgaatcatgaagaaatacaaagtctgaacagacttataactaatgtggaggtttagtcaataatcaaaaatgttccccaaacgaagaagtccaggaccagatggcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaatagagtctcaacatcatcaagaccatatataagaaaattttcactgttgagtattatattagatgtgagcttttcatatatgggattcataatatgtttcaaatatattacaaagctatagtaattgaaacagcatgggaatagcataaagacaaacacataggccatcagaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatgacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactatttacagtagccaagatgtgcaaacaacctaaatatctaggatggggaaagaaaatgtggtagtcacataaaatggaatattatttgccttataaaggagggaaattctataatataagacaacatggatgaatcttgaagacattatgctaagtgaaataagccagtcaccaaaagacaaatactgtatgattctacttacatgtggtatctaaagtagtcaaatttatagaatcaaagagtggaatggtggttgccaggggctggggaggggggaaatgagttgcctgtcaacaagcataaagttttagttaagcaagatgagtaagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactcactttgcaaggtgcacatagccttgaatccacaagcataatgtaaataatttacttttaagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctaaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaaaaaaaaaagtttctcttctgtacattgatatccatcccttgaaaataaccaggcaaagcaacaaagccactttatggaaaacattgaattagaagcctcaagttgatagtgattattttttgcaggcaaaaaaatccatgctcagcaccaaagggataactgatgaagagggttactgtctctcatgctttgttttttaatagctaatctaatctctcacctatctgagtctttagaaaggaattgaagggggtggggggcccttgtagggttccccagagagactgaggctgtgcaataaaaggaagcaggtagacagtctgatcaaatatgcagcgcaaatgatgactgcccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatagggcgtccatcatatatgccccatgcttgggcccattgatgtgtggcttgggccacaaatctggggccattatcagatgcattctatgcctgggaatcaaccatctaagatctgaaattgtgtcaccgattgattgacctgacctcacaaggaggttttttatttgtttttgtttttttttttgagacagagtctcactctgtcacccaggttggagtgcagtggctcaatctcactgctacttccatctcccaggttcaagtgattcttatgcctcagcctcccgagtagctggaattacagacacgcaccaccatgcctggctaatttttgtatttttagtacagacagggtttcaccatgttggctagcctggtctcgaactcctaacttcaagtgatccgcccacctcggcctcccaaagtgttgggattacaggcgtgagccactgtccccagccactggacttgataaccatccggagtatcatgaacaaagctagaaatctgagtctggttgcaacctcatcatctgctgcttccacttccttatcatagacccaggggaccaccagtgtagcctgccacggctccaggtttggagtgaggcgtaggttccaggcagctcctgttgaccctgctgctgcaggccaggtcagctgtccttgcccaggtgtgaatcatgggcatgtatctccctgctgggcttccgctttgctgccctttcctggccctttggccagagagagcaggcttttctttctgttgcttttccttgtttgttcttttttttttttttttttttgagacggagtttcgctcttgttgcccagactggagtgcaatggtgcaatctcggctcaccgcaacctctacctcccaggttcaagcaattctcctgcctcagcctcccaagtagctgggattacaggcatgtgccaccatgcccggctaattttgtatttttagtagagacggggtttctccatgttgaggctggtctcgaactcccaacctcaggtgatctgcctgccttggcctcccaaagtgctgggattacaggcgtgagccactgggcccagccatttgttctttctaatttaggcctgttggtggttctggattgcaggcctctttcgttttcagtctggcatgtgtgggaataaaaagacagcccagggcacaaaacagggtgttgttcctgcctctgggtcccccgccagtctgcctctactttccacctctcagggttgtgtgattgtctgttgatttattcccagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcaccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttgggaggccgaggtgggtggatcacgagatcaggagttcaagaccagcctggccaagatggtgaaaccctgtctctactaaaaatacaaaaactagctgggtgcagtggcaggcgcctgtattctgctagggagctgaggcaggagaattgcttgagctggcggggtggaggttgcagtgaaccaagatcacaccactgcactccaggctgggcggcagagtgagactgtctgtctcaaaaaaaaaaaaaaaaaaaaaaaaagaagaattttaggaagaaatctatctgattctagaattatctaggctgttgaggatgtgtgtctggtggccactgggacatcagggtgagacttttcttttaactgcatgtatgtgaattaggttgcttctggagcctactgagagctcactgggtccccatagcatccatgctgaaggcgccttccttctgtctgtgaccttgaccctcagctccacatttccccaggggctgcaggatttctcagaatcctcattagcacaacctatttttttttttttttttcctgaaacagagcctcactctgttgcccaatgcagtggtgtgatctcggctcactgcaacctctgcctcccaggttcaagtgattctcatgcctcagcctcccaagtagctgggactacaagcgtgtgccaccattcctggctaattcttgtatttttttttgagatggagtctcgctctgttgcccaggctggagtgcagtggtgcgatctcggctcactgcaacctccacctcccgggttcaagggattctcctgcctcagcctcccgagtagctgggactacaggtgcccgccaccacacctggctaattttttgtatttttagtggagacagcgtttcactgttttagccaggatagtctcgatctcctgacctcgtgatccgcccgccttggcctcccaaagtgctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatgttggtcaggctagtcttcaactcctgacctcaggtgatccacctgccttggcctcccaaagtgctgggattataggtgtgagccaccacgccctggtcaattgcttcctttttatatttagattgactatccatctggatttgaattttgtgtgggtaggaaatcaaggctcattttatttttatatggctatcttgttgatctgtcgttatttactataaagacgatccttttttcacttcacctcattgtcacctttacccatgtatcaagtgagaatagagtgtgagactttaaaaaattaatggattattttttaagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaagagatacctgaggttgggcaatctataaagaaaagagttttaattggctcatggttccacagactgtataggaagcatgatgctggcatctgcttggcttctggggaggcctcaggaaacttacaattatggtggaagacaaagggggagcgagacatctcatgtggctagagcaggggaagcaagagagcggggaggtgccacatatttttaaacaaccagaatatcatgagaattctatcatgcaaacagcactgtggggatggtgctaaactattagaaaccacccccaagatccaatcacctcccaccaggctccgcctccaacattaggaattacaactggacatgagtttgggtgaggacacaaatccaaaccatgtcagtcgtggtgccatattttgtggtagcacgtcctgaatcccatcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagctactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgagactccgtctaaaaaaaaaaaaagcttcatgacaaacttccagactttcttccaaagtgtccgtatgagttttcattcccacgagtaatgaatgagagttcctgttacttcacatccttgccaatgtttggtggtgtcagtgtttcggattttagcaattttggcaaatatgtagtggtatctcactgttgttttaatttgcaattccctaatgacatatgatgttgaacatcttttcatatgcttatttgccatctgtatatgtttttggtgaggtatctgttcagatctcttgcccacttttcaattgggttgtttgttttgttattgttgagtgtcaagagttctttgtatatttttggataacagcatggtttttgtttttgtttttgtttttttttgagacagagtctcgctctgtcaccaggctgtagtacagtggcatgaacttggctcactgcaacctctacctcccaagttcaagcaattctcctgcctcagcctcccgagtagctgggactacaggtgtgtgccaccatgcccagctaatttttgtatttttagtagagacgggctttcaccatgttggccaggatggtctggatcacttgacctcgtgatccaccagtatggttgagttttaagagttctttgtacgcttttgggtaacggtcttttgttttgcaaacattttctcccaatctgtggtttgtctcttcactcttaactgtatcttttgaagggggatctcaaagaacatctggtcccccacaacaacatgtcatgtcaggtgagagatgactcattttctcagaaactaggattttgtgtcatatgttgtaaaccacgaaaagttaattttataacccaccttctagatctactgagaatacgtggtgttatcactaacagttttgaggaaagaaataattgcctaattcattttgtagtgaatgtgttttgttactaccacagatactcttaaaatccacttattatggagggggaaaaaaaaggaattttctttacagaaagtgaggagtgaaacctaatggagaaaatatctgtttcagggaataaccctcccaacatctgatttttttttgttttagacaggggctcgctccgtcccccaggctggagtgcagtgatgcaatcatagctcactgcagccttgaactcctgggtttaagcaatcctcctgcctcagcctcctgagtagctgggaccacaggtgtgcaccaccactgcaccaccacacccgactaatttttttgatttttggtaaagacagtatgttgcccaggctgatcttaaactcctgagctcaagtgatcctcccacttcagcctctcaaagtgctaggattataaatgtgagccactgcacctagcctgatcttttttttttttttttttttttttttttttaagaaacagtcactagtgctgtatgtaggttacagtagctatgtaggcccttcagagtcacttcacttttctgagctttcgtttcttcaacgtcttcctgtctgtaagacacatgctcttctacccctgagaccaaaaaatgttaccagtgaggatctaatgatataaaatagggaaaatgctttaaaactgcacagtgcttaacaaatgcactgttattatatcattaaaagtgactcctgggtggtgggaatggttgcataacgacgtgaatgtacttgatgtcacttaaaactggttacaatggtaaattttatggtatatatattttaccacaattaatacattttaaaagatggttcttgacaattattcttagcgtctgaggtgccccatttcttgggtatgggcatatagtgcctcaagaatattggggatcctcacctcttctatgcccaaacctttaagaaaattctgggccaggcgcagcggctcacagctgtaatccaccactttgggaagccgaggtgggtcgatcacctaaggtcgggagttcgagaccagcctgaccaacatggagaaaacccgtctctactaaaaatacaaaattagctgggtgtggtggcacacacctgtaatcccagctactcgggaggctgaggcaggagaatcgcttgaacccaggaggcggaggttgcggtgagccgagattgcaccattgcactccagcctgggcaacaagagcaaaactccatctcaaaaaaaaaaaaaaaattctggaaaagctaggtcagtgacatgaatattggaatcagagtctaacaaactcaatttcttcctttctaaatccgtggtacggattcatgtctgcagtagtttttctgagaaagcagaaggggtaggtattggcaatcaacaagctgcagagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacaaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggtttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtcatatatatatacacacacactgggagaatctagggtcagtgccttacaaatggcacaagttgaagccctgagactcccactcctaccctgctccccccattctcagtactgctcctcagatgcctccagcagatcatccatttctgctaggctgggcctgggtacatgcagggagatgtgtacaggggctaagagcagaaacttttgagtgagacactcctgagttcatgcactggccctgccatttgtcagctaattgatgttgcatttaattgcatcatctgtatgtaagcctaataatttatagccatcttagagatgttgtgagcttaaataacatagtagtgaatatttatttatttgtttatttatttatttagacagggcctcgctctgtcacctaggctggagtgcagtggtgtgatcatagctcactgcagccttgacctcccacactccagttatcctctcacctcagcctcctgagtagcttgagacaacagatgcatgccaccataactgactaattttttaaaattttctgcagagacagtgtctccctatgttgcccaggctggcctcgatctcttgggctcaagcgatcatcctgccttggtcttccaaagtgctgggattactggtgtgagccactgcacccacagcctatttattgagaaatgtggaaggcccaggcactattctaagtgctccagctgttttatctcccacagttttgctcagataggagttccaaagctggagctggaagactcatatttttagaaatgttacagttaattctgaggtgggtcagattgagattcatggctatgcattaatgtttaggtggtgactaaccactcagggttttagagacaaacagaccttattctgtcactcactgactgagcgtggccaagtctttcagcctctctaagcctcagtgtcctcatccataaaatgggaccaatcgtagcatccacttctgagaactgttcagaagtggaaatgagctagtttaggtggctgtgtctggcatacgccaatggtttgataagtattagcttgtgcctttattaggccaactcctttttgttaggtgactgagaaaccaaggaccttctgccctttatgcaccagtcactattagtttaaatttgttgctcttccatccacatgattcattccaaatttgaagtgttggagaaagggagttagtatgtcatagaaaaatctctgtttttggctcagcaggactgagtttgactccatgtaactgtctgagtcttagtttcctcatccataacatgggagaacaataccctgaattagagaattctgctgccagaattagagatagttcatgtcaaggtgcaacatataggtaatgtgttattgctggtgttctggttataaaatgtacaagatgtgaaagcaaaagggcagaaaaccctttttaaaaattcatggctgggcgcgctgcctcatgcctgtaatcccagcactctgccaggccgaggcgggtggatcacctgaggtcgtgagtttgagaccagcctgaccaacatggagaaaccctgtctctactaaaaatacaaaattagccgggcatggtggcgcatgcctgtaatcccagctacccaggaggctgaggcaggagaatcgcttgaacccgggaggcggaggttgctgtgagccgagatggcaccattgcactccagcctgggcaacaagagcgaaactccgtcccccgaacaaaaaattcaaatgggaaagagaggcagatggcagagaacaggggaggggctgggcaccgtggctcatgcctgtaatcccagcactttgggaggccaaggcgggtggatttcttgaggtcaggagttcaagaccagtctgaccaacatggtgaatccccatctctattaaaaatacaaaaattagccgggggtggtggtgggtgcctgtagtcccagctactcgggaggctgaggcaggagaatcacctgaactcaggaggtggaggttgcagtgagtcaagatcgcaccactgtactgttgcctgggcaacgcaccgagactccgtctcaaaaaaaaaaaaaaaatgagagaacaggggagggtctagggctcagagctttggagaacagacctcagtagcaccaacactccaggatcaatgctacaaagacacgggttacaactaaactggagaacatggccaaggatgggaactcagcctgagcagggctgagccgagcagggctaagccaagtagggctgagccagaacacttcctccttttttctgaacaatctacctacatttcagctacagggctggctttacccagtccggcgggagggaggagagggctggtctgtgacttcagtgctgaggtttgatcaaggcaaagggaaacttcctattcccagaccctttgcaagaaagaatggcatattacttgccaccgacaggggttattattactaaatggagtcagtataaatgctttccaataaagcatgtccagcgctcgggctttagtttgcacgtccatgaattgtctgccacatccctcttctgaatggttggaaattgggcatctgttcctttaaacaggaaacatttcttgttcgagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagcgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggatggggcggctggccgggcagaggggtcctcacttcccagtaggggcggcccggcagaggcgcccctcacctcccggacggggcagccggccggaaggggggctgacccccccacctccctcccggacggggcggctggccgggcagaggggctcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgacccccccacctccctcctgggcggggcggctggccgggcagaggggctcctcacttcccagtaggggcggccgggcagaggcgcccctcacctcctggacggggcggctggccaggcggggggctgaccccccacctccctcccggactgggcggctggccgggcggggggttgaacccccacctccctcctggacggggcgactggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggacggggcggctggccgggcggggggctgacccccccacctccctcccggacggggcggctggccgggcagaggggtcctcacttcccagtaggggcggccgggcagaggcgcccctcacctcccggacggggcggatggccgaccacccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcatatcccagacgatgggtggccaagcagagacgctcctcacttcccagacggcgtggcggccgggcagaggctgcaatctcggctctttgggaggccaaggcaggcggctgggaggtggttgtagcaagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacggggagagggagagggagagggagacggggagagggagagggagaggggtcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 117 - DNA, 46526 bp, Homo sapiens
tccctttttgacttaccaaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaacttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttattttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttcttgtgtgtgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaacaacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtatccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggcacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttcttttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacagtaacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggatctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaagcctgtttggttgtctcttcacaaggacgcgagtgaaacctccttcatcaggagcatttggggtttgatgtttaagttttgggcctctggtgtatttcatatttctgttttgctagaacttagtgcttgtgcaaggttaaattctagaatcaggaaacgttgtttttaggggccttcagcaagcacttcggaggtccctggacgtttacagctgtgagtcgtggatctacccagacatcagaacatagtcatccttggctcattcctcctccgtaggaggggtacacagttggtagagtgtgccctccaagatttcgtgaaacattatgcttgtctgtatttgtgtgtgcatgtctgcgtgaattttgagttcaggaataacaggtgatttgatcacagctatttgacagtggtgatagtcattgtatgccaagatgtttatgaggggaataggtagattgagtgaggttcatgtatattttgcctagttgtactcacctacaagagctgtaattaaatgtttctctctttccccttcctctcttttattcattcttttttttttttttttgacaaagtctcgctctctcacccaggctagagtgtagtggtgtgatcttggcttactgcaaccttcgtctcctgggttcaagcgattctcctgcctccgcctcctgagtagctgggattacaggtgtgcaccaccatgcctggctaattttcatatttctagtagaaacagggttttgccattttggccaggctggtctcgaactcctgacctcaagtgatctgcccactttggcctcccaatggaatgaaccattgtgtctggcctcattcattctttctttcataaaagtttggatactgccaaacaaaattaaagacatgaagacatttgataaattgttattacaaatgtgacagttatttaactactggtgtttatttttattagagtcatagcacctactggcctctgcttcagggattcacaatggtgttgggcaggttggatatcatggggcttacccttagcaaggcattctattccacctatgcccaggcggtgtaaaacatataagcatctggtacgctgtggtaccgacccagtgactggtataacacaatggttaaggttgccaaatagcaacccttaatcaataatgatcaaatctccacggaggtaaactaaactagaagtttacctcatacaggtaatttttgtgccatacatgattcacagaaccttccagatctgatgctttctgagtgatctggtcaatttgttctcaacctggaattcttgggcccttaggtgtttgtaaatttgttctcagagactctgagctctccaccttcatttttaagtgctttaattctttttggtgataatctttaaaacttcacagaggtgtgtcctggctctttggggcgactgcttcatatttgagtactgccacacaatgacagctcatgttctggggcctgcctacagaaagggatgaactttatcttggaccttttaatgtagtgtggatgggcgtctgtagctggaggtcttcaggtgccagtggttaatctgtttgaagcttgcttcactccaacctctcattctgtaacagactcctcctccaccgtccctcacctctgctgaacccttctagcagagggaactcaccacaagtgggggatggatttgggagcttgaaaggaccccaatgaccctgcagtccagccctcaaagtgctaagtgacttactgaagcctcgaagccatttctggaggatttgcaattctttgtatctctggatttgctgccctgtccctccaagccacctggtttcacttttggacagctttaagtgttctcttctctgttctctgtttctgccttcttagaaactatttaaaaccactcattttcattctaaactccggagccataccaaacaactgtaactgtcctctggtgagatttgcgttgtatgtgacaaatcttttaacttttttctgttagggtttcagttttgttggaagtctgcagtttgctcttaaggatgtgataagaatgtaacaacacatttgtatctttgaattttgaataggaaccaaatttttaaatttagtttagttttgttttgtttgagacagagtctcactgtgtcacccaggctggagtacagtgatatcatcttggctaactgcagcctctgcctcctgtgctcaactgatcctcccacctgaacctcctgagtggcagctggggctacaggcaggtgttttttaaaaatggaactcttttctttttttttttttttgagacggagtcttgctatgttgcccaggctggagtgcagtggctcgatcttggctcactgcaagctctgcctcccaggttcatgccattctcctgcctcagcctcccgagtagctgggactatgggcgcccgctaccacgcccagctaattttttatatttttagtagagacagggtttcaccatgttagccaggatggtctcaatctcctgacctcgtgatccgcccgccttggccttccaaagtgctgggattacaagcgtgagccaccgtgcctggccaaaaaaaaatggaactcttaatacattagaaaaaaaatgaaatcccttttaaaaagcactagaggaaattctgtgtttaaagatttacttatttggcaatgcaaacaactgtttatttcctaacataacttttgcaaatctgaatttttatgaaaagatttttaaattaaaaattttaaattgtactaatttttactttttaagtaattttgagtaggtaatatttttataaagatatttgtatggtttgaagataagaaaattaaaggtgttcaagaagagttttgcccccagttctgtccactgtatacccagtcctccccacttctgcatacatatttcagacaggtatttcttggaagaaagaacatatgctgtgaaacttacatgtctcagtaggtctcattttaagtgattctgtaaaatgcctgggaaatactggtgaaattctagaatggaaataactttgtgagattttgagctgagtactggtaaatagtagaaatggacttactaataaataagggaattttatttgataacttttttctgattacatagtaatgtatgttcattatggaatatttgggaaatacaaaaacacaccaagaaaaaagtatatttatttataattctattttgctatgtattttcccattattcactctgtgtttgtcacagatttttccccaccctttttcaatgagtgtatcctccatgtccccccaatcatgcatccagtaaactttgtcattactaccatctgtactttcactcacgtttcaattccaagcatgtccctctctgacaaccacctcccatcattccatcttgcttcttctaggaccttcccttcaaggatcttcagtgccaccagggcttccagttaggttgactgaccctatctattgtcttcccgatgtcagcaccgcccctcactccctcttcattcagcttagagtccatgtgtctttgttaaagtctcctgtacccaccaacacccttgcctttctgtcagttccactgaggtggtagaatcccaactctggttaatcctataaatccttgtcctccaaatttgtactggaattccaggatgtggctggggtaaaaaccttccatgttgcagacaggtctcgtttcaaaccaatgaccacaaacctccaatgggctttcaggggtttcggcaatgctgtgacatttccctggttatatcacccttttgcactctcggtctgttttactaatcatcgaattctctatgatctcaacctaaaaggttagagatatttcctgagaagccccaccttttctcttgataacccactatggagctgtcatttgtgaatttaagaagaaacacttgcctcttgactattttaaaacatcaaaaacaacatttaaaaattgaaggatgaggccggggtgtggtggctcgcgcctgtaatcccagaactttgggaggccgaggcaggcggatcacctgaggtcaggagttcaagaccagcctggccaacttggtgaaacctgtctgtactaaaaaaaattagctgggcatggtggcgcacacctgtgatcctagctacatgggaggctggggcatgagaattgcttgactctggcaggtggaggttgcagtgagccaagatcatgccactgcactccagcctgggtgatagagtgagactctgtctcaaaacaaaaacaaaaacaaaacctgagggatgagccacaaactgggaaatgatatctgccacgttgtataactgataaaggagatatatgtacatatactatatatataatcttctataaatccataaaatattaaacaatccaacctagatgggcaaaaatataaactagttcaaagatgagcaaaaaatatgaaccagtaattaaaaggaaataccaatgagcaataaatatatgaaaacataaccattctctttggtcatcagagaatttgaaaaatacagccacagtgagatagcattttatgtccatcatattatcaacatttaaaactctgtcagtaccaagtgtgggtgaagatacagagcaaagggaactctattacatcgatctaggaaatgtaaattgacacaatcattttagagagcaatttgcaatatttataaatgttggaaatttgcacacagtaaaatctagcaattccatttttggatctatgtcccaaaataaacttaaaaacattgttttgtagagacagggtcttgttatgttgtgcaggaaggtcttgaactcctggcctcaagcaatcttcctgcctcagcctcccaaagtattgaaattataggcgtgagccaccacgcctggccccaaaagaaatcttgcacaggtaccaggagataaggaggaagtgttagttttctgagcagcattgtttgtaaaagtacaaaaaaaaaaatgaaaagaagcaacacaaacaatctatatattcatcaagaggaggatagataaattgtggtatagtcatataaaggaatactatcaagtagtgaaataaaatcaattagaattattaggctgaaccatatgaaattgccattcttctagatcagaaacaaccaaatattggcaatttcatacagtttaaatatatgtatcagtaacataatgctgagcaaataatatatataatatgatatgatttatataatgttaaaatacacataagagtcttttatgttgcttataaattaatatgtatattgtacaaatatacagatgcatgggggtgatgagaagtttagagtagtagttgcctgggatgggattgggtcttggggggacaggggggaacatgccaatggggaggaattacaggggcttcaaatgcatcagtcatgttttatatcttcaactgagtgctagatgtggggatattctcttttctctttaatcctttttgcgtctcagtgctgattaatggaatttagccaccagattgggtgattttttggcttgttgaatagttggccaggtttgcagggaagctttgccctcttgggcagagtatgtttttccaatctagtaactgtctgtttttggtggtgatttctgtggctgtaattaatatgatcagtgttgccaaagcaaggataaggggtattgactcactttttattgccctgagccatccctgttgcaaaataatgatctggatataatctccagaccaggaagcaagctgcagatgggaaactcccttatgacacttctgaagatcccaaacagtttctttttttaatgtaatttgattttttatttatttagttttgagatggagtctcgctctgttgcccaggctggagtgcagtggcacgatctcggctcactgcaagctccacctcctgggttcatgccattctcctgcctcagcctcccgagtagctgggactacaggtgcctgccaccatgcccggctgttttttttttgtatttttagtagagacagggtttcactgtgttagccaggatggtgttgatctcctgaccttgtgatccgcccgtctcggtctcccaaagtgctgggattacaggtgtgagccaccgcgcccggcccccaaaccggtttctaacaaataagtgttaagtcaaggggttcctctacagaatcagtcatcttcaccatgacacccacaacgcccaaattgctgctggcattcctccactctgaatgcacaattagaagctcagcactctattggataaggctgctatttcaccatttgaagaaccttcaaaaaggtctttagagacagggcatggtggctcacacctgtaatcccagcactttggaaggccaaggcaggcatatcacttgaggccaggagtatgagaccagcctggccaacatggtgaaaccctgtctgtactaaaaatgcaaaaattagccgggtgtggtgatgtacacctgtagtcccagctactcagtggccgaggcacaagaattgctcgaacctgagaggtggaggttgcagtaagctgagatcgtgccagtgacactacattccaacctaggtgacacagcgagactccctctaaaaaaaaaattccttagaaacttcagaaggatccttccactagggcagaagggatgagagagtaagaatcttcacccctaccactcatgcctttctgaaggctcagtctggccacactgcaagggcacagtgagccagttttggcctggggcttcttgctgctgccaaattaacaactccagcccttgggtttagccacctgctgctgctaaaaatgttgctgagagtgatggagaggtgttttagttcccattttacagatcagaaaatcaaggcccagagaaactaagtagtcttggagataggagccatggcctctccacttgagttatcatcttgaaacatcaaggacaagccaactttatcaacagttttaggcctgtgagaaatgggcttggtttatcttgaagattgtaaacaaataaaaaaatagactgctccattactgatgagaaatatgagtcattctgccaggaattgaaagtacagctgcccataaaaaagctatgccggggtccagcctctccaggtccttgtgtgtgaaaaaccactcagtcaaagttccccttttatttctctttgtgctcagtaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 118 - DNA, 21780 bp, Homo sapiens
acatctcccggcggcgggccgcggaagcagtgcagacgcggctcctagcggatgggtgctattgtgaggcggttgtagaaggtatgaggaggctgtgcggtgactgccgccctcgctccgggccgtcagccctgcccccgctccctgcgttctcccaggccctgcgcccgcccgggtacctgcccggtctggaaggcggagtgtttgttttgccacctcgcccgggcgggggcgagcagtgaagcccgcggagcgagagacttggcccggaggcgggagcctgggccggggccggggaagccaggcagcgggttaaggcttttgatttagggagagggacctgggggtaacctaaggaaaggcctcaggtcatcggaggggagacctggcccgggggcgggaggctgggctgggaccggggaggccgggcagcgcgaggccgggccggggaggccaggcagcgggaggcctggccaggggaaccgagcccggggccgggaggtcgggcacggggcaccgagctccgagggcgggagacctggcggccggccgagtgccggaaggccgggtcaggcggcggaaggcagcggcaagctgggaaacggacggcgctaccgccggcggaggagtggccccgggaagcggtgctgcgagggctggggcggccgggtgctgactgtgagatactcgccctgggggctgatccttccaattttggacgaggcttccgtctctgctgccttccatgcctggggcctggattatcccgggttgacaatgtggtttagctcttccagagagatagttgcagggtttaaactccaattccttttcggccctgcagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcagtaagtggcacccaagcaggaaaccggaaaacatcgttcgcagccccctctcgcccacccacttcttttcctgcttagtcgccaagccttgtcgaccttgtaaatgtctgccagatctgtccgcgtctctctatctctgatttcagccgtctgaccacagcagcctcttccctggtctctccacttccagacccgcctgctcctttgcagtccactttttacagcacaggcagagggatctttatgaaatgaaagtctagaaagctcgtcctttgcccttaggttaaacccagcacttaatatggctaacaaacccctgcgtgtgttgggtcctgagtgcccccacccctccttatctttagcaccggttcgatttctgcacggcaatgctgaccttcatacctagtgtctgcctgcaacacctctgcactccctttctcccgccatcacatttgattagaagagctgctacttaaatttctgttttcattaaacagtttaaggttaaatcttcctatgctgtgttctttctgcagccagcattccctaagagagatgtgtcatatcctttgcagttgcttgtttactatcttccctgctagatttgcaagcaaactccaggagggacggacttggtttatcttggtatccttagtgtcttgccccaaatgcggggcctggcataacacagtgaatgcccatccattgtatttttacttttatgccctatctagaaaaagtagacctggtttaggattattcagcaaataataattagaaaagaaatggtagaggtgacatacggagtcactgaaacgatgtaaacctgcaagatagctgaaagagggccaggcaaggtggttagaccagactgtatcaaaatgggctcagccactgtgaatgtgcgtgctgtggttacataatctctaaaaatgaaatataaagcttaaatcatctctatcacagcccgatgcttggactttggttttgctttgcctttttgcaaaagaaggtttttgaaagtgaaaattattttagtgaatggatgaacagtttattggagtatggcaataaaacctgttcaaagtaagagacattagacattgtacctagttaaatcagatttgcttttgctatcctgaataaaggccttgcctcttgccatttgaagagactggcatctgatataggcaattataatgcttctttactgttttgttttcaaacctcgtttaacacaatctcctactgcttcatccccctacaaagcagtctttattttgatgaatgatatattacattgcttctggtgcctactattagatctttaagctctgccccaaagataagaagcactggtgtttgggcctaaacaaagatgggagaattcttagatttatataatattctttctctgcatgttttgttcttaccttcacatgttgcctgtagagcttctttgcattacaataatgaaatcaagctacctgatatgtattggacacggtctggcatctgccttgttgagccacttttgaataccagtgagcatcggtataagccctgaatagagatagggtttgtctcttccactgcttgatacactcagggtctagtatagtactctgcacacagttggtgttcagtaaattgttatggtgcaaatatcaaatgaataaatgctactgaatctgagttttggcagtttcagtcttcctgacagcaggatttcttcaagcggttttaaacttgaatctgattctgcaaagtagtcatccttggtgggagtgctgaggctttaaagtcatctgtaatttttataaaaaggcatccgagatcctccattttacacttatatcatacaaatcatttagatctgtgaaggctttcccattttctccttttgtccttccaaaaacaccatcttaggacttcacctggcacagggaagacagatcgtttgcacatactaagtgcccttctttctaacttgtgtcataaactcagaggctttgaatagtggagagtgctctgtactgtcttcctggtcacgtggcccttgccagaggaaaggaaaggatggtttgtttgtatagtacaatggaacttatttcaatgtattctgtatttgattttacattcctgttctcatatttttaccttaattacataacaaatattaaaagattgacttcaccaggcccagttacaatcgccagtttgataattcttatacgtactcaaatgaattcagagaccagatgggaaaagattttgataaaacctctggtacatcacaactgaagtcttttcttgtccaaactattgtgaaacagatgttctttctgtttcatttgctaaatctggaaacgtgactgcttttgagactttgtcctctctgacaggtaataaatataatcctgatatttttcaagttgtttgacagaagtgtaatctccccagaagtcctgctggacaggcttcacttttcctttggaggaacacagagatacagggaatatgttttaatgacatatacctaacgctgaacatgaaaccagttattttacttttattattattatttttagaaacagccttgctgtgtcacccaagctcaagtgcagtggtgcgatcatagctcactgcagcctccaattcctatgctcaagtaatcctcttgcctcagcctcctgagtagctgggactacaggtgtgtgccaccatgccaggctacttgtttttactttgttatagagatggggtctctctgtgttgcccagactggtcttgaacacatgatctcaaccattcctcccaccttggcctcccaaagtgctgggattacaggcgcgagccactgtgtctggcctatttcactttagaagtaaattgaatgccacatgcgaagtttgttaaatttttttaaaaaaggaaagaaaacacaaaagtaaactacctagtcgcatcagaaatgccatagtcatttttgccattttttcattcattagaattcagtgcattatgttattttgttatctctgcagtaactttctatcatgttatttattttctttgtcttatttaaagcttctgagattatggatttttgtttccttccctgaagttaagtgttatcattcctatatagtactaagctgtctacagaatagtgggagtctgccctcttgagttgggaagatcctagtttgaatcttggctgtgcgactttaaagttcattaacttctcttagcctcagtcacctgaactctgcagtggggatccttatgcctcagagtgtcattgggaggactcacgaaaatacgcttgtactttgagttcagtacctagcctgtatgagccagcattaagagggacagtcatcacgcagcgctttgcacacagctctcacgccacatcctttggctactgttttggtaaatctttactagtaaatgtttcttaaaagcatttacattcatggacatgattcagaaactaacagttgttttttaggtctcactttgagatttaaaaacccttagggcagagaccagattttatttcttacctcagagtttccctgtaggacaggaaccagcaacagcctaatgagctgattaagaattttagagatttaaaatttaaattaggattgccagttttagagactggcacataaatgttttcatttaaggcagtgactgtttcctttaggatatgattttttatctttctaagatgagatcaccatcctcagaataatttgtaccccgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctgtaaggatttcctttaccatcatataaatttttaaagtatatcaaaataaactgataactgagaaaatatatgttgttcagatactaataatgaagttaatgaagtccactatagtatttgtccctgagaaatctttatcaaatattttaaatcctattgtaaaataatgtattttttctttcagttttagagactggcaatcctaatttaacatctccttttgaattccccaccacaggcacactttcacacattcactctttaataacaggttgtttcaaattgttaatactttatagcttaatatagaaatttcactttagaaattaatttttatttctctgccttaatgctatagatgttgtagtctgctttacttcagtattgtaatgagtagttggctaaccaccatgtaaatagggagaacattctagttttttacttgtgtaggaaaacacagcttgaaatgtctaagtatctattttagagtgaagtaaatttatactgacaatatttttttgtgtttgaagacctgactgttacagcgttggtggcaagtgttaagggatccaggaactagacaagtgattctgagacctgagttccaggtttctaagtaatatcagttggtctactgagaactttgccataaacatatgtgttcagaaatttcctttcttagcagcagcatcctgaattgaacagaattacacacacatcagcccagtaagaaacaattcatgttaagtccattgctatgccaggataaatcttttaaatcacaattatttttcctatttatattttgtcaaataagaatgttctaaaaaccaaaatttctgttttcttttttttttttttttttttttgagacggagtctcactctgtcgcccaggctggagtgcagtggcgcgatctcggctcacggcaagctccacctcccgggttcacgccattctcctgcctcagcctcctgagtagctgggactacaggcacccaccaccacgcctggctaattttttatatttttagtagagacggggtttcaccgtgttagccaggatggtcttgatctcccgaacttgtgatccgcccgcctcggcctcccaaagtgctgggattacaggcaaaatttctgttttcatttaaggcagtgactatttcccttaggatgtgatttttttatccttctaagatgagatcaccatcctcagaataatttgtaccctgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctgtaaggatttcatctaccatcatataaatttttagaagtatatcaaaataaactgataactgaggcaatgtatgttgttcagatactaataatgaagttaatgaagtccactatagtatttgtatagtatttgtatattacagtactctgaaaagctggtcactatttaaagtttccattaccagtcacaaggagagaataattttatcccacaattttattgctggcaaaagacacaagtttattaaaagtcagtatttcagtgtaagagttactagactgtttgcagaagtgttcaaaagagatctttaggtccttggttgtctgtggaagctgatcagcatttaggggttcctgagcacagactgtgaaccctgcatttggcacatgcattcagagagccaatttgaggcagactgggggctagaaaggatactgccaggagctccaggttcagcttccgaagttattaagtcttatttcccagtttttaaattagacttcattttttagagcagttttaggttcaaaccaaaattgagaagaacgtacagagacatcctgtatcccacctgccccccaacacgtgcgtagtctcccccattatcaacatcctgcaccagagtagtacattcttacaaaggaacctacactgacacgtcatcatcacccaaacgccatcgttcacaatcaagttcactcttggtgctgtttatcctatggttttggacaaatttacaaggacttgtatccaccattatattgtcacactgagtagtttcactgccttaaaaagtctccgtgcgggccgggcacggtggctcacgcctgtaatcccagcactttgggaggccaaggcgggcagatcacgaggttaggagttcgagaccagcctggccaacatggtgaaaccccgtctctactaaaaatacaaaaattagcctggcatggtggcatgcgcctgtaatcccagctactcaggaggctgaggcaggagaatcgcttgaaacctaaaggcggaggttgcagtgagccgagaccacgccactgcactccagcctgagcaaggagcgaaattccatctcaaaacaaaaaaaaaaaaaaaaaaaaattctctgtgctgtctccctccctcctagccactggcaaccactgatctttttactgtctccatagttttgccttttccagattgtcagatagttggaatcatgcggtatatatggccttttcaaactggcttctttcacttagtaataatgcatttaaagtgttcatggcttgctagctcatttctttttagtgctcagtaatattctgttctctggatataccacggtttatttattcattcaccgactgaaggacatcttagttgcttctagttttgacagttatgaataaaactgctataaacatctgtgtgcaggcttttgtgtgaacataagttttcaactcctttgggtaaataccaaagagtgcgtatttaccatatggctggatcatatggtaagagtatgtttagttttgtaggaaactgccaaactgtctttcgagttggctgtaccattttgcatttccacgagcagtgattgagaatccctgttgctccacatcctcaccagcatttggtgttgatggtgttctggttttggccattctgctaggtatgtaatgatacctcattgttgctttaattagcatttcccattatttgcagtctgtgtatctttgatgaggcccactggattttcactttagattttctatagattggccataaagtcttgaaacaaagatattttctcatggattataatgcaatatcagtaaactattatgtgttcacctacgtttccagacttgttagctaccctgtactgttctctcagttaatcaagttaaccacaatttgtttctcaaccacaggtggctaatgattttgtatgtggtctgtccgctttgaattgatgtgcatggggcaagttggtctctatgatattcatggttcaaggaagttcgagatttcctggtacctaatacatgtttattgtacatatgaaagaaaaaagggcagatagaggggaacatggtactgagcatgatagaggcaaggaagggtggctactttgataggagaatacccctatttttgtcactcttgaaacagggccaagagttgaaattggctagaacaatcctgacctttgttgatattattttatagaataatatttgttactgttttctcacttttaaaaaatgcagatgttatagaaaaattagaagatatagaggaatgttaaggagtaaataaggtgtcagtaatgccatcacccagacagccactgttaataaatatgttaatatgtgaagacatactaatatgtaatatgtactgagtgactaatggcaggtcacttagtagctgtctcgattatcagatcaactgtcatggtatggcagtgtttatgttcaggtacccgtattagttattgttgttaatccctttctgcgcccaagttataaactaaactttttcataggtatgtacgtataggaaaaaatatgctgcatataggctcagtactgtatttggtttcaagcatctactgggggacttgggaggtaccccctgcccctgccccacaggtatactactgtataattattcttctatctaaagtaagatctaatggaagataggaactttgtcttgtcttccactctgtcctatttcccaggatgatacctggcacaaagtatttgtttactgacaaactaaaagatgatttatcccaattatactcacatcttcccttgattttccagaaagcctacaggaagtaagatggtagaaaagcaaagtcttcgtagaaatgcagagcatagactggctcttggagaaggtcaaacatcaccctctcctgtggttaaattgagatggtggcactggctgtcttctatattattgctgcacctttcctcaccaggggtgcacacaaaactgggagagaggggaggaaggagcttagctttgtcttaatagaagggaagaaatgatgttttccaagagaccttgaaattggggaccttggtaaaggtttcagtttgggaagataaaaaagtcctgggatggattccaacagtgtaactgtactcaatgccactgagctgtacgcttaagagtggtaaattttatgtctatttcaccacagttttaaagattaaaatttttaaaagtgggggaagttacctaggactttctagaaggacttttgagggtgagcaagttctgttataggcttgtgtattattttggtatttctgattttatcataggagtgaggttaaagttgtattttgactggaatttttgacattgtcagggtttctagagtgtggagaaggtcactcagtattttttgtttttgttttttgttttgcctttgttcttgttttcctctatttagggaggtggattgccatgggaagtacctttgcttcgaaaagccagaaaatgcctggtagaactccagaaaagtagtaaggagctggcttcttcagaggcagcatagcagagtgggaagagggccctgtcacttagattgtgactgtcgacaaagtcacttaaccaccagaagttgggttttctgacgtttagaattttgaaaagattaaaactgagtgccttgcaaagtacctggtatatattaagtgctcaataagtgatagttgctttgattctaagaactggttcaccttgtgagatataattgtgtaatggaagaatgaaagcagaaactttagtttctacttttacatttcctgggccattttactaccctaaatgagaagctgggcttccaaaacccactttaaaagtaaagactaggccgggtgcggtggctcttgcctgtaatcccagcactttaggaggcctaggtgggcagatcacttgaactcaggagtttgagaccagcctgggcaatacagcgagaccgtatgtctacaaaaaatacaaaaattagccagacatggtggtgcatgcctgtaatcccagctactcgggaggctgaggcgggagaatttgagtccaggagatcgaagctgcagtgagccgtgattgcgccgctgccctccagcctgggtgacagagtgagaccctgcctcaaaagaaaaaaaaaaaaagaataaagattaatggagatttggaacatcttgatactgtatcttgggaatctaagcattgtagaattgtgttatgtgagttataccattgtggtgggaagtttttgatttttgttttaactgtgttgagttgcagttcttagaaatgacccgaggtgttgtcttacaaaagaaataaactgtaatctgtatcttgatctgatgagggtatgtaaatataaaaaatcgagctgtatactttctatatgctttatgtagttcactatatataattcatagctcaattaaaaagagagagagaggctaaattgtatgtaccattgcaaagaaatcattatccccagaactgactcacatacacctttaacagtagagggagaactgaggtattaatttggaaaaataatcactgggataattaatataatgcagtggttttatgactgattttttattaacttctattttctttgtattctagttaataaaggtatccatggagaacactgaaaactcagtggattcaaaatccattaaaaatttggaaccgtgagtatttaaattgaattctttataatcagagaaagatggggatgtgtaataagcaaacctcgagcagtggggcaagaggaaagagagtggtctctctctcaggccagagagaccaagtgacttcctacctcagacagctgtgtggctttgcataaactgacttttcttctctgaacctcgtctttaacatggggctaaaactttcacagaactgaagggaagatgaaaggaaaggcctagtagggtgtgtgacccatagttggaaacctagtcctggaaccaaaaggacaccacaggagaggcaggactcccaagcgccggtgctttctaccctcccgaatcgctctataggattagagggtttaggtttgggaggagtttcttgacctcttgtttatgagtttttacgactaaaatgcaatgccagttttcagtccggggacaaactgcctagttatggatgaattttaccctttttttccccgtgtctttttggaatattctgcttattaatgcttccaataactagcagatggaaaaaggaaaaagataaaactcaaattcactttttaattcttgtctgttattatttatttgggatctctcgtaatactttaaattctgaaagtttatttctgaaacccagtattgttattctcggctgccctgaatattacaaactaattttattactaaacaatatgattacagaaatactattaacaagttaccactaaagatttcacaattttgtttagcaaagggatttttctagaaagtaaacttttaaaatgcagtcccattttagagagttgttgctgtcatttaaatcattttagccagtgcagtggcttgctcctgtaatcccagctacgtgggagctgtggcaggaggatcacttgaggtggagagtttgaaaccagcctgggcaacataacgagaccctgtctctacaaaaaaacaaaaaacaattagtccaccatagtgtgtgtgcttgtagtcagtcctagctacacgccagaggttacagtgaagtaagaccccatctcttcaaaaaaatcctttgaaagtgatttacacattttcctactattttttttttctttcttttttgagacaggctggagtgcagtgatctgattatggctcactgcactcctgggctccagtaatcctcctgagtagctaggactacagacatgtgccaccatgcctggttatttttgttttttatttttgtagagatgggggtcttgctgtgttgcccaggctggtctccaatgcctggcctcaagggatcctcctgcctcggcctcccaaagtgctgggagtacaggtgtgaaccaccctgcctggccctaccttttcatgtcatgcagaacaccacttcaataacaagttgcacggaagccccagacaggtttagggttgtttcgatcctttggtaagttgccctcacagtcccggctttcacagcctctgccttttattaggagtatcccctcgtggactagctatcatatgcttgtaaagtacctacctccttaggaggcacccagagcacgtggggaaggggtgtcgggagctgggagtcataagtcccatgatccatcatctgtaggactcaaaggtcaagtcacgctttcaggatttaacttcagtctgtaaatgtgaggctgttcacctctggttaaaaatcataactgttttctcacgttgactcctttaatttactacatttaatctttttccaacagtatttttggaattgtgtataatgtgagatgctcttaaggttaagtgcatgagtatatggactgtaggtgttagtgtttggtagttcctagacctgtttttgcctgactcttggtctagatcagggatcaagcttaaggcctgtttttatcaactttcgttggaatataggcacatccattcgcttacatattgtcctaagcccgtttcaccagtataattgagcagctatggctgggcacagtggctcacaactgtaatcccagcacttttggaggccaaggcaggaggatcacttgaggccaggagttcaagactagcctgggcaacatagcgagatcctgtctctaaaaaagaaaatacagaaattagctgggcatggtggggcatgcctgtctgtagtcctagctactcagaaggctgaggaaggagtatcactggagcccaagagttcaaagttgcagtgagctatgatggcaccactgcactccagcttgggtgacagagccagaccatgtctcaaaaaaaaaaaaaaaagaatagaattgagtagctgtaacagaaaccagatggcccacaagcctaaaacacttaatatttagcccattaaaaaaaaagtttactgaccccaatctagatagcagaggtttttttagataagtgacttccagacagatattttcaattatttacaataatgcttttatatattaataaattactaatttgtttagctcatggggtttaaggaataatttatgaattgtgataaatattgtgctttgagttatatttgcattttgttgatttcccatcatttcagggtaatttttaagatttttactcttacctcaaaggataaaatatttcacaaagttaataagtaatttttaaattataaaggtatttgatgaaattttgaagaatttagaggaaaatgtaaaacatggaagttaaaagcctgaactctgaagtccaacagatgctttccttccttcttggctgtgacacaatatttgcataacctttagcacattacttagcctcacgtcaggtcattttctcatctgtataactgttgatgtgaaattgaaatgaagacagcctggtttataacattcaacaagtgttaactgttactgtgagttataaaaattgcactaatataaacagaaggcgtggtcatttctacctttgtaaagctattatttgatttctaaacagaaagatcatacatggaagcgaatcaatggactctggaatatccctggacaacagttataaaatggattatcctgagatgggtttatgtataataattaataataagaattttcataaaagcactggtatgtgtcttacataatttttaatccttttcaaatgtttgtgccatttacatttgatataatattaaaagcagtattattgaggtattagacagtaaaccgtgacacagactagctgtgaagtagagattgggcaggacctacaggtcctctgatacactgtgaacgcgtcactcttctgcccaacttcatagcctcctcttgctggcctcctatctgtatgcttggttgcctctgccctgacttctctgtagcccttgcttctttttcttctttctgcttcctctttgatcccaatggaaggttctcaaaaaaacagttaagtggtagtatttattttttccccagaaactgcaagagatatcacaagcattgccttatttaatttatgacaacctggaaagtaacgatgagattctgaaaggttaaagacctcgcgcagtcacacagtatggcggcagagctaggtctgtgtggctccaaagcccaagctctgaatccatcttctgttctgcttcacttccttgtatcctcatgtgctctgttgcctgtcttcccttaccctacgaagctccccatcttagagagacctttcttttactctgttccttttgattcctttgatattttgtctccttcccttcttccttaaattttgaatacatgtagtttaagcttgtactcttcatttgtttccattccttcttgagtctttttccattttctgtctctactactaaaactgcttgctttaaatttaccatggccttgccaccagatccccctctcgatttctgtactatgtacaacttgaatgtagtactacatttgagaatgtttttttagaaatatagataataaaatccttcacagtgccaaaaaagctaattaatatttggtgtattgttattttttcttggcagttctttttaaagcttgattttattcataacgtataagcaatgttgtcttctgcttgtttcacttaaaggaatagcatttttcatattgctgcataattttcatatctgttataatgattatataatactgcatccccaaaactaccattcacttaatttgaataatttactgtatgaatgaacattatggctgtttcccttttaaattgatgctatgataattctttgaattggcctattaatcatattagagttaatttttaattagagaagctgtagtagatctaaggtgggccagtacctatcagagtggtggtggaaatggaaggaagccagattacactgggaagatagcagggtttgtgtcagattaattataaggagtgagaagagaatagttgaaaatggagctctaaatggcatcagttttattgcttttggctataagttgagatgccaccttcaaccattaacttaaaaacacaacaccttgtttacttttgctttacgcatatttgaaaatttacttctagatattctgcctcacatttctagttaggatacctccttcctatagaattttgcactgttggctctattgtttcaaaaaccaaaaacaagcatattattccactaccaccagcacctccccccacatatttagaccagcagtctgggttttgcccagtgagctcctttcctactttgcaatgtaaaggtcaggttctcatgagatctctggcaggctggtgttgggccaggcgccatggctcacacatgtaatcccaacactttgggaggccaaggcaggaggatccttgagcaccaaagttcaagatcagtctgggcaacacagggaaatcccatctctacaaaacagaaaaaaggtagcagggtgtggtggtgcgcacctgtagtcccagctactcgggaggctgaggtgggaagatagcttgaatctgggaggttgaggctgcagtgagctgtggttgctgtactctagcctgggccacagagcaagatcctgtctaaaaaataaaaataaataaaaattaaaaggcagccaacacatcagcaccagaagccagtgaccttgtcacacagctgagataatcaacaacattttggagatacatgtagactttctgtatttaatcttcatacccatcaaatttactcaattctgagggatgtttcccaccaagatttagcattttgaaatctgagtgcatcatgcagtcaatctgtacgttaatgtggaaggttctctaaaggagtggtagaaagcccaggagccctggatacaggcccagcatagctttgtcactttggactggtttgttaactctgctacatgtcccacatctgcacaagtgaaactagtaataatatgactctcatggtgattggaaggattagagattagccatagcagaatacctgatgaacagtaataatgtttgggggttttccttgaaggcactataaatgttgtaatgctatcttaaaattgttgggaagttagagtcagagaaacgcatttcctctgagtgtgacagatgtgtgtatgtattataggatcgtattgttttctagtcttatttttttaaactgatgattttcccatggcaacattttatctgtgaaaatgacaacatagtatatcccattatataagttagtatagcttgtctaaccaaacccttattgttagacatttgtgtttttcactacctaaaccgctgtgaaagacatcattttggctataacactgatgagcttatattatgaagtatcttataagctacaaaattgaagaaattttgttcaccatgttcaaaatagttagaattctcttaccatttaaaaggaagaatttattgtggacttctgaattgctgagtagttaatttcatttcaaagtagttattctttgttttccatacaattaaaagtaattctttctgttccaaggaatgacatctcggtctggtacagatgtcgatgcagcaaacctcagggaaacattcagaaacttgaaatatgaagtcaggaataaaaatgatcttacacgtgaagaaattgtggaattgatgcgtgatggtaagaagaaacaattagaatgaacttcattgtacaattaattttatactatggtctagcaataattatatgtataataaaatatgagaattgtggaattatactgtacataaccctaatcttacatactttagtaagaagtttaaaaaaagttatttatgccaacttcctaaaatggtttgagatgtgttgccgtgccccaggttaggttaagatgacctcttagttttagtctcagtttcttcatcatgttcccatacagtatatctgaagttgttgaataaagtcatggattttttttccttttatttgcaaatgtctttacagtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggtaatgtctaactgagtgatttggttattgacgattaagcaggggttactattctcaactgtaaattatccaaaggataatttttttcctgaagctaatgaactattgttacttttcatttatttaccacttaaaagatatagagtaaattttaattttatacttatatcaaaaagactcagcataattaacatccttttttttttttttttttttttttttagacagagtcttgctctgtcgcccaggctggagtacagtggcgcgatctccgctcactgcaagctctgcctcctgggttcacgccattctcctgcctcagcctcctgagtagctgggactacaggcgcctgccaccaggcccagctaatttttaaatttttttttaatagagacagggtttcaccatgttagccaggatggtctcgatctcctgacctcaagtcatccgcccgccttggcctcccaaattgctgggattaaaggcgtgagccaccgcgcccggccaattaacatccatttttacatagcatttcaattttttagaactaagttatgtgttcacacacaaatttttataaataaatatttattttctaacacccaggcctgccgtggtacagaactggactgtggcattgagacagacagtggtgttgatgatgacatggcgtgtcataaaataccagtggaggccgacttcttgtatgcatactccacagcacctggtgagaacgttacacataatgaatgttacatgtggattttaaatgaattaactgtgactgatcatagaattatacaatgaaaagtgtgtttcagagactgtcaagattttgatatccctaaagatatcaaaacttgtctatattttagggaaccttcatcaaagagaagtctcaaaaagttgtctttagccaaaagtttggctagaaaatatgcatatatagccaggcacagtgactcacgcctgtaatcctagcgctttgggaggccgaggcaggtggatcacttgaggtcaggagttcaaaaccagcctggccaacctcatctctactaaaaatacagaaaaattagctgggcatggtggcacacgcctgtaatcccagctactggggaggctgaggcaggagaatcgcttgaacctgggaagcaaaggttgcagtgagccaagatcgcaccactgcacttcagcctgggcgacagagtgagactccgtctcaaaggaaaaaaagaaaagaaaatatgcatatgtagagtagactagcacgatgtcattcattggactttatcaggtagatctccgctactaatatcaggtagaatattacgtggcaacagaggccaagtcagagcttcccctgcatcttagagaagaagagaggtacgtttctcaggagttatttgaaaggtagtaaataaaaaagataaacatgactagtatacaagaggatagatgtggagtgggagaaaagaaggtaaaaaacgatacatgaatgtgccgttaacctccacgtttttactgttctgctgcacacgtcatcatctaaataaacatttgtggattataccaccatttactcacacagctaagggtgtcggagagtttggaaactttaggtaaatgtattcttaagcagtgttgcattttaaaatatgctcaatatggtttatcttatcctctaggcatctttccaagcaaagtacctctaagttaaaagcaatgggtctaatagttaacctagaaaaaaaagtatgataaatatactattttccctttttggaccaatacttggtagtgtgtttattatactttattcagatgctctgtagacaagtaggacactcaaagcaatttgtttcttggctaagtcagtattaaaataaggtgaaatctgattggaacactgtgctacttacaatgatcctttttatacatctttacttttgcatcttaccttctgcgtgtttgctcttcttgcctattgaaaggggagtccagaaagtaaaactttcaataattcagtgttcgtgaagctggtccccggccagctttgctgaaagcagggggtgtacgcatagcacacattcgtccttcagcatcatttcttctgaaaccaaaggtgtctttttttttttatttgtatgactaataagacttatgtaagtttatgcttatttttgcctttatgactacataataatttatagaatcaactaaaatcagctatccatggtattttgcttgtattttgccttttaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 119 - DNA, 14845 bp, Homo sapiens
ccgagggcggggccgggcccgggagcctgtggcttcaggaagaggagggcaaggtgtctggctgcgcgtttggctgcaatgagctcggcctcggggctccgcagggggcacccggcaggtaggcagggggcgtcgactgggcaccgagcaggtctgcgtcttgctccggctggaggggaaacgagggttagtggaccgggcgcgcggaccggagtggggccgcgggttccttcggctttgcagggcggcctggagaagttgcactcttggattgaagcgctcagggcgggtggggacggtttcgcgcttcagtctaagaaacactcggggacctggctgccgcctcctggcggtcccgagtagcgacgccggcgccggggcgtgcccctgccgcctttgtcctccggggcgatgagcgctttcggggcgccccggctgtttaaaccttaaaaggctgtccccacgcgggcctggcgttcccccacacctggccgtttgaaatgttgggggttggatcttttgtttgctcacttcgaaaagtgaaaaggaggggttgttccgccgagtcataatgaaaacataacaggcccgcggggtgcccgggccaagaccctgggtcctcccgggcttcagctggaggcggccagttcctggcggccagcacaccccggtatctctcttcttcatccaggaaacctgctgctgtctgtcggtttgagccaaaaccacaataacttttttctgcaaagtaatcaactgctaagagcgtacgttctgtcacttattactggtaaagtttagaaacttcaagcctggccagagtgaaacaaacaaaaaggtcgaaacgcctgcagttggccggccgtggtggctcacgccttgtaatcccaacactttgggaggccgaggcgggcggatcaccagaggtcgggagttctcgaccagcctaactaacacggtgaaaccccgtctctactaaaaatacaaaaaaattagccaggcctgggcgcaagctactggggaggctgagacaagagaatcgtttgaaccctggaggtggaggttgcagtgagccgagatcgccccactgcactccaacctcggcgacagagtgagacttcgaatcaagaagaaaaaaaaaaaaaaagaacgaaacgcctgcagttggttagagtgcctttgtttaagaactctttatattttgctgcacaaaggaaatggtgctccagaggcaagctgtaaaagtcacatggtcgtagaggaggtagataggtagccttgtcctggaggcacagtgcagggtccagttgcagtctctaggggcgggaagccggggctttccttcactcacctgctcccttcctcttcttcctccaccgcactccccagtgcatgttctaggcctgatggaggttactctacatagggttactaaatacattgttgatggagccgatgggtagattttcatagagagtgcagtgaatgaagacgatgacagtagaatgaccgaagtcgtttgggaagttgaacaaagtttagaaaggtagccggtctcgggtgggaggggctgcgtggggatgggcctacagagactttggaatctgtaggtgggctggctttcaatcccagcttcactttgccgaccttggcacgcctggcccactttctctgtccctgttcctgagctgtggagctgtgagataaggtatctaaggcatcaggccatcaacaaatggtagctggcaggattatctggagggactatcaaattagagtgaggtgaaaaaaggaatgattagttttgtaaaacctaagctgatttaaggaataaggaggtggcagttacattatcctgcaaaggaagagaagtgaaaagagggccagacacagtggtgggcgcctctagtcccagctactggggagactgaggcaggagaatcgcttgaaacctggaggtggacttgcagtgagccaagattgcgccactgcactgcagcctgggcgacagagggaggctctgtctcaaaaaaaaaaagtgaaaagaggtcaagaatcaggtttaaagaagggcacatttttgataagtagattgcagatgaaaaggaatttctatatctgttatacagggtagctccttcattaaaatttattttctccatatcaataaagctatttcttactttatccaggtttttaaatattaacgcaggccgggcgtggtggctcatgcttgtaatcccagcacttccaggaggctgaggcaggtggatcacttgaggccaggagttcaagaccagccaggacaacatagcaaaaccctgtctctactgaaaatacaaaaaaaaagtagctgggtgtggtggcgcatgcctgtaatcccagctactcaggaggctgaggcgggagaatcgcttgaacccggaggcggaggttgtggtgagccgagaccacgccactgcactccagcctaggcaacagagcaagactccatcccaaaaagatagtaataaaaaataaatattaatgcggcataatgatacttaagtgcccccttctggaaagcttgtcttcttgggatacacagctcaaggtggtcatgatgtgttattttctctcaatctgtgggtaaagtttatcaactccagaaaagtattggaacttaggtcctggcatctgtctccatagctttttgttctgattcagtgtttgctagagtggccactggacctggtcattaactggtactgcaggatgcagggtgcactttgtgagagtgaaggtaagttacagctggccagcatcagaattgggatgtccagagcctaggtttttttctacatccgtagcattaacaaacaacaacaacaacaaaaaacttaaaaaaaaaatccctcactgaggttgccaaatctgttaactttgaaactgaatgtattaagagatggggtctagctctgttacccaggctggagtatggtgactattcacaggggcagtcatagcacactatgtcctagaactcttgggctcaagagatcctcctgccttggccttccaggtaaccgggactataggcttgccactatgcccggccagaacgtcattttaaacagattttcttgagcagctacttaatactagttagccattcctaaacctgtaggtcttgactaatgtgagggcatatttgagacaacccaaactcacatcttaagttattaattttaatgtgtcagctaacaactgggaagctacttctttggcaatatgagaaacaagagttttaaagacccaagcaagaatacatctccagtgttttcaccctgagggatatgagttagtttgctgagcagccatttggcacagcttccatgagttaggttgtgagccgccttcggctcagcagtcagtatggagcagaagccacaggaggtgagccgctggcctgctgccaccgaggaggacactgagacatgagtgctttccaagttgtgcagaattttggcatgtgaggaggatggttgtgacatatggatttaattttcttgaagttattgtttctttatactctaattggttaaaagataagcaggtgaggttatcaaaaggcagtagattccgacagcttttgaaaatgggaagagtgaaatccctgtgctgtcttcatagagcagtgtgtggagtaggaagtacctcgttactgtgctcacctagggcaaaggtcggattaaacagctttctcatctgccatgcagcggggaggaccagttggagaggttgcttttggctctcacaccttagtgtaaaaatcactttgtgaaaaatgcagctgtcacctccttcctccaagattctgattctgcctcagttaggatccaggaatctgcattttaacatgcacaccaggaattctgatgcccaaggttgagcaaaactgacttagggcgtacagacagaggatgccttagtgtggggtcttagttgggtctcattgcttggggcagttccaggaggaataggctaaaagggacttgaactgaattccccaccttgtattttttttgaggagaagtgaggttagatcaatcaggtgatgggggctagtaatggggagatctctaaggagaggggaaccaacccttttggctaggagatgatgggtaagagtccatgctttagggtcattcttcctcaactgaagggtgcatcttgctatactgctaatatttcagtttattcattgctgtctcccctctaagctgttgagctatcaggtaaaaacagatgcatgagtggatggggcctttattgtagaagatgccacactttgcactgtccagtgtagaagccactggccaattcatttaaattgacaataaaatcgagttcctcagttgcattagctgcatttaaatgctcagtagacacatgtggccagtggctaccttatgagacagtgcaaatacggaacaattccaccatcacagacacttccatgacatagcactgctctagagagtagagaggaattcagtggaaggctgtccagggagtagggagtccagttgagaatggagagcagagggctccccttacagggttggaaatgcagatgtgtcatgcaggagatccaaggtccaagtctttgcccttgcccttcccttcctccacccaaacttctacctcttccaggcttacaccactgctaatccagcattaaccacaaactatatttcagttttcctgtaggacttaattctttttcagaaaatgtgcaaaaacattttctgcataacaaagcaacttcatatttcaactccgtaatcacagaactgttactctaggcatattttgcagtgaatgcatttgtgtaatattttctccatttctgtttataagattgttattttgcaggtcaagttgggggtgagaaagcatagagctgttatagtttgtttattagtaagcagtttcccttcatttccttttcttcacatactttggcttttaaactaaccaaaacagaagggtcttaagagtttgggagtcagaagggggatgggagttcctactatattttactgccataagtaaaaaataattaacaaaaatcaactttttttaataggtggggaagaaaacatgacagaaacagatgccttctataaaaggtaaagctgtgctcttttctaataaaggtctcttcctttgatggtcatgatcagcctacagaaatcaaagcaagaatgggtcctgggagctaggaagtaaaactgagtaggccaagttttagcctttggggagctcatttgtagataggcaggttgtgctgcccctggttgtcgagggacccggagtgatgttcagaatgcatattaattggcatggcatgagcctagagctagaacttggttctgagcctcgtggttattcctggttgctggatcctgggggccaggggaaagacatcaaggcagagggttagggatgtgtcaggatggcacatggctgctctttaccaattggcagagagatatttcaggactttccttattagcatggcctttcctggagcacacccatggaacatcagcctggcaaggaggaagctcagatctctatctacatgttgacctagaacttggaggggctcattatttaatatgacttgaagtgattgtttttcaacttttcattaacagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggtagtagttttatctacctatcaagatgaggcagttaagtgataaaattacttttggccaggtgtggtggttcatgctggtaatcccagcactttgggaagccaaggtgggaggatcacttaaggcaaggagtttgagacaagtctgggcaacagagtgagacctggtctctacaaaaaataaaaatcaattagctgggcatggtggcggtagtcccagctactctggaggctgaagggggaggattgcttgatcccaggagttcaaggctgcacggagctgtgatcatgccactgcactccaggctgggcaacagagtgagaccttgtctctaaaataaaaaataaaataatttttttccatgtttccaaatgaaaagttaaaaaaaattaaaaattaaaaaaattccagacttctagatgtagggaaaagttacttatcataacttgtcaacactaatgaggtaacaacagatcaagagtgttggagcatgggccttgctttgatgcagcctcccttaagaacttgcctgagttggccgggcatggtggctcactcctgtaatcccggcactttgggaggctgaggcgggtggatcataaggtcaggagattgagaccatcctggctaacatggtgaaaccctgtctctcctaaaaaatacaaaaaattagccgggcgtggtggtgggagcctgtagtcccagctactcgggaggctgaggcaggagaatggcatgaagccaggaggcggagcttgcagtgagccaagatcaagccactgcactccagcctgggcgacagagtgagcctctgtctcaaaaaaaaaaaaaaaaaaaaaacttgcctgagttattttccttactctgttctattaaatgttgacaggcttttgcatttgtactaacatttgcatagtagacaacaacactctaaattgaatcggctgtcattatgattaaatcctttccgaccatggtgaatgaagggaaaaccaccattgttatatttcatttcttttctcctaaagaaagcaaatttatgtgtcgttaaaatgtgtatagattcttccaaagtaagggtatttgacaactttgaaaagtttataggctaacatttcatttaatataccactaggttttcagatctaggatttgaagtgaaatgctttaatgatcttaaagcagaagaactactgctcaaaattcatgagggtaggtagttttgctatcatatagttcatcttcctctaatgaaaccgagtcctttatcctatctgtaaagacaggtacaagtaattacttgtgtgacaaaaaaagtattaatttagcacaggttacaggttttgggtatgctgctgtgtttccgttacccagcacatttagagacccttgcaaataattatgcctctaaagtttatatttagcataccactagttacagtctcttgtagaaatgaatgaaatgaccccttcaattggcagtaaaagcctaaaatgcaagtactacaggtgctgggcagtcaacaggctcattttctcattgactcctttcatgcctcattttctcactggtttccaaatagtgttggtttacatacattacctcctttaattctcacagcgtcaatagggggtaggtattctaattataacaacctatattataatcatcgctgcatgccaaccattatatttgcataattactttaaactttcttcagagctcttctttaaactgcacatcattctaactttggctgcttttaccagcttttctactttgctcagaagctttggaggacatcagtctcatggcaccgcacctggctttgagtactcttttggaagctctaagtgctataatcttttttttttttttttgagatggagtctcgctgtccgccccaggctggagtgcagtggtgtgatctcagctcactgcagcctccacctcctgggttcaagcaattctcctgcctcagcttcccaggtagctcgcccccatgcccagctaatttttgtatttttagtagagatggggtttcaccgtgttggccaggctggtcttgaacactggcctcaagtgatccacctgcctcggcctcccaaaatgctgggattccaggcgtgagccactgcgcctggccctaagtgctgtattcctatagtgaaagtgcagcaatgcgtggggagctgttgagcagcagtttctgggtctttccactctgctctaaggtctctgctgattcaaggaaatttttagtttattgccaaaataacttggatcttaagtgagattccctatcgtaatccctttatgttttccacatcattctgtgttttagaaaggctaatgaaatttggtcaaactctattactctgaactttaataaatttggatttttttaaaaaaataagatacagtacggtatattgtttgattaaagactaagttgtttcatcacagatattttacacttattaaagagtaggccgggcatggtggctcatgcctgtaatcccagcactttgggaggctgaggcgaggtggatcacctgaggtcaggagttcgagactagcctggctacatggcaaaaccccgtctctactaaaaatacaaaaattagctggatatggtttcaaatctgtaatcccagctacttgggaggctgaggcaggagaatcgcttgaacccgggaggtggaggttgcagtgagccaagatcgcgccactgcactccagccctgggcaccaagagtgaaactctgtctcaaaaaaacaaaaaagacaaaaccacaaattttcctcctccccaatcatgtggatgtaactttattcttgtgttaataaactgaatttttatgtgtagataacaagcatcatattttcatttctatattctcttttgggtcctttatagtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggtaagactgagtacattatcatcttaattataaagtctgtcattctgaacatgtgataaaggtctaaaagccagttttgaaagtaactttctccagtaattggacaggccgtttttgaattctggccaatcatagttgcactttgagctgttagtaataattctttgacactctcattgtctatattacaaaataacagcatttggattgagatttgaagtgactcacaaagtaaccaatgtgctactccctgtccgagcctgataccaaggagagccattggaaagcgtacctgctgattgaagagtgccgcacaaggcaacctcatcagactaggtttgcttctttgggaggtggagagcatataaaccagtggaaagaatggaaaaataaagccttctagtcttatcctgtctcatccctttcacattgccccttaaaccaagattgtttccccgctgccaaattggttttagggataaaagtattttttacaggcgtgatggctcacacctgtaatcccagcactttgggaggccgaggcaggcagatcacctgaggagttcaagaccagcctggcaaacatggtgaaaccctgtctctactaaaaatacaaaaattagctgggcatggtggcaggtgcctgtaatcccagccattcgggaagctgaggcatgagaattgcttgaacctgggaggcagaggctgtagttagccgagagcataccactgcactccagcctgggcgtcagagcgagactctgtctaaaaaaaaaaaaaaatttttttttttgcatgaatattacttggcacatcattaacgattttttttttttttttgagatggagtctcgctctgtcccccaggctggagtgcaatggtgcaatctcggctcactgcaacctccgcccccaggttcaattattctcccacttcagcctcccgagtagctgggattacaggcacctgccatcatggctggctaatttttgtattttcatagagatggggtttcaccatgttggctagtgtggtcttgaactcctgacctcaggtgatctgcccgccttggcctcccagagtgttgggattacaggcgtgagccactgtgcccggccaaagattttgaactacaaaagagaaacctgacatgccagtgtcacaattctgtatttccatgaatagcatggaggacatgaaataacattatgttagtctattcttgcattgctataaagacctgagactgggtaatttataaggaagagagatttgattggcctacagttctgcaggctgtacaggaagcatggtgctggcatctgcttctggtgaggccttaggaagcttacaattatggtggaaggtgacagagagccagcatatgacttgttgggagtgggagcaagagagtgccaagggagaggtcccagactctcttaagtaaccagatttcatgtgaactgagtgggagctcacttacaccaagaggatgatgctaaaccattcatgagagaccctccccgatgatccagtcaccttccaccaggcttcacctcccacactgggaaccacattttaacatgagatttggaggggacagacgttcaaaccgtatcaaacatgaaactgcatttcgcatcctaccataaagccttgttttggggtgaggaagtggctgtaagtgaagaatgactgcctcgtttctggtttggacaactgcattggaatgtctgtgggacatggaattggtcatacaggtgtagaacctaagacaggtggcctcggctggagaaataaatcaggaggtggtcgtggaagccatgggattagatgagtttactcgtgttgaatacagcctgaaaaaggagcataaaacaaaaccgaggggcacccatgaggaatgggctgaagagggaagatactgaggaggatggacaccaggagagaaacaagaaacaaataatgacatgattgttttgtgaaaaggggagtggccaacactgtcaaacacaagagaattggaaataactaatgagctactgtgggaagaaagccacaaatgaaatcgttttccaagttactttctctctctatgccttagattcttggtaaaaagagcacctgcctcatggggtggttgtgtgggcaaaatcacctgactgatttaatgaatgcaaaccacttagaacagtgcctggcatacagcacgccctcagtaaaggctcgctcttactcttattgcagttgactgggcaggtgatgtcattaggttaaaggtgttctgttatatttaggaaggacagtagaaaaaaggcctgaaaataagcctgctgatacgaagattaaaatctgcctataaaaacgggatagtagggattttctatttattttatgatttgaaatcattcaggactttcttttgatgctcataattctttaaccatttcagaactgattgatgcatttataatgctacaacagaatcttattggctggctgtattcgtgtatagggtgaccataacaaagtaccacagactgtgtggtttaaacagcaggaatttatcgtcacagtcctggagctggaagtctcagatgaacgtgtggggaggattggtttcttctgaggcctccctttttggcttgtaggtggccatcttgtccctgtgccttcatatggtctttcttctgtgcatgtctgtgtcccaatttcttcttatgaagacactagtcatgttggatttggtttcacccgtatgacctcattttccttaatcacctctaaaggccctgtcttccaatacagtcagagttgaggtattggggctaggacttcaacatatgaatttttggggaacacaattcagcttgtaaaagtcacttatgagaagagtttaatgttagcctctgagtgagtcagaatttaatgttaattatgagtctaaatttaatgtaaattctgagtgagtcagaattagtgggtaaaaatttgagacctcactttttaatgggcacacaaggaagatggtgcattagtaggtatctcctcaggtcaggctggatgtcattttaactcctaacaatttatagcagcagccaggcaagcaaaagtcaatctggaaatacactgcctgcctaaacagaaacacttaggtcaatactatagctttcaaaagggaaggtaacaccgtgtgccctgggtgtggttaatctgtaagaaattttaaaaccacaagctttttcctctacagtatacccttctaccaacataatttgatgtatacttggggatgccaattttttcttaaaacattaactaaaagaaagcctaagtaaggaaacaactttgttggcttttgtgccctccaaacctgaatgtattgcttctgaactgctcagaatgtggtttctgttgtaatgaaggggtactggcttacacattcactgcacacattaagcactgggaaggaaacagtaggcaaagaggtgggtttttcctccttgtcttgtaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggtgtgtggtgtttaaaacaaacatataattgcctctcttggctaaggtcctgtaagtttcacctttgattggtttgggtcagatctttcggttgggacatggtgattccatcctgaagctcacagacttagaatttctttgaccacatggcacagagtgataaatgaaagtgtaaagtaccttacagaaaaataattcctgagagttatgttgagtaaagcaacagtctaattaattatattagtattagcagcctaccatcagttactgagggtggtagtgccattgtggtaattgtcatggaaagctttaattttttttttttttgagacaaggtctcaactctgtcactgaggctgaagtgcaatggcatgatcatggctcactgcagcctcaatttctcaggctcaagcaatcctcccacctcagcccccctgtagctgggactataggcatgcaccaccatgcttggctaactttttaatttttcggtagagattgggtcttgctatgttgcccaggctggtctcaaacaatcctccagccttggcctcccaaagtgctgggagtacaggtatgagccattgcgtgcgtgcgtgcgttttttttttttatagtctcactctgttgcccagacgtgtgtgtgtgtgtgtatttttttttttttttaatagtctcactctgttgcccaggcgggagtgcagtggtccaatgtcagctcactgcaacctctgcctcctgggttcaagtgattctcctacctcagcctcccgagtagctgggaatacaggtgcctgccaccacgccaagctaatttttgtagttttagtagagatggggtttcaccatgttggccaggctggtctcgaactcctgacctcaagtgatctgcctgcctcagcctcccaaagtgctgggattataggcatgagccaccatgcccaactgaaaaatattttgataatggttctttgcttttgtagtaaataattttgacttctttttagtaatctcatgtctcaatcattgtctatcttgggaattttttaggaaatggaagaaattatacagaattaaccccgtgtatataaaactatatagaattaatctcttttcccatttgaaaagagtcaaaaaaatttaaaagccatttatatcatggacacatcttaagactcttctaaggatttttaagaacttatacttctgtaactaaaaagaatacacacagtaattgaaagccagaaaactgcagcaacattttccttctcacttttttaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcgaaattc

SEQ ID NO: 120 - DNA, 51748 bp, Homo sapiens
aacaaatatttcccgaaagatccaggagcagcatctccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtggggtacgcatgctaatgtaggcgtggagtcccccagggggacgccagcagttccagctgggatccaggtttcgctaggggagagcctctggctatgggaaaggggtctccgagttgatgtgaaggcccaggtcgaggtgtacactgggggcggggaagtggaggtgaccacacgagcgccccatcactgagcgccgccgcgaaatctgcgctctttgggtcacttggagcgcggccagtttggcagatttgtttttttcccggaacaacccgcggcggctcggctgtcccgggaaactgcaaactttgctgtgcgcgttctcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacggtaactgcagcccccacctcggccggcgcctctccagcccgccggccgtgcgcgccttgcctccctccttcctgccggcttcctagttcccccctgcgcccccagcgtggtctaggggagcctggttgagtgggactgagtggccccgacggcctgcgctgaaactttgggaagagggcccgttccgctctctccatcgcttgccttgctcagcttgtcctcccttccctcctagccggggggctaggggacacctcgtactattcgagatttaggagaggagggctcgtgatctggcacagcggctaacagcgagggctcctttgcctgcgttccggtccccaccccttgcctgccggcggtgggacctcaaccctctctctgttaaatgggaaccacggtgatccccgcagactgttggcggggatggacagagttgattatggtacgcgtttcgcggcagtggctctgtcaagtctgagtacactggagctgagcgtccttgctgcagggctcttagagggaccttgaggaggtggaaaccaggcaggagacatttagacgtgtggagtgttaggctccaggtgacagctttgcggtttatggagcagtaaaattacttgtgggtgattgtgggtgtatcatttccagatctttattcttgaacttctgggctcctgggctagttgacgtggccctccctgttgtctcaacttacaggctatttcctccttttgggtctcgccggcctgaccttcacccttggtaccgccattgcctagattcacagtccaccttctgccacctgtaaactgtgtggctttggacaggttacttaacgtctctgaagaagctaaagtttctgcaatagcaaagtaaaggccctggtctagcagtgccatgagccttgggtgacgcagcggagcgcttgagtgcccagcagagcctccctttccccctcccagctgctagaggcaagagggggaggttttcaggtcttctctgtgtgccctttaggaagatttttatttgggcaagaagtgagtcacaaattgtatgatgtcacttttcaggggaagcagctgcagtccatttcccccttcatgaaagtaaaaagttcagacaatagctgggcagtgacttcttacccagctgtgtaccagttgccccaacatgtgggctcctgttcaacatgtttagaaataatcactacaggaactttttttcagtctctacaaaatctttttaaaatatggatgtggtttttaaatatcggcaaaggttgacagttgcatattatcttagtctcgtgggcagtggtgataatgggaatatttcttgactatttagattgtgccacctagcattttacatgcattgtttcattcatcctcccaaccacctgtgacataggtactgttgttttcccattttacagatgaggaaactgaggcttagagaggtcgagcactttttctgaggtcccatggctaatatgtggaagaactgattcagccccagatctcagggttctcaaccaccctcttgggtctccttggttctgctgtttggacagcagtttattgaaggggctgaaggatttgaaaatacatttaagttagatttataaagaaaaatggatttggtgcctgccatgtacctgacatttttctatgattaaaaaaatgattaagatgaggtctcagtctgcaaacagtgacaatcttggtggctaatagtaagaataagagttacagtgactaaccaagacttactatgtgcctatcattgttagtgctttgagtgtctcatgtattaatttatttaaagagaagttagacatatttaacagtgggataagcaatctccctcaaatgactgctctttgcagcctggaccttaaaaaggggacagatatgagaaaataatgccatgtgtaccctctacggacagcttggcagaactgagataggtctggattttcttggtgcactgtgatgatgaaaggaggaaataagaggtcaaaaccaggtcttggtttgactgaaatgacgtgtctgagatcaggcattccccacttggttaccaccctgggctatgatcgctctttggaggttccaaaaatcaagcccagtctcataggaataagaaagtaactaattgtttagctttacagatttgaaagagccaagtcccaccactgctgacttggattgttagaagagacactttctgtcactgcagacagtgttcagcatcaacccagaaggatgcggtaggtttcagacagaagacctaatggcctactgtttggagggaaagttctagaaagcgtcccatcattgagccacagaaatcagcctgaattttacatctcagtagctaagtccaaagccctctcttagtgtctgagaaggatgagtttaagctatacccatcctttggtggaacatttcaaatgtttaatgagtgcacagttctctctgcctgcatcgctcccacctaccctctctgcttcccccttttcagttctcaggtcagacatttcctcccctgaggagtttccctaatttctgtgaggctcttgagtttccctggtatggctacagattgttcaccctcaaggcatacaccacagttgcatttcaaactagacgccatcctttttttcatgtctgtttctcaacatggcaggaccaggtcaatttgctcacaagtatatccctaattcctaacttctagtaaatatccattgaatgaatgaagaagagtctccaaaagtctcagcagtcccaataatatcaaaacaaaggcttggctttcttaggagccattttgcttagggtcttcccctttttcaaaaccactttattaaggtatagttgaaatataaaaagctaggcatagttaatgcatgcatacctaccaagtttggagataagcatagatacacccatgaaatcatcaccacctcaacaaagctaccacctcctaaagtttcctcccacaccgtttaatgctattattactattatttttattactactattttttgaggtggagtctcaatgtgtcaccaggctggagtgcagtggcgcaatctcggctaactgcaacttctgcctcccgggttcaagcgattcccctgcctcagcctcccaaatagctgcgactacaggcatgcaccaccatgcccagctaatttttgtatttttagtagagacggggtttcaccatgttggccaggatagtctcaatctcttgaccttgtgatccgcctgcctcagcctcccaaagtgctgggatcacaggtgtgagccaccatgcctggccaaaactagtattttttgtgtggtaagaacattcaccataagatctacccttttagcaaattgtaagtataccatatagtattgttagctatgggcactatgctatataggagatctctagaatttattcatcttgcacaactgaaactgtgtaccctttgactatcacttccccatttcttcctcgctgcccccacccccaacctctgacaacctccattctattctccacttgtatgagtttgactctgttagattccacatagatgtgagatcatacagtaattgtctttctgtgtctggcttatctcacttagcgtaatgttccttaggtccatccatcttgtcacagatggcaggatttccttctttttttatggcagaataatattccattgtgtgtgtataccacatattctttatctattcattcattgatggacatttagattgtttccataatgttacagtgaatgtgggagtgcaggtatctttttgagatcctgatttcagtttctctagatatatagccagaagtgagattattggatcatatgcgatttctagtttcaattttttgagaaacctctagacagttttccataatggctgtaccaatttatattcccaccaacagtatagaagagttcccttgttttcacatccttgctaacacttacctttatacacacacacatatatacatacacatacacattatatatgcatatgtgtatgtgtatacacacacacacacacacatataaaatagctatcctaacagttgcgagatgatatcttattgtggttttgctttgcatttccctgatgattaggaacattgagcaccttttcatatacctgttgcccatttgtatgtctttagagaaatgtctattcgggttctttgcccatttttttaattagattttttttttttttttttttttttgctattctgttgtgtgagttccttgtgtattttggatattaaccccttttcagatatatggtttgtaaatattttctcccattccataggttgctttttcgttttttgtattgtttccttgctatgcagagctttttagtttggtgtaatcccacttgtttatttttgcctttgttgcctgtgcattagcatcatatgcaaaaactcattgtcaagaccaatgtcaaagagctttctccctatgttttcttctagcagttttaaggtctcaggtcttatgttgaagtctttaatccattttgagttgatttttttgtatggtgtgaaataagagtctagttttattcttttgcatgtggatatccaattttcccaacaccatttcttgaagagactatcctttccatattgaatatttttggcacccttgtcaaaaattagttgactgtaatgtgtgggtttatttccagactctctattctgttccgttgctccatgtgtctgctttatgccagtatcatacggttttgattactatagctttgtaatataatttgaagtgaggaaatgtgatgcctctagctttgctcttgctcaagtttgctttggctatttagggtctttcgtagctacatatgaattttataatttttttatatgtctgtgaaaatgccattggaatttagatagggattgcattgaatctgttcagtgatcaatttgagcagcatggacattttaacatattaattcttccaatctatgaacatggaatatctttccatttatttatgtctaatttctttcatcagtgttttgtagttttgttgttctggctcaaagaagagcagtgtgttgcttaatttccacatatttgtgaattctctaatttctctcctgttactgatttctactttcataccatttgtggtcagaaaagatacatgatatgactttaatcctcctaaattaattaagacttgttttgtagcctagcatatgatccatcttggagaatgttgtgtacacttgagaagaatgtgtattttgctgctgttggatgaaatgttgtatatatgtctgttaggtccatttggactagtgttgttcaaatccactgtttcctaattgattttccatttggatgaaatatccatagttgcaagtgaggttttgaagtcccttactcttatctattgctatttctttctgtagttctattaatacttgttttatatatttaggtgtgctaatgttgatgcatatatatttacagttgttatgtctttggtaaattgatatctatagttataatataatgaccttctttatctcgaaagttttttactttagtctattttgtctgatataagtatagccccccctgctctcttttggttaccattcatatggattatctttttatatcccttcacttttagcctatgtgtgtccttaaatctaaagtgagtctcttgtaaatatcatgtagttggatcttatgtttttactctatttagtcactgtatgtattttgattggataacttaatccatttacatttaaagaaattattgataggtaaagggctcactgttgccattttgtgattgttttctgactgttttatagttcatctgtttctctcttcctctcttgcttccctcccatgtgatttgatcattttttgtagtgatatgctttgtttcttttctgtatatattttgcatatctactacagatttttgctttgttattaccatgaggcttacacaaaacatcttataacgttctattctaagttgataacaacttagtccatttgggatgctattacaaaataccctaaactgggtagcttataaacaacagaaatatatttcttgtagttctggaggctggcatgttgaagatcaaagtgctaacagcatcagtgtatagcgaagtttcatttccttgttcatttattatatcttatcacatggtagatagggcagggcagctctctttatataaaagtgctaatcccatttatggagctttacccttttgacctaatcataccccaaatgccccacctcctaatactatgacattggtgaatagatttcaatgtgtaaattttggggggtacgtaaacattcagaccatagcaacaacttaacttcacgcacattcaaaaattctgcagttttattctctccttccatgttttatgttattgatgtcacagtttacatttctttatattgtatatctattaacaactatatagctatggttattgaagctagagttgtttttaatactttagtcttttaactttagtagagttcaaagtgatttatgcacagctaatacagatgctcctcaacctatgatgggtttacatccctataaacccaatgtaagttgaaaatatcataagctaaaaatgcctttaatgcaactaatctattgaatttcagagcttagcctagcctgtcttaaacatgcttatatcacattagcctacagctgggcatgagaatctaatacaaagcttatttaataataaagtgttgaatatctcatataatttatcaatactgtactaaaagtaaaaacaggatgggtgtatggttacttgaagtatggtttctacatgatgtgttttgcttttgcagcattggaaagacaaaagatcttaagtaaaaccattgtaagtcaaagaccacctgtaaattattcacatattctggatttgactatacacttacttttaccagtgagtttaaagaatgtcctttcatttcaacctgaagtattccttttagcatttcttgtaaggcaggtctagtagtgatgaacactgtcattttcatgtgtctcagaaaagtatttatcttttcttctgaaggacagctttgctggatataatatttgtggttggcagtttctttcttttagcactttgattatattatcccactctttccaggcctgcaaggtttctggtgagaaatccaccagatggtcttatggacatttctttgtatgtaatgaggtgcttttccgtgtgtgtgtgtgcatgtgtgtgtgtgtatgtacatgtatacatgtacgtacatatatatgtatgtacatgtatacatgtacgtacatatatatgtacgtacatatatacatgtacatacacacacgtatatatcaatagcttttggagtacaagtagattttggttacatggattaattgtgtagtggtgaagtctgagattttagtgcacctgtaacccaagtagtgtacattgcacccaatatgtagtttttaaaaatcccacatcctcctcccactctcccctcttctgagtctccagtatccattataccaatctgaatgcctttgaatgctcatagcttagcttccacttacaagtgaaaacatagatatttggttttccattcctgacttacttcacttagaataatggcctccagctccatccaagttactacaaagacattattgtaatgtctccatcttcatttctctttctttctttctttctttctttctttctttctttctttcctttctttcttttctttctttctttctttctttctttctttctttctttctttcctttctttctttctttccttccttctttccttccttccttccttccttccttccttccttccttccttccttcctttctttctttcttttctttctttttgagacagagtcccgctctgtcacccaggctggagtgcagtggcgcgatcttggctcactgcaacctccacctcccgggttcaagcgattctcctgcctcagcctcctgagctgggactacagccgtgtgccaccatgcctagctaatttttgtatttttagtagagacagggtttcaccatgttggccaggatggtctcaatctcttgacctatgatccacccgcctcagcctcccaaagtgctgggattacgggtgtgagccactgtgcctggccctccatcttcatttctgatttagcttatttgaatgttctctcttcttttattggtaaatctagctaatggtcccctgagtttatcttttcaaggaagcaactttttgtttcattgatcttttgcattttttgtttcaatttcatttattctgccttgatctttgttattttcttctgctagctttgggtttggtttgttcttgcttctctagttccaggaggtgtgactttaggttgtcaatttgtcatctttcagactttttgatgtagatatttagcaccacaaactttcctcttagcactgcttctgttgtatcccagaggttttgataatgtgtgtcactgttatcattcgttttgaagaattttcaaatttctatcttgatttcattgttaacccaaaaatcagtcaggagcagactgtttaatttccttgtttttatatagttttgagggtttcttttggagtcgatttctagtttgattctggtgtagtctgagaagatacttgatatgattttcatttttaaaaattaattgagacttattttgtggcctatcacatggtctgtcttagagaatgttccatatgctgatgagaagaatgtatattctgcagttcttgggtagaatgttctataattatccgttaggtccatttgttctggagtgtagtttaaattcagtgtttctgtgttgactttctgcctcagtgatctgtctagtgctgtcagtggagtattgaagttctccaatatcattatgttgctgtctatctcttgtcttaggtctagtggtaattgttttatgaatctaggagcttcagagttatgtgcatatatatttagggttataatatcttcctgttgggtcaatccttttatcatactttctttgtctttttgtttgtaaactgtttttctttaaagtttgttttatctgatataagagtagcaacttctgcttgctttcggtttctatttgtgtggagtatctttttccacccctttaccttgattctataagaatcctttgtattaattagctcagcttcttgaagacagcagacatttggtttgtgattttttttttaatccattctgccaatctgtatcttttaagtggagcattaggccatgtacattcaacattaatattgaggtgtgacccaatcatcatgttgattgttacctggatactttgttttttttattgtgttattgttttataagccctgtgagttttgtgtttttgagaggttctattctgttgcatattgaccttttatttcagcgtttagaattccttttagcatttcttgtcgggctgatctggtagtggcaaattccttcagcatgtgcttgtctgagaaagactatatccccttcatttatgaaacttagttttgctgtatacaacgtttttggctgagagttattctgtttaaggaggctaaaaatagggccccaatcctttctggcttataaggtttctgctgagaagtctactgttagtctgatagcttttcctttgcaggttatctgatacttctgtcttactgctcttagaattctttccttcatgttgacattagtaatagcctgttgactgtatgccttggagatgtccattttgccatgaatctccccgaagggctttgaccttcttgtatttggatgtctaaatctctggcaaggctagggaagtcttcctcaattattccctcaaataaattttccaaaatttttactttttcttctccctcaggaacaccagtgattcttagctttggccattttacataatctcatatttcttagagactttgttcatttcttttagttattttttctttatttttgtctgactgggtttattcaaaagccttgtcttcgagctctgaaattctttattctacttggtctagtctgttgttaaaactttccacttgttttgtaactccctaaatgtgtctttcatttctagaagttctgattgtttttttttcctctaaagtatctatctctttagaaaaattttcattcatatcctgaatttttaaaaaactttctttatattggttttcacctttttcttgtatctccttgggtaacttaataatcaaccatttggattctttatttggtatttccaagatttcatcttagtttggatccattgctggaaagctaatgtgatcttttgggggtgttatagaaccctgttttgtcatattgccagaattatttttctggttccttctcatttggatagactgtttcttctaattatttttgaatttatttttgattcaaccgtttctttctaatttccttttttccaccttatggatgtgacttcaatgattatagcttattgtaacctaatttggctctgggtgcttttggcggtgaagactctgtataagttccttggttatagagagtctttgtatgatggttttctcagatgtagtagcaatgtgcttcgtgtgtgagcaggttgactgtctcttgtggggttggaatggcaaaagtctctgaagctcatccccagtggtgtgcacttatttatttattcatttgttcattcattcattcattcattcctccagtattactgggttgaacagttcaggcttcaagtcagtatgggagttgtccctgggtaaaaactgggtgtgcctaaaacaggtagataaatacaatacctaatggagggcagaggtcccagccttgacgtaggcggctggagaagctgtcattgaaaaacactgaggtcttttcagggggaaggaaggggctaccccagctcccatcccaggccagcaggagaaaaaactgcctcccattcacactcctgacccagtgttctgtccattcaaaccaggcagacaccactttccagctgcagaaatactgatgttccatgtagagagggattataattacccctcatgcaagcctgaaccttgagggcacttgtcctatgaggatgcagtcaccctgaagtgttctagaaaggctgtctacagatgcacccatgccacgctcttgtgggagaagcccaagctgtagctgcagtggtgggtgaggaggaaaagtctccttctccaagacctgtcacaagcaccagggatgcctgactgttgtagtagagccacagactttcccttctgagttcagcattgcacctgtgcctctgctgaaaaaaacttcccacaagcagaaagctatgggactcaagctttgccatctggattcttttgtcccatgggttactcctttgatgtggtgcactcccccttcccctaggagtaggagccctgagggccagactgttgtgaatgctgctgcttctctgggtctagccacccagtggggctgccacactccaggaaagtgccggggaatgtctgcagggggtccagtgatgcgacctgccctcaaatttccagcagtaggtaccagcatctgttctgatgggggtggcagggaagtgacatagactctgtgagattccttataaatagccttagtgtgttggctttctcacacactagctatagtaggaatgaactggtcatgtggacagactcaggacctactgattagctgggggtaatgcaggcagtggtgacagatggggtcatgcgtaagttttctccttcctgggtgctatgttattctgccagcagatgctgtaatggactgtgttggttggcctccaggcaggaagtggcacttggaaaagaacaccagctgcggtggtagcagtgggatttgtgcttcttatgttacccaggtgaggtactctggtgtctcagacaatgcgtgaggccatagagcttcccaaagtttctgtcctttgtgttaagctatggagtagggggtaaaggggcaaagccaggtgggggctgggtcacgtaagtacatgctatggctctccatgtgtgggctcaagcagaggccccagtggggataagagggcagtcctcttgccgcaggggtaatgttccagggaggagtgcaactgcctgtgctgcacagaaagtccacacagggagtggggagtagcaggtgacagtaagctctgcccagttcccatgcacttggcaaggtaggtctcacaccggtagtgttccactagtagcagctagctaggttccaggcattctgctctcagaactcaaaactgccccaggccataagccttcccagttgagacataccatggctttcaggccacgccccttctggtctgcctgagaaacaaaggtacccagctcttgtgctcgtgagtataacccactgcccactcacccctcggttctggccaagggggttcatcgtcactcgagattatatcacaaatgtcaattgggaacctctctcaacctatgacagactactgagtttgctggaagatgtccacaaggtcacctgtgaggtaggacctggaatgacttccttctatccctgctggagaccgagagcacatgcaatgcacatcccaatgctattccttctcatgtattccccagtgctcactaaatcagcttcagtgctgggtagggttaagacctttccctgtggcctggattgccaagttctccagtgggaatgtatgtcccagagacagtttatccccctcacactccagggacttagaattttctacctggttcacagtataggctgcagcccaccacttctttcaaaggctctgtggtttctttcagttttcctattaagttcctgtgttgcttcttggaaaaaagtacacagcatgaatctctacacactattttatcttcccaagtgagagaggcatgctaacaatgcctccaatctgccatcttggaaaaaaatcagttgcttttcttttgctgctttcaagattttctccttatctgttttgactcttaccagtgattgtaatgtgtctcagtgaagacctatttatgcccaatctgtttggggttctttgggcttcatgaatctagatgttcctttccctctccagatttgggaagttttctgtcataatttctttaaataaactttctacccttttctctttgctccttctgagacaccgatactgcatatattggttcacttgatggtgtccaataaattgcataggtttcttcactctttttcattcctttttctttttgttcctctgactgattaatttcaaatgatctgttttcaagttcactgactctttcttctgattgatcaagtctactgttgaaactctcaattgaattttttatttcagacattgtattcttcagctccataatttctgtttcgttcatttattggtttttatttctttgttgaacttctcattttgtttatttgttgtttttctgatttcatttatttgtctgtctgctctcttgttcctcactgggcttttttaagatgattattttggattctttgtcaggtaattcatagatctccatttctttgggatcagccactggagctttattttgttcctttggtggtgtcatatttccttgattatttgtgttctttgaagcctcgcattgtgtgttcacacttgaagaagcagtcacctcttcccgtctttattgactggctttaggagagaaagacctttgccagtgagcttagctagagattctggggatctctcacactttttctctagatatacctgctccacacctcttgttccctctttgggattatatgtgttctctcagtcctgcaaaggcagaccttgtgctaaaagcctcctgcttattccttagggtagtaccctgaaatgttcaaagttatatgtcttctctcaatccatcaaagttgagctggctgctaatatccctacctgctgttgagatccaagcattgtctgtggttgtgtacagactgttgtgcactgaggtacatatcagctggttgaaggggtacataggcaagttgtcctgcagggtttatgggagggacttagggtagcatccatgagctgggtagcagaatctatagccggcttttgataaccatacactatttgcactcctgctgctgcttctccttgctcctggctgccccagacgattcagccgtactattcccctcagtgttctgggtgggatgaaacagaagtgggtctcctagacaacatccttttgggctgggaaagctgggtgctcacttcactctcacttcccccatgggagaattgtgagctggagggacctctcttggaactgagctgtgccaccttaggggaggggtgatgtgggtaaagtgagctgctcttattatactctttgatgcatccactcttcgattttttgctccaccagtgtgctgaaacctctcagtggactcctgtggcctcacaaaagtattcttgtccataggtgtagttgccaaaatcagtatttctatataagaatgaaaactggaacctcctattccgctatcacactgacatttcttctttcttttaaaaatagtggttatattgtgttgtcatcatataccctagattgagcctttaagattaactttagcaaaagggccaacttgattaacaccacatatcaaagttagtgtctttgtctggtggatttttttaaaactttgacttactagttttgaaaatatgtgagtgtgtattgtgttaataacagtctatattggaaagtaactaagtctatgtaaaggagacaagagaggctatcaggtattttctgcatgtgtggccttatgcttatctcctctgtgagttatctccatttttgagaaactttgggttctaatctgaaaaatctgcctcccaaccagaaacacattggtgatgatgaagggaggctcatgatgtgttgagaaacaaggtgaccatctgacttcccatggtcattgtagagacctggcagtaggactttcccttcttagctccctcccctcttcccagttcaccctcagataagctggaaggtgacaccataatgccattcggagtgcaaggccactaggttgtcactttgcctccttggacacctccttctgaactgcattccttctccccacctccaaaagttattacttgtgctcagcggcacaaaatattctgtaaagtagatgccttcttgttttccaacttaatgacagcatccctgggtgagccctaactggaatacagaactgcacctgacaaccgcggcctgctcagtgaagttgctcagggattgtatcagaggcatttgaaccggagcaactccatattgaataggggctgggtaaaataagactgagatctactgggctgcattcccaggaggttaaggcattcttagtcacaggatgaggtaggaggttagcagaaggtagaggtcataaagaccttgttgataaaacaggttgcagtaaagaagccagccaaaacccagcaaaaccaagatggtgacaagagtgacctctggtcaccctcactgctcattatacactaattataagccattagcatgctaaaagacactccccccagcaccatgacagtttgcaaatgctatagcaatgtctggaagctacgctatatggtctaaaaaggggaacttccttagttcctggaatttcccaccccttccttggaaaacttgtgaatagtccaccccttgttttagcatataatcaagaaataactatgagtatccctagtccagcagcctaagctgctgctctgcctatggagtagccattcttttattcctttaccttattaataaacttgctttcactttactctatggactcacccttaattctttcttgcgcgaggtccaaaccctctcttggggtctgcatcaggacccttttctagtaacagttgggaccaggtagaaattggagtctgaagtttctctttattcctgaaagttgatccctgatcccttcatggggaagaaaatgggacttgatttaggagaagtgattctaatactggccaggtgcagtggctcacacctgtaatcccagcactttgggaggccagagtttgagaccagcctggccaacagcctggccctgtctctactaaaaatacaaaaaaaaattagccagatgtggtggtgggcacctgtaatcccagctactcgggaggctgaggcaggagaatcacttgaacctgggaggcggaggctgcagtgagcggagatcacaccattgcactccagcctgggcaacaagagcaaaactccatctcaaagacaaaaaaaaaaaatgattctaatactggctctgccttgggccagccacatcacctttagctaattctttccccttagggtgtgtgtttcatccagccttccattcaattaaatattttagtaagcaccttctgtgttccagctacctctgccataatgaacttatattgtcttataggagccaaacagcagagcgcaaataaacaagccacatacgaaggctatgcgggaaatgaaggcagagggtgggggtggaaagggccaggtagtaaatatttttggctttgtggccatcactcaactctgctcgtagagaggaaacagccataggcaatacataaatgaatggacatggctgttttctagtacaactctatttactgaaacaagtgttgggccatagtatgctgattcccagactagatcagaaagggccttaaaatccaaggagatggctttagatttgtacttatagttaatggggatctcttgaaaattctcaagctggaatgtaatttgatggaaatctattttgtgtagaaccgtgtaaaagcatctgacatagaaagagagcctaataccccaggttgtcgctgcttttgaattgcgtatgagcactttgtgacctgctaggaatttagggggaaattttcattgttgtaaaccttgacagaccttccactgtttcttgtatgcagtgaacatacaacaaaattgtggttactggattagaagctccctgagggcaaggactttgttttctttgttgccatatatgtagtctctgggatgtaagcatattcacatatttgaatgcattaatggggcggtaaccctgaagcttaaatatgcaaaacttctcacccctaggcgtaatggaaaactgtatcacctaatgagtgtcatttaaaaatatcacagtatcagtgatgccactgaccttgtggctttttttctctcttcccagatggcagatgatcagggctgtattgaagagcagggggttgaggattcagcaaatgaagattcagtggatgctaagccagaccggtcctcgtttgtaccgtccctcttcaggtaagtttgcttaatcagggaccctggaccacgtcagcctgccatgcctctgccatctccacccacccatggggagggggacattcagggaaggaggttcatgctgagcatgaggtttgcacaggttcttgctagctgtacgtagcaacactagtgtcctcatgtgcaccctgttgtctgtgggccaagcccaggaatggacaaaagcaaccactgggagtctcctgctcagccgctgagtgtctggtagcagttcctaagtatcaggggctgttctcattagaggtgatttgcaggcaccttcagaacagagcctgggctgctgctgccagtgggaccaagtttgacaacacagaatccaagggctgagggacaggaggttttagggtgactcacgcccaccctgtgtctcctgaggcattgcactgatggaagggagattgcatcctgttcattagttcctacctttccatttcttgagctcacttttaaaattctaaattttgcatttaataatataatagcttcattgattaaactcttgtatgcctgcttggtattattgcatttagtctacataattgcacatttagttttattgttatcaccatttgtcaggtagggaaactgaggtgctgtgaggttgaatagcttgcctttttgctgatagttagtaaatggtaaagctaagatgagaaactaaacaatgccagcaccactcacttaaagattctgctgtgtgcttcccatttaaaagtcgggctagcttggtgcagtggcttacacctgtaatctcagcactgtgagaggccaaggagggaggatcgcttgagcccaggagtttgggaccagactggacaacacagtgagagccccgtctctacaaaaaaagataagaaaattagctgggtgtggtggcgcgtgctggtagtctggctactcgggaagctggggcaggaggatcacttgagcccaggagatcgaggctgcagtgggccatgattgcaccactgcactccagcctgggcaacagagtgagactctgtctcaaaaaaacaagttgtttttttttttaataaaaaatataagtagggctgtaaggacatggaggaaccccaaccctcccttaaccttgatcatggatggacagtgagtggaacttcttgagagacagaaggcagcaggagtcagacgcatcacacttctttggattccctaagccaagtcctactgggaaagatagagagagggataaaggccgaggttagggagtgctcccaggcagtattcaggaggggaagagctggtggggatgggcagccaggctcccaacaccccagagcagaccttgggccatatcatccaacataggacttggaaaagtgggagaaccccaacactgtggacccagattccgttgtttgccagatagagtcaagaatatccaatgaaatgaccagaaaatacagttctgactcctggaactttccaaaaccatgagaaatcggtgcaggccaacttactccccaaggaaagccccttagagcaatggtcttcaaatgcctttgcttatatgtgctcaaaataatataaagctgtgtgtatattttaaggtaacatacacatttttgtcaagatagttgcaaaaaatgtaataatatttcactcttccgaaccctttttgagtatctgacttcagcaagttgtctacaagtgaaagaaacgggaatcatttaataatcattttgtaagtcagtttaagaacagactaatacacaggactccagctcagcaaagccttttgatgtacttcccagaaattattaaaataaatggtgtgttgtaaatactgacatttcaaagtcgtttctttaaatgtacccagtggaatctacatccatagtgattttataaccacctttatccattaaaagaatacatgaacagctctcctgtaacagctagaacttttatgtcttttttcccttcaaacttggttttttcattctcttttcctccacattttcttctgatgtaatagatttagttgcttgaaagtcttattgatcacaccacatcatatacctatgtaacatatacatgtatgcatatgtgtatccatataaattttaagacagttttctagatatcatgagtattaaaagaaagttctcctagactaagttactgtttcagctttaatgaattcacaattgatctgaaaaataaatgttaatatatcattaatattattaaattgtcattcatcaaaataattattaaatagaaattgcattgaagtttcaacttataatggaatgaaggggctcttaataagttagtttctaaagaaatggacaaataatacttattgctggaataagaaagaatttgatattacctctttttcctatttttcatttttagagataagatgcactgagaaatcatgaataaatacatgagatggtaggagttttgttacagtcatgtcacttaattctttgaattccttctgagttctggaccaaaaaatgacaacttgattaggtctttccttaattatgttggaagaattggcaattatctaacttacaaaaggaattatcattccgccttaaaggtatttaatttttttagtttctgggaagtacaccaaaaaacttgtacccaaacttctcaaacagttgtaaattaaatttgctcttcttttatttagaggcagtctgtttaactcaaaatgttccagaaaagataattaagcattaataaacatttgtcagtatcctttttttgataaaatgcttttaaaccatatgctttttaaaatgtatttttgtcaagacgttggagttgctaatgcagctcattcatgtatgaaaattgtctgctctataatctaatggacagagccagtccctgtcaaaccagttagccataccacacttgtttgctgtcagtaaaggtctgataccatttttcagttcagtgaatatgttattaggcatccttgtgacagtcatcttgtttctgaattctaaatttttattcttggatagatgaatggatggatgggtagaagggaagaaggatgaaaggaagaaagaaagggtaccaagcccagccatgccatgtttacctcctggaatcagtgtttgttttgttctcacaggactgatatggtttggctctgtgtccccacctaaatctcgtcttgaattgtaatcaccataatccctacgtgttgagggagagacccggtgggaggtgactggatcatgggggtggttcccccatgctgttctggtgatagtgagttctcatgagatctgatggttttatgtgtttgacggttcctcctacacacactctgtctctcctgctgccatgtaagacatgtctgctcccccttccaccatgcttccccagccatgtggaactgtgagtcaattaaacctcttttctttataaattacccaatctcaggtagcatcttcatagcagtttgagaacagaccaatacataggactccagctcaataataaaaaatctttggaaataagggaacgaaaaaggcaaagacattaaataagaaccatcatcacttccatttcattctattatatatatatattttaacacatttttcagtatatacaagcatactttgttttactgtgctttgcagatactgcttttctttctttcttttttttttttttttgagacagagtctcactctgttgtccaggctggagtgcagtggtgtgatcttggctcactgcagcctccgcctcccaggtacaagcgattctcctgcctcagcctcccaagtagccagactacaggcgtatgccaccacgcctagctaatttttatatgtattttagtaaagacaggattttgccatgtttcccaggctggtcttgaactcctgaccttaagtgatccaccccccgcttggcctcccaaagtgctgggattacaggcatgagccaccacacctggcccagatattgcatttttaataaatggaaggtttgtggcaaccctgcaaacctattggctccatttttccaacagcatatgctcactttgtatctctatgttacattttggtaattctcacaacattttaagttttttaattagtgttatatctgttactatgatctgtgatcagtaatcttttttgttgtcgttgttcaaatccaggataatctctgtaaatgtgatgagtgatctttgatgttactattgtaattgctttggggtgccacaaagcacacctgtataagacagcagacttaaatgataaatgttaagtgtgttctgactgttccacccactggccattcctgtctctctccttctccttgggcctccctattccctgaggcaatattgaaattgggccaattaatagccctacaatggcctctaggtgtctattgaaaggaagagtgatatgtctgtcactttaaatcaaaagctagaagtgattcaacttagtgaaggcatgttgaagccaagacaggctgaaagctaggcctcctgtgccaaacagccaagttgtgaatgcaaaggaaaagttcttgaaggaaattaaaagtgctattccagtgaacacacggataataacattattgctaattattgctgacttggagaaagtttgagtggtctggatagaagatcaaaccagccccaactttttcttaagctaaagcctaagccagagcaaggccctaactctgcagttctttgaaggctgagagaggtgagaaagctgcaaaagaaaagtttgaagctagcaatggttgatccatgaggtttaaggaaagaagccttctccataaaatagaagttcaacatgaagcagcaagtgctgatgtagaagctacagcaaattatccagaagatctagctaagatcattggtgagagtggctacactaaacaacagattctcaatgtagacaaagcagccttctataggaagaagatgccatctaagattgtcctagctagagaagagaagtcaatgcctgacttcagtgctttataaggatgcttgactctcttgttaggcagactggtgactttaagccgaagccaatgctcattgaccagtctgaaaatccttaagaattatgctaaatctatactctttctgtgccctataaatggaagaacaaagcctggatgacacctgtttatagcatggtttactggatattttaagcacactgttgagacctactgctcattaaaataagattcctttcattgacattgcacctggtcacccaggagctctggtgaagatgcagaaggagattaatgtttttatgcctgctaaaacatccattctgcagctcatagatcaaggagtaatttcaacttccaagtcttattacttaagaaataatgtcttactatttgagaaatattatttcagaaatacattttataaggctatagttgccataaataatgttgggaataacattatagctatagtgttaccgctgatggatctgggcagttaattgaaaaccttctggaaaggatgcaccattctagatgccagtaagaacatttgcgatttatgggaggatgtctgaacattaataggagtttggaagaagttgattccaaccctcatggatgactttgatgggttcaagacttccttcaatggaggaagtaactgcaggtgtgccaatcatggtggaaatagcaagagaactagaattagaagtagacctgaagatgtggctgaattgctgcaatcttatgataaaacttgaacagataaggagtttcttcttatgaataagccaagtaagtggtttcttgagatggaatctactgctggtgaatgtgctgatacatttttgaaatatacatttagaatattacataaacttagttggtaaagcagccacagagtttgagaggattgacatgaattttgtatgtgttttaactctttttttgtttgttttcttttaaactttttccttttttttttttttttttttttttaacgaacactttcgttgagggctgactttcaatagatcgcagtgagggagctgctctgctacatacgaaaccccaacccagaagcaggtcatctttgaatggtttagtgccaggttcgccaggaacatgcattgcgtgacaggcgaggggacaatcacctttctgttgacttgaattttgaatgaagttgtactgtgaataaaatgctatcaaacagaatggtatgctacagagaaattgttcataaaaggaagaatcatttgatgcagcgaacttcattgctgtcttattttaagaaattgtcacagccaccctaattttcggcagccaccaccagattaatcagcaggcatcagtgctgaggccagatcctccaccagcccaacagttacaacccactgaaggctcaaatgattgttagcattttttagcaataaagtatgttttaattaagatatgtattttttggacataatgctgttgcgtatactcagactggagtacagtgtgaacataacttttctacccactgggaaaccaaaaaagtcaggcgactccatttattgcaatatttgctttcctgtggtggtctgaaactgagccgacggtatatctgagttgtgcctatatttgaatttggaacagcccagtgtggtcccacgtacccccattactagtgacatacttcccctttatcagactcatgtataagtaagaagcccaccacagtgcctgattcaaggagactcacagatacatcttgtttgtctctttgtggatgacctggaggtttcatcaccctgtaagtgaggttcagggtgggtgagaaagtctgcccttcttttacacagtgggagatgggagaatgggcaagggaaaagtggtatctctgacagaccagttttagaaaaaaatacaagtggcagttgaggacctggccatttattcttcccttaagactgtgcacccctgggaaagtttttgagtaccttgctggaagacttctgcctaaaagaccttttattttgcaaaaatagatgtggtctgtggtatgtcccccccacccctcagctttaagttctttggaaagataaataagcctggagggtctacattctggtccactctacctttttcatagcatgactgatgttgacgtcattaaaataaacagtaagtatcccgaggtcctctctgcagtttcaggagcaccatgtgacccaatgacagatgtggggtgcgatgcatgggagtgccactggctcctctggatgttcgttgtagctgaaggtgctccgccccccccccacacccctacaaccttccctcccatcccatcccaccctattccagctcccttctctaaggagctcagaatcactgttaggcagtggaggaggcagtagcatctctgacctgactctaatcaaggaccagactgctcacctgccctcccctggagacatgaaggatcctgggttgcagaaagaaatatccccttccccaaaaagccagggtgggactcaggtttcaaatactaacagtttcaagcccctagacttgtcttggcctttttttttgcctcacagccactagatggcaggacagcatcgttttatttccagtccataggcactaaaaatccagcctgttctttaaaaaaatatttagtgattttgtaattttctgattattgaagaacatttggaaaacacagaaaagcacaaaaaaaatccaaatatcttaaaatttgtaaagcattcagatttttagttatttagaggaaatcattgtggggccagtccatattcattatgaaccacagtttatagaacagggtctagggtcctccttgcacttgaacagggttctgtcttgatgtaaatataaccctatagtccttgccctggatataaagtcaaagttttaaccaaatgcctaggcacagctacagaaaataataactaattgctgaattgtaggacatagccttggagctgtgggaggttgaggagggaaggataaggaaggactggaggaggagctgaaacttgagttgtcaggaaaagcagggggggtatcaggggaccggtggaacctcagggccagggtggagatgatggtcaggcaaggccaccgatgtggcttctgcctaggaaagtgggcaaaatctgctggacagggtgagttaggtcttaatagcataggccacaaggagccattgtaggtccaagaccaagccctggccagcagcctagaagatattctctcctaggaacctgagaaatcagaggctcccttctgagctctgctcaaggtcagaattcaagaaaaggaaaaaaaggggaaaacaggtttcccgcagtctcagattacccctgggcctccgtggagtctcgtgtgtctctgctgaggagtttgtttacccttctggtttcccagtggaagagagcaggagaaaagatctattctcaacatttgctaaactccctattttccaggcactggctcggatcacatgggttttacccttggcatcatctctgttttccagcctttgccccctggagggtggttaataaatgccacttggttataattctctctcctggaggcatcttgggcttcttcaccagtgagtgaagatatgtaaacacatccctataaaaaatgtgttatttgtataattataaggaagattcaagtggcatcctttttcatttggagaggggttaaaaaactgttttagaagacgcaatgctttggaattagagacaagaacaaagaaggcagaccttaattcattccaaagaatacattccaagttaagcaaaaattgtgccatgatgcccattgattgaaaggggccagatctgggcccactaaagaaaatatgaacattgaaatttatgcagggcgtttacttttcaataaaggaaggattcaaattcagcttccagaaaattggatgcctgtctcccaaatttgtacatagagaatgataaagatttaatgctgtatttgaagcagtgatgacactatgtaaaataatagaagtagcaaagttgagtcagacaaccggggttcagatcctggcccttcctcccacttactatttgagggactatagcaagtcacgtgaccttcctgtgcctcagcttccttatctgcataatagagatattgatctctgcccacgggattgttatgagaatcagagtaaccgtcagcttcctgaattacctgaatgtgcctgctgaggaagaaatcatagaatcatgattttaacactgggagaacttacctaattcccttcattatgatcaaggaaaggaagaccagagaggtgatacgtagccacccaagaggaccaggaccgagacacaggcctaacttgtccagtgcttccccccagcgtcaggtggcacccacgactttggtggcaccaggctgttcatccacattaatccacccacagagtgcttttttccttccacccaagtgggtcagcaaattttcttcgtgtacacggcttcttctctgcttcactttggcagagggatggtatagggacagctgtcccagcagggcgagcagtgggctttccagtggcggagggatggcatagggacagctgtcccagcagggcgagccatgggctttccagcggcggacggatggcatagggacgctgtcccagcagggcgagcagtgggctttccagtgaagagggccaagtgtacgtttcaggagcagcaagcacaggacaccaaaacgtgggcagaggtctagaaactgcaaagctgtagcttctgcatgtgtgggatacctccagttcttttcagttattgctcttctagaggggataaattaaagtgaaaaggtaaggtaaatcatcagcttttcacagtaatagaaacctagaacactattagcagagaaaaattaagcctagtaatagaaaagtactatgaaaacataaccagttgcttctcacatgaacatgtgatcacagacaggaaatgtgagcgtggcattgcatgtttaacccctgagctgctggttttctttctctcaaggatctgtgatgatgagaattttgtttgttttgttttgagacagagtctcactctgttgcccaggctggagtgcagtggtgtgatctcacctccctgcaacctccacctcccaggttcaagcaattctcgtgcctcagcctcccgagtagctgggattataggcgcgtgccaccactcctggctaatttttttgtatttttagtagagacagggtttcaccatgttggctagactggtctcaaactcctgacatcaggtaatctgcctgcctcagcctcccaaagtgctgggattatgggcgtgagccaccctgcccgccaatggtcagttttaaggggaaaagatgggtggagtgattaaggactgaagtatgttagctgttctaatgctggaccctgcagccgtaatacagacgtattgtatcctccattcagtctattaggctatttaaagacaattcagccttttctaccccctggatgatttgttttaaagtcatttgtcaatttttattgtcagggaccctactggttttgtttttttgttttttttttttaggggaaagagggaaatgtggaggttggtatgttttggggagggggatctattcttctccttagcctcttttaaactgagtttgcttccccatgtttatatttttgcaactgactttcagagaaaaaaatgtatagagcgaattttctctcctgttcacagacctgaggatggcaggtgatcaagaggcttgtgcagggtagcaggtgtcataacctcattgtatcagcttcataccctttctagactgtggtcctgaaccaagaaatggagaaaagcgttgctgagccgttcactttataagtgtttggtttttatgtgtttgcattttccttgttgcatttggagggttgagatggggaaatacagcaactcctggatcgttcactttatgcaagatcattgaaaaatgtttgtatgcctcatttaaaaatgaagggctttggtatgcttccgtggtctcctattatttttattcacttgagtacctttaaaggaaaaacataacctaatgaacttgaactctttaattcaccacacactcacttcctgtttttgttgattaacttacatatagtttgacatgttttgccgtcatgtgagtgccgttttgcagcctggtgtagatttgggacttcggtgggttgaccatgtgtgatgctcatcaacttgaactgtatgatggtttgttctgttgatactctgtctcttgcttagctattcccctgtcgttcccaatttttcactcttaaagattgtgctcctggctgcatgtttatggaaattttgttttcttttttcctttggaccccacgctcacagacagttgcttttttccacaggagccatcccagggttgggggatgctacaatggggagccggggcatttctgccggtcagcagagaagggagaggccagtgtgaccttcccagcccgagtttgaatggtcctgtggaaaactccagcgtgcagttcactgctgattcagtcacaggccttcagggccaggcagcctgtgccagtcttctatcccctgctgagctccgagcatgttgagtttttattattacagagaagaaggaaactcacttcctgtcgtcgcagagcacagcctagttctgatgcagaggggactgttttcagatggagacactaggtactactacctgcactctttcttttcttctctgtcttgctctgtgccttaatatgttaggactgtggggatgccctctgttgagatgttgagaccatgaatgaatcatcccaaaaatatttagacaaagtggctacgaaaaccagagctctagttccgaatgaaacagctctggggaaatgtgagcctggtggtgtgtttactttcatgctgatgaatgtctgcaggcagatagagctactgggaatcctattcatggtgatgctttagaaaattaatcgcagtgggcttcttgcatgcttatattcctttccaaatatagaaaggcataattcacattttgagtagcccaggggatccataagaggataaaacctgtatttatccactccagtgatggggaaaattacacttgcacccggagtggattgtaaaaatccattgtactctttctaaggtttttcacttctttgtaaagtaggcagaatatttttatcctataacgttttctgatacaagttgctgtaggctcttcaaggatgtctttttatctaaataatcatgagagcttggttataattttttgactcttgactgttgtagtgaaaatgactgagttgacctcacactgtgaaattagaagttgcaggaaatggctctctacctaagaagttaggacactctggttccttcctgatagttgatgctggcattatttgtgttcctagcagagatttatgcttatctgaacacatctggaaatgaagatagtggtacttgcccatactggcgaagaagctcaacatgaagaaagagatgggatggttaggaagcactgggttcaacctgctgtgttaactttcctttgcattttagtgtacacttaagtgcacttaataagtcattctaccaagatattgtagtgtgttgtgatcttgcttgtctggctctaagcatagtgatttagtagccaggtttctttttttaaatctgcagtgaattgtggaacacagaagcttttaagcggatttagaactttcaattcactgctctggtttatcttggactttgcacttaatggcaggttccaaaacaagaatcctatgtttcttcgcaaagtaatcttagtaaaagtcttccgaatataaacggggccaaagtaaaggtagttgcatcagcagttagcaaagagaggaaaaagaggaggatggatagaatgggaagcgacaaactctggaggaaaaactaccctggccagttttatttgccttgtctttctttgcctctcatctgtactttgcagaatcagtgggataatgattgttaattcaatttgtaaagcataagcctataaaaatattcatacttcttcatggtgacttaaaaaatatctgaagtggttcctccaccgtttgtgtcgttcatcagcttcggaagaaagactcatacccgttgatctggacttgaaagaatctcagtggccttttcctcctgcccctccgtttggcggggtacagcagttctcacatgcttcagcatcttctgcagtgaggtcctaggaacctggagaaacaacaacagccacttttagaaaatcatgtctttggggatgattgccagctgaagaagtttctaatctggacctttgaaagcattttattttccttctttttccctccccagctcccacccctgggagaacctgctggactgagctatggactgttgccttctttgtgccattggctaattaattagcacaatctcctgggagcccttgaggccctttcttctgtccaatagcagttgtttagctgatgatctgctcgactccagcagctgatttccaagcagacagtaactcttttattcgctgctgggactgagatcacaaagcatgtctcctctgactgtgctgagagtgaattactgctcacacctaggctgccctggggactctacacagtttgttacaaaggaaggagactctaaggatgacactgcctgctggggcatttcctggaaggattttggtggtggcattaaaggaatttcagtttaatgttcagctcagctgtcattgctgggagaccttgcaggttccaaggagagttgtaaattgcccccgtggccctaaacataccctcactgctgcagaggggcaccttccagaggccgtgcttcctgaggtatgtcaggttccatctcctggccaagagccaaggagccaaaaggctgtgcacagctggagaggtgtttgataccgtagagcgagctggtgttctccgccccacacaggagtgtgaatcggcaccacgcaggaatgtggggccaacatcttccatcaacttctccacttccacgggctctggaagtaggcgaggggcttgaaacaagatcagagacagcaatgaaaggtcagagccaagagggcctatgcagtgggcggacaggcttgtcatcgtgaccctcaagcttcagagggtccgagatgctcagaccctctgctgctgccattgatcagcatgttgcttttgttctgtgcttaacactacttattggagatcatcccaggagaacgcccacacctgacctgagactcattctgtaggtctagagcaaagcataggattccgaattttaacaaagttgagaaactctggaataggagacttggggttacaccttggaatgaatccaggctctattcctctctagctttgtaattttggacaagctgatttcatccctctctgtgaaatggaactaatacctcacagaactcttgaagattaaatgagataatatatgtaaagtggtaaatgatcaaaaaatgatgtttattataactgtatttattattgttgttattgctgacacagtggagtaagaagtttaaaaggctaggcagagggataaagtcacagtgaaaaatagaaaaacggggtgtctagggagccccctcaattagcacaaaaaagtatgaatccagtgatcttcaaaataagccagatcttgaaatccgtttgtagcaagcaagagacttttaactgttaaatggcaattattagtttagtgttttaaataacttatttgcatataataaaaagttacacagagttcttccactcttgcctactgtctgctcccagctccctgtaacacagataaccacgctgaaagatagacataataatgaaccggcgtcagtgtcgggagtaaatacccaagattcattgtctcacggccacggaaaactaagacacagacacacaaatactgaggttcagagtggaagtttaataagcaaaagaaagagaagagctctctctactgcagagagaggggtccaagagaaatggattgctggttccgcagtggaatgcaaggcgtttcatagatgagcttgaggaggcagtggctgatttacataggatgcaaaagattggttgaaccaggtgtgtcatttgcatagggcaccaaaaactgtttagggctaggtgtgtcatttgcgtagggcatgaaaaagctggccaccccacactcatcttttattatgcagctggttctccacctggccagcgccatgttacctgtttccttactgtacatgtggtggcaaagaaaagggaagagtggagcctccatgttaaacatacctggcccttacgtagcccttttctactggcatagctgccggtgttcacccgtgcaagcttccagcttgcttatctatgtctgcagcttgatttttcagactgctctttgttaaaaaaaaagaaattatttggggcctgctttttgttaaaagggaaattctgtggaggactcttatacccttactatctgcctaaataatttctatctcctgtatcaataacagtaataatcatgatgtttatttaccacttacaacaggacacacactgttctaaatgctttgtgaagattaacttgtttacaggctctgagcaaatgctgttattttgtccttttaacaaatgaggaagcacaagcacagagaggttaagtaatttgcccacagtcacacagctatgcagtagaatagggagtcaaatccacacagcccagcccctgaatccatggatttatctactgcaccatccttcaagtgtctctttatgcagatacgagcaaatctaaacatattttcttttcttcttttttttttccaaaaggtagcacactgctgccattgttctgcaatttggttttgttctgcacttaacacgacttattggagattgtcccacatcagaacataaagaggttcctcattcttgtttactgtactgtgtgattttgattaaagaaccctccctttatgatccaacctggttattatgggagcgagtgactaattgaataagcttatgtctgccagatagctcttgtaattgaagtgtgctatgaaggttcaacactggaaatgggagagtcaggggaaatgagggaagaaaacttattactccaaaaatgtttccaggtagtattaggtctcccacctgaaagaaatactcaagcaagagttgtcctgcgttcgggctgccctaaattaactccctctcagaaatctgttctcttcctatatgtgagctttgagcctaatgaggctgtacctaatgagtgtctctgcagcagccttgcaacaagaattggcaaaatggaagtgcgggtaccagtgtgcctgcccctccctcacctgcccctgacatgtcctgctggtcaccaggcaggacggcagctccatttagctgatcacctaaacagaggtggcccagggcctctgactgtggtgtttcttcagcacgaaacgctcttcactcattcacaaaacactgttgagcacctgctatgtgtctggcactgttgtagaagctgggggaactgcagtgaagtagtccaggtcctgccctcatagagtttacactctagcaggagacaacatagctctgtaatttgaggtcaggtgatgaatttaaaaattaaagcaggggccggcgtggtggcttacacctgtaatcccagcacctcgggaggccgaggtgggcagattacctgaggtcaggagttcgagaccaacctagccaacatgatgaaaccccatctctactaacaaaatacaaaaaaaattgcccggttatggtggcgtgcacgtgtaatcccagctactcctgaggctgaggcaggagtgggaaggaaaaagtggatataataggggtagtaactcatgtaggccctgtgggctgtggtcaggaccctggagttccttcccagcatatgggaaaaccactggatggctctgggcaaggaactaatctgactggatttatatatttttttttttttaaatacagggtctccgttgccgaggctggaatgcagtggcgcgatctcggctcactgcagcctctgcctcccaggctcaagtgatcctcccacctcagcctcccaagcagctgggactataggcgtgcaccaccacgcctggctaaaattatttatttatttgtttgtttgtttgtattttttgtggagaccaagtttctccctgtcgaactcctggactcaagtgatctgcccacactggccttggaaagtgttgggattacaggcacgagctaccgcacctggccttaccattttatttaaaagctcactttggagagaagccagttaggaggcaatggtggacaacaggtcagaagatgatgtaccttgagcgttccagggtcctggcctgagggagcaagcagcatgatgcccaatgaactagggttgttgtgtgcagagacaagagacccagggatagtggccagctccaccgggtgggagccatcgtgggtgccctgggtcctgccatgccctgtgatcctccgcaagcaggtctgagccgtgcaggggagagctgcaccaggactggggccgacaggccagcagggacaccctgaaggcttcagaaaccctggaacggagtttcacagggagccctgggagggctttaagtggtgatggtggaatctgatttttgttgttgttgttgttgagacagtcttgttctgtcacccaggctggagtgcaatggcatgatctcggcttactcaaacctccgcctcccggattcaagtgattcttctgcctcagcctcccgagtagcttgggattacaggcacaagccaccacgcccagctaatttttgtagagatggggtttcgccacgttggccaggctggtcttgaattccctacctcaggtgatctgcccgcctcagcctcccaaagtgctgggaatacagacgtgagccactgtgcccagcttgatttctctttttaaaggaacgctcaggctcacaggaatcttgggtgaacgttacccactctcctcttccattcccacatttctcttatccattggctttgttctgcccaatctttgccagtctgtcctcttggctcctcaagccacatggtaaaacatggcggccaccaactctcattttaaccaccttgacagaatgactctttttctcaatttcaattctcaaattcccagggaagagggctgattgacccagcctagggatcaggtgccccctggaccaatcagtggtggctgcaaggtcaaggggacaggatggcaaatcactttctaccaatatggtggctctcactgtagcctcaaagggagaatagggatgaaagggatttaatccccaggggaaagaaggtgccttaaaacatcacagcttaggtggaagcctaatctcttggactctcattcttgcagaatatatctataagcagtggacttttagtccctctccccttttttctggtgctttcctcctgatgccttctagacaatcatttgcaccttttctttgtctgtctccagttacatgttttaatcatcggggtttgcttcctcaaagttaagctatggatggagttttcccaaggccagctcttcttaggaggatgaattgaattcatcctcctaagaagagattgaattgatagtcactcacaaacacacatctgtggtctgggaagatgtgggtttaacaaaaagctattttggttagaaggaaaaattaatattgactgactcaaatccagaaagaggaagcagataccaagttcattttgaaaaataagagttcattttaggggcagactagctaagctcttttgcttagaaggagaaattaatattggcggactcaaatccagaaggaggaagcagatattaagttcattttgaaaaataggagttcaatttaggggcaggctaggtatcacccttttgagatatttaccaggagtgaggaccacatttcatattcagttgtaaggtacttttcataaccatggacagtgttttcttaaagtgtttctctttcttcccctattgtgttctttttatgtaaccagttaattttccaaattttattctgatagaaccagagtccttttattttttacataacatatctaattctgtttttctcttaaaggatgcttgctggttttgttttgttcatcactgaggatgagctaatgacagcttttaaaacatcccagcttgttttttacttggatatcatcatagagatccataccacagaagaaagaagtaggacttttatctctgaaaggattttagtgcataaactgtgacttccagcctgctagacttcatgctagtcttaggatctttgaatagccttaaattagctgcaggatccaggaagcttgctctgaaattcagttgacatggtaagaaccctactttaggccagatgtggtagctcacacctgtaatcccaatactttgggagggcgaggcgggtggatcacctgaggtcatgagttcaagaccagccttggcaacatggtgaaaacctgtctactaaaaatacaaaaattagctgggcgtggtggtgcacacctgtaatcacagctactcaggaggccgaggcatgagaatcacttgaacctgggaggcggaggttgcggtgagccgagatcacgccactgcactccagcctgagcgacagagagagactccatctcaaaaataaataaataaataaaaactctactttacctattcagtgttcttttcttttatcccattctggcattttctgaagggttgcagagagcactggttgaagcctatcctgaagctaccttggtagaggagttaattgcaccaggagacctaatttcagaaaggtcacagattatattccaccctccacaaaagtaacctggaagatgagtaagtcctgtcctaaattttagtaccaaaaacagtgtttgctcaaagaaaaaatagtctagtagagaaaagcacaccctttggggtcagaccaccaggaatcacatacaaactctgaacctgaattttcttatctacacgaaggcagcatggctgtgagaacatgcagtgattttataaaactcctggcccataggtggcaggtattaataggaaatagctacgtaaatatacttcttctggacttaggtactgtttttgcattggtcacctctgcttttgagtctcactcaagaaatctttgcccagaccaatgtcctggagagtttccccaacattttcttctagtattttcatagtttcaggtcttagctttaaatcttccatccattttgatttaatttttgtatatggcaagagttaggggtccagtttcattcttttgcatatggctatctagttttcccagcaccatttattgaagacattgtccttaccccaatgtatgctcttagcccctttgttgaaaatgagtttactgtaaatgcatagatttctttctggattttctctttttttttccattggtccgtgtgtcttgtttttatgcaagtcctatgctgttttggttattatagctttgtagtataatctgaactcaggtaatgtgatttctccagttttgttccttttgctcaggatggctttggttattctgggtcttttgtggtttcatataaattttagaattttttcttctatctctgaagaatgtcattggtattttgatagggattgcatggaatctgtagattgctttgagcagtatggagatttttaacaattttaattctttgaatccatggccaacttgcttggatttggacttgctgtgccccctcacaaccctgagctagttacttgcccaccccaagcctccgcagctcatccttaaagggggttacgatgatatctgcctccctctttgagttgctatcagaattcagtgaggacatgcagatgagagttttaacaatatctgggcccctagtaagcactgacaaatgttaattattattgttacttgtaaaatgggcatgattatcccccactacctacctctgaggcacctatcgaacaccagagattttgtgtgttcgaaagactgtgcacacattattttaaaaagtacagaggacactgtcaatagcagtcattaacagggtggcaataaggaaatcctattgctgcctgaatggtgtgtccttgaacagtgcagaaactccctttgctgatacatctccaaggggcagggggtggggatacatcacaggaagtacctgctgccactgcaactcccatctaattttgcgacagtcacgaaatgcgtcacctactgcatgcaactgactgcgtcacatgagaggaagttggttttctgcaaagggtaacaactcaccggatcaggtcacacgggcgggtggacgcagagctccgactagccgcaagtccagcgctcttttgtgctgcttctttgtggaaggaaatgtgaagaaaacccagcgtcaccctgtaaaccagacaaaatacaaaacagtggagaagcccagagaaggcaaaacagattccggatatttctcttttaaaagtaaaatggcatcatggaagaaatttggccttccgaaagtggaggataaagtcatgttcaaggggaagaacagcaatacagcatctgcggcttagacatacagagctcgtctgtaatttggagtaagataggagtgggggcggagagggggaaggccatgccctttcagagattctgagaaactccaaccataaaagtccatgacaactcaagtgcagtacccgtgaccccatgtttgtcaggtaacaagctgggttttgacttttattttgctgcttctaactctggctgggcgccatgggagaagggcgggcagatcactctattgaatactccaggggacagtgttgcagactgggacccacccttcactagctgggtgacctgggacaatccccgtctccccatggacctcagtttccgtatctgtaaaatgaagtggatacaattctattcattcatttatataacaaatatttattcagcaacttatatgttgggcattgttctccctattggggattcagtgattttcagaacggagaaatgtctccctcctggagctcacgttggcatagatggctggcaagacagcttcccaccctcattggaaatgtgtccctctgcccgctccatggtgcctcatgccccaccacactgcctacctgctagacttttggcaaactggaccaccagttgtctggagattggaaagagcctacttttttgttgtaatccttctgttcctttttcccccttttaatgtaaatgttattaaaacataacatccacatagaaagtgcacatactgataaattttcaccaacagaaacacacatgtaaccagcacccacaccaagaaacaaaatatgactcacactgaagaaagaccccatgtccctctggtctctgatctccaccgtagggaaaaccatctccagatttctgatcctaggtattagttttgttctttttaactttgtctttgtatatacccttttgtatgtcagttctttcactcattgttatatttgtgaggtttattcatgttgcttcacattgtggtggtttgtttattctcgtatagtatttcattagacgaacgttcaacaatgtgtgcatttgactgtgaatggacgtacagattattttctgctggaggccatcgctgaatggtattgctgtgacgtgtggacctatcttagtgaacgtgtttgcttttcccaggggagttgctgtggcataggttatgtatacattccatttcagtacattctgctggttttccacaatgggtgtacaaagtaggttcccaccagcaatgtttgataatccagggagctgaacattttgcatcttttacgctgtagccattctggtaagtgtgtactggtatcacatggtgattttaatttgcatttttctggcatctaataaaatttgccaggggaccctgttccacttaaacatgacaattaaacagagccgtctgtccacgccaggtcttttcttcaaggatactgcagttttcttaggcatcccccgctttcacactagtagtaaaatgaagagacgttactatacacacttcttccacagcccctgactctggaactttatatttcaccagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtgggtgtgtgggcatgggctcatctttccggttccctttcatcttctcctatttgtatcagacatttatgggagaaatgctgcacctacctactgtggcagacagcccctctgaaggcaaggttcctgtattcaggggaaagggttatgcggaaatcaagaatgttcagtctaaggccccaccacgtgtattagctgatgcggggctttgaccaaagggctaagaatccaggggaaccttggctttgatgggagctgaatgttaccaggaggctcacctgttgcgggcaggtggcactgttagcctcccctttgagtttgcttcagttcatttaaattgtggccttggaaggcattgtatatacttggagtgtttctgctgcagctggcaccagtacatttagcacccggcccactggcgcccgcatgtagtattcagccaggggatgctcacctgtggattcattgcttgattcccacaggtatgggcgttcgaaacggaacagacaaagatgccgaggcgctcttcaagtgcttccgaagcctgggttttgacgtgattgtctataatgactgctcttgtgccaagatgcaagatctgcttaaaaaaggtgagtgctgccaggagtggtggctcatgcctgcaatcccagaactttgggaggccaaggtgggaggatcacttgaacccaggagtgcaagactagcctgggcaaaatggcaacaccctatcttgaaatttttttttttttttaagtagccaggcatgatggcatgtgcctgtagtcccagctacttgagaggctgaggtggaaggattgcttgagcctaggaggttaagggtgcagtgagccatgataacaccattgcactccagcctgggtgacagagtgaggccctgtcacaaaaaaagaaaagttgagcccttaccgcccctccatctatcttcttcctgtacccaagggaggcgatccgcccaccatggccaggcccatctcagaaggatgcctgtgcagggcagaggaatttcagtgtgagaaacctccctccctcttgaccagtccatacctgtcctggagtaggcaggtttccttgaggagccttcaatctctttgtaaaatgatgaaatcagcttaaagtccagcaaaagaaatagattatttgtatacagaatggtcacaatttcaaaagactcattcctgggaagtaacaaatctgtgtcatcctttctagaatgaagtgtaagcgtaaacttttcccttgtggcagatagagaataataattccatatactttagaactatgttattttttatatagcatgttcacaaaattatttcattagatctttaacagaagccctgcaatgttgggcaacagaatattatgctcattttataaatataggggtgggccacgtgtggtgtctcacacctgtaatcccagcagtttgggaggccaaggcaggaggattgcttgaggccaggagttcgagaccagcctggccaacatgatgaaaccccgtctctacttaaaaatacaaaaattagctaagtgtggcgacacacacctgtaatcacagctactcgggaggctgaggcatgagaatcacttgaacccgggaacccaggaggcagaggttgcagtgagccaagatggcaccactgcactgcagcctgggtgacagagcaggactctgtctcaaaaaaaaataataataataaaataaaaaataaaataaaagaaggggtggagcttcagagaggaagaaagatacactgaagggtgcagttagtaggggcagaaccgaaacccacgctctggtcttctaactccaggacaaatgcgtttcctattacacgaccctctctaatggatgccacctaaggtattctggcatttagggcaagtgtttgaaagtaacatcctatcaattcactagacacagacccacaggaagtagataggaacacaatctaaatcactgctatttttcttaacctcacagctaaaacaaaaaaagtccccaccatctttttttttttttaaaactaggcatttttcctaatttcctccaacttgactcttacaagctgaccttttgtaccctagtaggttatgtcctagaccagactagaaatcaggagtctgagatctgggtctggcccaagttctaacaggcaacccaggcaaggcaaccacatcatcctgatttttttgctttcctgaaaggcagattatgataccagctcctgctgtttcttggggatggagtgaggaagcctgtgagccaagaggaattttgtgagcgtgcttcgagaagtataatggcccagataggcatatgaacttgtcccaattgtagtttctgtttggtttttgtttgtttgttttgttttgttttgtttgagacggagtctcactctgtcgcccaggcttgagtgcagtggtgcaatctcggctcactgcaacctccacctcccgggttcaagcaattctcctgcctcagcctcccaggtagctggcattacagatgcgtgccaccatgcctggctaattttttttttttttttttagtagagatggggtattaccatgctggccaggctggtctcaaactcatgacctcatgatccgcctgccttggcctcccaaagtgctgggattacaggcgtgagccactgcgcccggccgtttctgttcttttgaaaggtgattcattctgcccaagtccagagcatgtcacaatcagagaattcttgcttattgtcctatcaaactagtaaagcacttattttttctgactttacatgcagtcagttccagtgaagacaaaactcccattttctaactgtcctaatttgtgtactcttaaaataagctaagaactccagctttcatcaccatcaccttgtacctctactgtcaaaactaatacaagaatcactggggagataatgcaaagtgtcttggtaattcgaatgggagaggccactcttactctgcctggaactggtgaggtagctggactttgcagtgtcctgggcttgaaaaacggccccaaggctccaacgtgttctaccacctttggggaaggttatgagacctctccgagattccatttttttaaatcagtgaaataaagataaatgaggcctacttccagtcttgtaggaattaaaaataactcatgtaaagtacctagatcagtgtctgcacatagtatttgctcaagaaattctaaatattattccttcccccctcattaatcatagagaagaagaaaggatatgtgtattagctagttataggttggtgcaaaagtaattgcggtttttggcattaaaagtaatggttagttcacctatagctggttagttagtatcatagaacctttggtgagttctagctgggccaactagctacatggtttatgattcctctcctcagtatcctaaatggacagccaagctagtatttttatttatttttctttaattttgtttaattgtggtaaaatacacataacgtaaaattaccatcataaccatttttaaatgtatagatcagaatgacttcacatggttgtgtcaccatcaccaccatccatctcaggctttctttcatcttccgtaactgaaactttatctccattaaacactaactggctatttccccttccctccagcccctggcaaccaccgttctatattctgtgatcttgactactcagggtacctcctgaaagtggaatcatgcgatgcttgccctttagtgactggcttattgcacttagcgtaatattttattctctttaacaaacacttgcatgatgcttattatgtggcgtgttttacaaatattaactcatttaatgagttaatattgatcttcaatgtacagataaggaaatcaaggcacaaaatggttcagtaacattcctgatgtcacagaactagccaacagcagggccacacacatcagcccccatacactgtacctatccctctctcttaacgtcttagataagtctgatcctttgaaaggagcccagtccccagctcctcccctcccctcccttgtaaccctctaatagtcagaggcagctgccaggctgcctctgaaaatgctgcatctgaggctccccagaacttagaccttaattcttcaatgttcgtattatttgcttgcagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggtaatctcttttcaatgccaatacacttgaaaatgggaaagattgcagagtgacggggatggcatcatttttacaaatccaaatgctgcttccatattcaaattagggttttatttttctgggaaagattacagagtgacggggatggcatcatttttacaaatccaaatgctgcttccatattcaaattagggttttatttttctatctctgaatggttagcatatgtgtttccactggatcacaaattatgaaggtttctttttttttttctttgagatggaatcttgctctgtcacccaggctggagtgcagcggcgtgatctcggaagactgcaacctccacctcccaggttcaagcaatactcctgcctcagcctcctgagtagctgggattacaggcacgcaccaccacgcctggctaatttttgtatttttagaagagaggggtttcgccatgttggccaggctggtctcaaactcctggcgtcaagtgatccacccacctcaggctcccaaagtgctgggattacaggtgtgagcctccacacccagccacaaattatgaaggtttctttaagacattgcaatacttttatttgctttgcttagtcatttgaaacacattcattcatttatcttttcatcaaattatcattgagctcctaagtatgccaggcacagttctaggtatcaggacacagcagtgaacagcacgtacatttctgttcccaactgcatagaatgatgtctgctttgatatttaggcttgccgagggaccgagcttgatgatggcatccaggccgactcggggcccatcaatgacacagatgctaatcctcgatacaagatcccagtggaagctgacttcctcttcgcctattccacggttccaggtatcatgtccattgtctgccaagcatacttcagtccattccatcatcaaaacacagatttggggactgtattcgtttcctcttgctgcagtaatacattactacaaacacagtggcttaaaatacacaaatgtattatcttgcagttctggaggtcagaattccaaaataggttggcagggctacgttccttttggaggctcaagggaaaatccatttcccagcctttacgtggcatgttagaaccacctgcattccttggctgtggccccttccttcatcttcaaagccagcaactttgcatctctctgacccttctgtcgtttaccgtgctctctttctgaccacagctgagaaaggacacctgtgattagatggaacccacctggatgctccaggatcatctccccatgtcagtccgatacccttaaccacatctgcaaagtcctttcttccacataaggtttcatgttcataggttccagggttagggcgtggacatctttgggcaccattattctgcctaccacagaaatgcattcacttttctctccaggaaagctgaattctctcatttgttattattattattgttttagtagttataaggacaaacatttctgtagtactttgcaatatagagtatctttcatgtgttttttctcatatacaataataccgtaagtatttaggaaaggtgttattcctgtcctgattttacaggtaaaataaaagaatttttagtttggatgaatctaagtgatatgcctaaggtcaggtagagatttcagtgcacagtagagctgtgagtcagccaaggttcctttacacggcagcctgtacacagataccagaaaacgccagcaatgggcaagcctactcactatttaccaagcactacatttgactgaatctgttcaatgaaagtccttcctttgttttgggtacaaaccagcactaagttagaattttcccagctgtaatagtagttgtgtcaagtatttggcacaagggtactggttacagtaaataggttgatgtgtttggaaaaccagctctggcaggatctacagatgagattttgtgagagcgataacttcacaagttttaaggatggcataagatcgaaaataatttggtctttctgctcttgagagggaggtggtgtaatgggggcatatgtctgtgtaaacaaacccagtggtagagttgtagttgctctgagcaaggaggcagttgagaaaagctatgttaaaaaggagctgctgggccgggcacggtggctcacatctgtaatcccagcactttgggaggccagggcaggtggatctcaaggtcaggagattgagaccatcctggctaacacagtgaaaccccatctctactaaaaatacaaaaaaaaaaaaaaatagctgggcatggtggtgggcgcctgtaatcccagctactcgggaggctgaggcaggagaatggcgtgaacttgggaggcggagcttgcagtgagccaagatcgcaccactgcactccagcctgggcaacagagcaagactccgtctcaaaaaaaaaaaaaaaaaaaaaggagctgctataactgagcctaaaatttcaaacaacataggtaaaagaaggatggcttgtcagacggagtgctgaggggctggatagcccagtgcatttggtaaaactcggggctggatctcagggtatatcagtcttcttgggctgctatagcaaaataccttagacaaggtggcttaaacaacagacatttatttctctaagttatggatgctgggaagtccaagatcaaggtgccggctaagttgctttctggtgagggctccctttctagctcataaatggtcacgttcttgctatagcctcatatggcagagattgagagcaagactgagtgaggtctgttgtgtctcttcttataaggacaccaatcctcttggatcagagccctaccctagtgacctcattggaccttaattacctccataaagaccctgcctctaaacacagtcacattatggggtgcggcttcaataaatgaattttgggaagacatagttcagtccatagcaagggatatgacagggcatggccagggtcaaaccaggacaggtaggcaggtggccctgtcatggtggaacctgtgtgctatgtcaagcagcctgaactttactcagataaagtggcgcaagggaacggttttaggttagggagttataggatgagatttgccctcccgggtcatcaggctctcctggccctgcccctcagacaattgggcattcagcttccttgtgcctctagatttcttcagcaaggtccaactctactcctatgtatcccagcagcaggaacacatctcagaattccttgaggttctctgcaaattccttctctagtaggcttggattaggaagtagcactgacccctaaaggatagtgaggagttccagagttatggaatagacctccagcatttcctttggaagtctgcacatgcagatctgtctcacacccacgtatctgatatttatcaggtgggtacgtccatcaaaactgacacaagagagtaccctggcaacatccaccaatgctggcccttagtgatgctgtctgtcatgggatttccatgctgaaatactcaaagcattttctagcatcttcatgccagccgttaaatctcagatgtttgctctctgagcacaccagcataattctcattaatgacttgtgtgcagagtagagtgaaatagtttctgaaaagcaggtgtgaaagtgccatatactcattctcattggtgagtggagcagctgtcagaattagctgatttggtcgtctcctttctttcctgttgaaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaaccag

SEQ ID NO: 121 - DNA, 4240 bp, Homo sapiens
gacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaaggtgggcgcggggccgggccgggggagccagggcctggtcgcccggctgtaggtgctgcgaggctcctccggttggcctccaggcgcctcccctttgccgggtttgatttgcgtgggttttctccgtacagccctggttttgcagatgggagagccagaaacgcagaaaagttaacttattcgaggttgcagggcgtggacacgcacagtcctttttcctccacccacttctgcccgggtaaattagaaaactcactgaagaaaagatgagtcagagaaggtgtgggggaggggcagaggttgggtgagcctgcctcgcatcatttcctttctgtctcggaatatgcttttcacggctgtctgagagtaatactagcattcagtaactcctacccaggggcttacagtgtgccgcttacccttgtaactgccaaatacaattttcgcagtagccctgtggcttagatactgttagctatcactgttcccattttacagaggacaggactgtggctcacaggttaagtggctttgtcgaaatgcgcagccgataactgacggagctaggcttgagccaagcagtccggcctccggatgggtagtgttagccactacactgcctctctggtcaagttcattgtggagtggcttcctgtcctgctctcggtcactccctctccaccctcgcctgtggattgcagcagcttccaggataaaaaagaaaccctgagtacagcagagtttctcagccctaccccccttgttctcagagtcgggagaggcttgggagtgctctggggacgcctctcagaggcttcaagctgtagcttggaatcagccattcagtcaccaatcagatagggcctaaatgtgtcaccatgggtttcactctgtaaagactggtgcctgttggggacaggatggacagaacagctctctgcctgagagcagtcaagtccagattttaaaaaaaatcagtactgaacaaacaaaacaggacgtagaaaaatcgggttttatggatatttaatgtctggaaaaacactgataaattgcattttaaaggcggtctacgaaacatagctgacatttgagatgtatgtgtgcttggttttatttatatcgtcatgtagttactgtgtgctgggaaaagtacaccagaaggtgagcggtgggtatggacaggttggtagcgggcgactctgccttcctccccagaagttcagcatagcggttaagggtcgactctggcaccacactcttagggtttcagaacatggctctgccatcgtctagctacacgatctcaggaatgtccattagcttccctgtgcctcaatttcctcatctgtacagtcatggtaacacagtgcccagcccacagggctgtcagagctgcgggagctggtacacctgccaacggtgtctcagaattgccagtagtccaagcagcaccctgtcctgcctctcctttcctctcttcacattccagaagcggccttttatggtcttgtgaccagctccctgatctcagtggtgacgtcagcagatgaggagtatggtagccagggactgaagactggtggtcactcggggcagctttctaaataacaattggagtgcctactagtttcctgtgattgccataacaaatgatcacaaatctggtggcctgaagcaatagaaatctaccccctcaatctggaggccagaaatctgaataagcagggtgccacagaccggcacaccctcggaatgctgttggggaggctccttccgggtctcgtccgctttgtggtggctccaggcattctttgacttgtggccgcttcactccaggctcacacggccttccctgtgtgtctcctgcaaggatacctatcattggtgcatccaggtcatccaggatgatctcctctcaagaccctcagcttacctttgcaaagatgctttttccaaagaacattcatggtttcagcaatttcacgtgaacataccttggggtgacatcgttcagcctgctgtagggcaggatgtgggatcaaccctattttcttccctcccacaactccccagcccctccctcagtgtctcctgctctaagtaggtagctccactacaacttcctttggcacttgagtcttcagtgggccacgcctcctaggacagtattagagagcagggggtttggctgaggtggaatcaggccactcttgggcatttggtgcagcccctttgctgccaggcgactctagcctctacagaggacctcgtgtaggcacctctgtccactcagcacttggcgtctgtgctgaaaagccctagggaggattgtggggtcgcttgtctccaaacctatggtaaaccgttctgttctttccttcccagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatactacaaaaaattttctattcct

SEQ ID NO: 122 - DNA, 25255 bp, Homo sapiens
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggtgagccctctcctgcccgggtggaggcttaccccgtcttagtcccggggataggcaaagtggggcgggcgcgggacgcgtgcgggattgcggcggcagcggcgcacgcgggcacctgggagcggcgggctgctgcgggaggcgttggagactggctcccgggggctgttaggaccttccctcaggcccgggtgctcagaacgctggaggacttgcttttcttgggccttgatgcgaagtgctgaccccgctgggcaggcggggcagctccggcgctcctcggagaccactgcgctccacgttgaggtgggcgtggggtgcggacaggaattgaagcggaagtctgggaagctttagggtcgctggagggggaccccggttggagagaggagcggaactcctggacaagccctgacaagccaagccaaaggtccgctccggcgcgggtgggtgagtgcgcgccgccccgcgggggcggggagagagcctgcagccttcagaacagatattgctcattttctggcagttctcagacgtaggaaataagtcagcaccgaagcagtggttaagccggagggctcggaagaacggcaccttttctttctcgaaaaagttatatgggggctgaatgagcttctggaggcttgtttaccgttttttattgtcacacagaaaaagaaactgccttgtctcccttccgggaattctctctttaagactgtaagtcgctgcctgagtggtttcattttgttttgtttttctgcccttctctttcttcttttgccctttcttagcttgcactcccatggtgatttctgcttggtctcctgctggggttggtggtactcgttcccaccgcacagaacccggcgcctattattggccaagaaacttgagcagcctgttttgaaaagtccctcgctcagaaatgccagcttgcagatggctaatcaaagagacgtggatccaggaggctcatttgagtaccggagcctctgagagtccatggatttttattttattgggccccaacaaagtgccaggcatagcgagagaagtgtttacaaatgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggattctttagaaacttccttggagaaaattaatgattcaagattgagaaaacatttatacaacctcaggccacactcttctctctcttgttattaaccattgcaccactgcaatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcaacactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggtgataactatagtcaacaagtatccccatccttaaccccttttgcttctctttctctttccttctctcaaccttcctggtgttagttttctctttcctatttctgagtgtttttactccgacacttacaataaaaaagtttgaaatcccaaaaagttgacaaatttctaaaggagacagaaaaagagtcaaacttactttacaaattaatttgagaaatagctgtgggttgcattttttttttttattgtgcatgaccctgttattggccaagaaacttgagcagcctgttttggaaagtccctcgctcagaaatgccagcttgctaattgaagggatgtggatccatgaggctcatttgaattccgaagcctctaagagtccatggatttttattttattgggccccaacaggttttgtcttgcattatttaggacattggccaggcaatcactggacagccagtttgctctcctttacattttgtagaatggttatcttatggtcaaaggaaagggagagggcctttggaaaataaagctgtgtatttacaagcagtcatacagaatagttttgtggggaaaataaagaacagttatttaatttgtaatttaatcatttttcttaaaccaacccaaagagcataaaatggaatatttatttatttttgtagcttaatttgtaatttaataatttttcttaagccaacctaacgaacatattgggctgtttattttcatttttaatgggccatatttacatcacaaaggacttgagaagtcttacaaatacaataaaatgataaaatatgaattaagacattagcaaccaggatggaaaaacacaaatttgtaaatgatggccaggtttgcaagcaaaaattaaattgataaatggcagcacccccactaccagctatagttagactgatgaaaaatcctctaatgttcatgcctgaaatacagttaccacccttagcagcaaattagaggcaaagaagttctggaatttggacgttgtctctgagtaagctctttgagacactggacaagtaatttccttctgaatactcttatactgacacataggagaagtgtcagtgtttcaaaggaatctctttgaaggctactacattgctttaggggtgccagattaccagagtaaactgccagtttgagagaataactgtttcttaagagatggtctgaaacctaagtaaggaaatccccccacttgaaagcccctaggaagttaattgcttttggcaaattatcttgggccccaaaagtcccttgatgagcacatgttttgtaataggtactaaagactatttacttatgatgaaaaataaaataacacaatttaaaacttgaaattgataaaaagcaacttgaaaccaaatttaggacagtgaacccatccctttcttatttttaaataggtaaatatagaaaaaatgaccacatgatgtgaaacaaaaagcaaatatttaaaaactacatttatactttatctcaccacactaatgtaaagaattttgattttacttataaattcttagccttgtctacacatatacataattgcatgtttaatttgagctatatatagtctgttttttgttcctttgcatgttacacaaacctttttctatttctacataatttttatctcatattttttattggatacattatagagagagcatttattaaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataattcaaaacgataaaaagcaacataattttatatgttgtaccttgtacttccttataaggtacaacactacaatagccttagtgtgtagttttctttttgctatgtatgtatatatatattcataaaagtggaaaaataacatttaataaatcctctttattttctggaaaatccttgctttaaaaaaagtctttagctttttatatagttctacttctaacaccaattaaatatcttcaattcagtctcaagcaggaacaaatcttcagtccacttgcctacctttactgtctttgaagtgacagtgtgagtagtaaagcccaaatcagagagaaattgacttttgtaagattggtaacttcaccttccccggaaggaaatgaggtggttcttccctttgatcacaactgctttcttgatttgaaataaactgttgtacagcccagtcaccccatctttagacatttagaaatggcaatcatagttatataggacaactagcctgagtcccactaagtagaaatgatagtgaatttagtataagattatacctttaggctgggcaggtgactcacacctgtcacccagcacttcaggaggccaaggtgggtggatcatggatcacttgagattaggagtttgagaccagcctggccaacatggcaaaaacccaactctactgaaaatacacaaattagctgggtgtggtggcgtgcctgttatctcagctactcgggaggtcgcggcaggagaatcactggaacctgggaggtggaagttgcagtgagccaagatcatgccactgcactccaggctgggcgacagagtgagactccgtctacaaagaaaacaaagaaacaaaaaatcatacctttagagcaaggccagccttgtgaattagcaaatctgactacaaattcaatcagcagatgtactcagcccagcaaagtgagcaagcttactataggttgtgttaaggcatggactgggataaactggcaaaattagagtaaatttgacaatttgacattggattcattaatgatagcctgtccttcaatgaagtcaggcagcattgtgtttctattcacctctgtgttttgtgaggctataaaaatataagatatgagaaatgtgaatactttttatttgtgagggcagatatcttgaaaaagagagcgagaggaagtcagagtatgcgggtgaagactcttgtttttttgctgaggatttagctttggtttttagccattctcacagagatcattggtcctaattaactggttgttgttgttttttttcatgtgaatgtctgtaaggtttcaggcttgattttaaaaattgggcctatactcacagaaagacaaatactgcatgatctcgtttatatgtggaatctaaaagttttgaatccataaaagtagagagtagaatagtggttaccagaggctagttgggggcaaagttgggggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaaaatatgtacataattcaagacatcatgttatataccataaatatatataatttttttatttgtcgaataaaaataatacaaaaaaaccctgggcctatactgcccacaggtagtggccacaggcagagctggtcccaagcccctccctctctctgtagtcccttatcccaggttgctttattcttgtatgacccacgtggcccctctgggcttgtaagggctctggggctgtattttaggactctatagcccttacattacccatttcctctaccaaaggtcatttctcttatcttcaagcttatttttggaagggtcattatttcttcatgagaagtcaaattctgatttgcaagtgctgaacacagatgccattagtctataaaactcttatattctcacatgtaaatgtagtaacctgctaacctcagattctgcttcctctaacctagttgccctgcaactgtgatgaacctcaaaatcaccaagggtacttccccattctcagagatcctgattccttaggtctatgtaggggccttagcactttttattaaataatgcatcactacaggattctgatgtctgtcggggtcttgagaactatttttctgactctagcactaaactcaaaatgtaatttcagatggaatttcctaggctcattcattttattttatttatggcttggccagtcatggatctaatcagtaacttgcaactgttgcttcaactacctctgtcctggactttccagagattggctttaagaaagaaagaggacatccctgggataagattaccatgtgtatttttatgtacagattttgaaaaacatacaaatgaatgggatctttgcttatctcttccatgtagaaaaatttattttacttctatttcaggttttcaataatgtagtaggacaagatgacatcactatatccctgttttttacacagatatattagagatgcattatcttattggaaattttaaactattcaataataaactattagtcttttagaatttctttttcctcaagtgttgataagtaactgaaagtctacaagcagacaagcagaattagtcggtggaacttcatttcttgctccatttttgtcctcagcagtagagggtggtgagatttcaacccagcctagcaggaccaataagtctggaaagaagtagctctagttcatattggcacctgctaattctagttctgaagaccatgggaaatctcttgcctatttagctcagtgatcatccaagatgggaaattcttgggctcagctgtgagggatcccaagtttatatgtaacactaatgtctcacaaatcaagaatccaagagaatcaagagactatagttcattccttatattaaattcttaggactgccaactgggtggctacagttttgggggctagaagtctgatatcaaggtgccaactggactggttccttctgaggaccacgagggcaggatctgttcaggcttgtagatggccttcttttccatgtgtcttcacattatcttcctctgtttgtatgtgtgtccaaatttcctcttctttttttttaatttagaaatttatactgtctacaagctttatatagctttagttaaaaaaaagcaaaaaaaaaaaaaaatcaaaacaaaaacagtgaagccaagacactcttccaaagtctggacccttccggccttccaaatacaagagctctggaagttgtatataccaaatttcctcttcttaaaatgtcaccagtcacattggattaaggcttaccctattaacaccattttaacttaatcacctctgtaaagaccctatctcctgatacagtcacattcggatgctcaggaagttagggtatcagtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggatgctttgctggtgtcaacactcccctttacaaaaaaaaattcggccgggcatggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggcaacagagcgagactccgtctcaaaaaaataaataaataaataaaataaaataaaataaaataaaatctcactttctgtttctactgttctctcaagtacccctctgccttctgttacttctttgctgcattctgagaggaatggggtggggagcactctttcctgtagaaccccataacccatctattttcatcaatttatttgaaattcaaagccaggggttaaaatgtccactttcaatttgagatgtctaactttcagataaatctattaacatgcatttctaagtgacttttaagctaagcattttattttattgagctcgtatggaagggtaactattatacttgtataataaagtgcactttcaaaaatactcggttcaaatgtaaaataatattcgtaatattttaagacaaacctcctagaacttatatgtgtctttcttcccagagcagtctctatgggtgcctaaacaatactgcattattagatttttttcagtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacatttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtccagtaattttacttcaaaaataaaagagaattttctttaccatcaaacaacgttgctgtaatgagtggtgatatatttagtcctagaggaccaaagagaaataaaatggctttgattatgctggtttaagaaaatatatccgatgaaacagaggttaatatttgtgatgtttgatttagtaaaattataagactaccaaagaaaactagaagagcaaaataaccaaaatttatataaagaattcaatgttgataattcaaaggtttagaattttttccacctttcaaatactaagttgctgttatagatttactaccattattacccagattttctattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgtgtgttaaaagataatatgctgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagattagcctggccaacgtggtgaaatgccgtctctactaaaaatacaaaaaattagccgtcatagtgtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttttgtgcttctttttaaaagtcttttcctgtttgctttgaacttcaataaaaacagggggtaagaaggtaatatgcttttattttgtctgtggggtttttttcttccttcttttggttccttttcagatcctagctcatcaaggccatttgccacactgacactggaataagcctgaatgggggtctatatttcttccagtagttagtttaattcggtcattgagctgttgctctatttgtaaccgtcatgctagatccgagggctgactattcctgagaaagtgtggagatcctttcagactgccatggtgctagggcagagtttcagtcattatcttctgtgtctgctaattcttgcatcatttcttctactctgtaacctggttggctatgaaaagtgattcttcctcactgatgctgcaggcaatgggtgaatatccaattgttctctcaggttcttgtcatcggatacaaagaacaaatttcatgtgtccctgtttctgagaggttcaaagggagcaaatgcacagattctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccaagcttcagggcagggctggcaagttttgccttccccgccagcaagagccctggctttaggggtcttgctacagttttcccagactggaggtcttggggctggattctggttcttagcgaattcttgccaaacacctcccctttccccagtatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtcctgagtctcttgttagccactcttaactgtgaattattggacaaatcatttctcgcactctgtgtaatctgtcacctgggtacttgatgatttaaaccaggaattgtggcccttctcataatactgtctcctaaatattgggtgaatttagtatatcaaggagggcagggcactatacccgtaggggactctctctctccctctgtctctttgcctttctcagatatgcatctttggtggcagacctggggttcaaaccacagttgttttgaaatttctctttccttctccactatgctccccctcactgaaactttaataataaaagtagcacacttattgggcatgtatttgttatgtgccaggttctgtgctaacagctttaagtgcattattccacgtattttcacaacaagcctgtgaggaagaggttatttccacttatagataaagaaactgagacttggagaatgtaagtgattttacccacaaacacagggcagtaagtgggaggccctgttcaccttagaacacctggcttctatcattcatggtgctgtttctagtgtggtttgaagaacctgagatccaaactgctatacaagtgacctgctgctttcttggagagagaaatctgaaagacagtggagccctcacattgtctttgcctgtgcacagcagatactgccaattttgggtgggttacacttgtttaccacgttgcttacttcagaaatcaataaaattctcttcatgcttttattttacaggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataataattttacagtttttggttcccctatattatataacataactgagagaaaaacaactatgaaattattttccaaagatgagttttatttatatttatcacgcttatttgatgtggttatggataaatttaatttacaagtgacatgcacctctgaaatgagaagactggtctatttggctccatttttttctaagcaaaaatgactcatttgtgaatatgaaagcttatcatgtcaaaactgattaggatctaccataacaatagtggaactctgaaagcaagagacttctcctcttaagggatatgtctcagcacttcccttcaatcagaaggtctctaagaaagctgtcctggcactgaagcctgcaaaatatatttgcattttgcagctgaataactagacgaataagaaaagcaacaggcagaaaccaacagcttttttttttaaatcaatactttgaagggcaaactaatttcagatcacaaatccttcaaacactggtaaattagaagctaagcaaaatgcaattgtgcaaacatttcttcaactttgagtagagttgaaaaaaggaaaatagcacatgggttcatgtgatagattaatagaacaaaaaaggactgtagtatgtttcatggttgtcctcccaggcttccagcactcaagctgtaaaacaggatgggtcctgtttgtgaaaagattctaccagtctccctgtgcttcatgtccagattttaataaccgttatggaaaaatctcccctataacccaacccatttatacttaaacccatttacacttaaatcttctccaacacgaataaagaatggcgtcctggctttattataacctgctaaacacaatcaatttgctctatgaattgaaatctttgttcataattttaaaacctaaaatgtaaattaaaatgaacaaaatatgctttgcacatcaaactgtcaaggatttttgtctattgctttttcggttttgctttgttttattttaatttaagaagtgaatgtaaattgttacaaacttttaagaaatacatttggatatatgagtcaaaaatttgaaaaaaaattttttttaacttttttttcttattattatactttaagttttagggtacacatgcacaatctgcaggttagttacatatgtatacatgtgccatgctggtgcactgcacccactaactcgtcatctagcattaggtatatctcccaatgctatccctcccccctccccccaacccactgtttatacttgctaagatagcaattaatttatacgaaaataccctgagaaaataatcaaaaataaaggaaaatattgtacacatgatatttcattatcaatatgatgtaggattccttaggtaaattctggaatatttaaagactgaaatagtatgtatcaaagtcatgttttctgatatatttctaatataatcctcaattatataaaccttcttaagtaatttccaactgatctggctggattaactgattctccctgatccgtctataaaatatcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatagagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgacatttttgattaaatgatcaaagaagtcctccccacatcatcatattcaataagaaggattctatggtatactgcacacatatttcatatatacacattgtacatatatatatatacacacctgttatatatatgctcatgcatatacatgtatgtatgtattatatgcataggaatgcaacaaaataacggcaatatctccagattgttgatatatagttttttgtttgtttgtttgtctgtttttttgagatggagtctcactctgtagtccaggctgaagtgcagtggcatgatctcagctcactgcaacctctgccttctgggttcaagcaattctgcagcctcagcctcccaagtagctgggactacaggagcacaccacaacaccgggataattttttgtgtttttaatagaggcggggtttcaccatgttggtcagtctggtctcaaactcctgacctcaggtgatctgcctgccttggcctcccaatctgctgggattacagacatgacccactgtgcccggcctgatacataagttcttattatactttcctgccttttccaacatttctataataagcatatgtaccattatactaaaaaaagtattttaaaatctgattttcaataaaacaactacttattttcttattttaataaattttgttttcatactttggaggaacgaaagaacctgtggtttactgtatctccattataccaaggaagttgtgctaggcacattctgtaagataattcattaaagagaccaattcattcagagaccagtataataccactagcaaaaaataaaattatacttggacttgggttctgttttctttaaatattgctacaatgttatatagccctatgcactatttttgaattttgttctgggaatctccagtttgttttttactattgacagactattatctttacttactaaaatagcatatatatttacatgtcataatttgctcatgtagtaaatattttgttttatcaaaaagaatatatgaagttattaaggaattcatgttcctaggaaacacagcagaaattaattttgctgtataggtgagcagagcagattaaactgcttatatttttaaaactagttataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgcataatatcaaacttctaaaaagttcctaggactcaataggcatttaataaacacctatcagataaatgaattttttaagagaacacattacataatgctttctaatagcaatacagtgacaaactttatttttaagtaaattaatgcaaatatgtatattatttaaaattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatgaaatttaggcttggagaaaacaacacttcgttaaagattttatagctgctcaagatttgaccaaggcttttaaaacttcaaatgttcttttccttattacactgtttcttatcaggatttgtggactttggaaagtaaaatgaaaagtcagagcaatgtgagttagtttgataatctcagtggccagtaacagctatccccactctgaatatataccaaccaacctctcccctttctccaaggaagttagttcttggcaaaggcatttcatgcagtgtactttgtcattctaaccttcctttttttttgtatgctcctgttgctaatcatcctatttctatgggcttcagtcactcttttagcttttgtcttgggagactttctgtctgttgacatgacttttaaaataatcttctcccccattgtatttatatctcattagcctaccccccctccccttgtgttttagaagagttttattgtctgtcatccctctatagttcccaccctgttacctgcccgtgtcctgttcaaacacttgctccttttttccttgggcaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggtaagagtcttaaaatgcaattgaaagaggccaatcttggaatttcatgtagaaccatttataagacaatttgaaattggggcctactgtggtgctatgttgacacacaggaaagggaaggacaggtggctagggtaccgcagaaccaggtgccgagctaactactggtctagacctttatgagtaagtctaggcaattcttccagatataggagaatgagtaaatatgaaccctaggaacagggttcatcagctcaaatcaaaagctcagaaattattttttttctggccttgacttacgcttatataatggtgctcgttcatggccagaaaaattcagaagcctgcagatacaaggacacagaaatccaaaaggtaggtaggaatgctccccctttctttggggatttagtttgtcctgataattccatctggggacctgaattttcatggatatctcaatgtattctaaggacccagattgaagtataacagaagtgtttctagttttgtttgacatgaagaaacctctggacataaagcttttcccatccctattcagcctataaagcaatgtttctcatccctggcagtgcattagaattgcttagggagctactaaaaatgtttcatgtttaggtcccatctcagggcaattacatcagagtctctgagtgaggaccttggtattggcctgatggagtaagtctggggtagagcctaacattctacatttttaacaagctcccaggtgatgctcatgctgccagtccccaggtcaccctttgagtgttaaggctagagactagaggaacaggggagacgtctaagtattggtgaggtttgtcttggttgctgctaaatgattgctggccatttcaacctggggtttcctgttctgtgtttaaacactgactgtattactggtgtcatgctgtgactgttgatataagcagtggatctcaaaaatccatgcagctcctgcccaccattttcatagtctgcttataattagccgctataactaatagtttccaaactgattttctaggcttagaagtggaaataaactgcacccggacccagaataccaagtgcagatgtaaaccaaactttttttgtaactctactgtatgtgaacactgtgacccttgcaccaagtaagttttagtctttctctgattaaaacactagatataacatgagagttatcattttcctagggaagtaacactgactgagagttaagaattagggttctagtcctgctttgcctccaagcaactagatgactgtttgctcatttaaacactggtgaacttcctgtgtaggtgacactttgctggccacttaagctaaagatatgagccagacatatgcctggcatcaaggtatcagtccagaagcacagacagtcaaggaaagcaatggttattgtgtttcaacagcatgagaatagcatcagaagagacttatgttccaggtgttacaaattatacagaaaaacttttcaactctgcctgaggagatggaggtgaagacatgaatgtgtctcatgacttgaatcttgaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgttttatttgctaggaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcgtggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtgaacatggaatcatcaaggaatgcacactcaccagcaacaccaagtgcaaagaggaaggtaattatttttttacggttatattctcctttcccccaaccccatggaaagatgtgaagaaaaaccaatcactcttgattactagaaagtcctttatttaatcttaaagattgcttattttcatataaaatgtccaatgttccaacctacaggatccagatctaacttggggtggctttgtcttcttcttttgccaattccactaattgtttggggtaagttcttgctttgttcaaactgcagattgaaataacttgggaagtagttcacaaagatttgcctcattcttacctataaaaagctaccactttggtagatttatgtattgttaatttcttgcccctgaatgcagccttgagagctgactgataagaacaaatgaaattattcctcagctagtttctgagcaacagttttggggcattgagtggtattctcatccttcctatgaacaggtgttctctgcagcagcagaattggccaaaaatcagaagcaattcttcactattcattgagatctccctatgcaaaaagagaacacaagaagcaaaggcattcccaggaaacacattgcagggaacactttaaaaacttgtacttcactgcctcctcttcctcggcctaattgcttgtttttaattatttctccttcttaacttaaaatactatggggacacatgttatacaaaggtgacttagtagagtcagtagaaaagccaaaattagatattatcataattagtctagaaaaatccctttaagtcattcatcaactacagggtcacaccaactttcagtaacttagaagtattcaattttcccttctcagaacaattatctgtttcttcagttcagttgaagaagaaagtttgccttgcctttagcggttgtttagctgaaaatacatttgggatatttaagcactgtaattgtgctcagagacatacagattcttctatctcacattgactttaatgcatacacctattgagtatgtatgcttgagttatttgtgtgtgtatttcatttctgggcatccatagcaagttgatgttgacttgcttgtcctacggcttctgcatcctgccatagtcttgccgtccacatctttgctggacagagagtggtgcttgccatatggtaagtcaaaagccatctccttgctaggccagcctgtggtaattagatgactaattaagatatgtcctttcactagaacacttgacttagtagtacgaaagttccaaaatcagcggtctcctgcgatgtttggccacttttaagtttcactgaatttctcctttttccttcttatatttctcttagtgtgaaagtatgttctcacatgcattctacaaggctgagacctgagttgataaaatttctttgttctttcagtgaagagaaaggaagtacagaaaacatgcagaaagcacagaaaggaaaaccaaggttctcatgaatctccaactttaaatcctgtaggtattgaaataggtatcagctttccttgaaaagaaaaatagagaaattagtgatttggctttttgttacttccttttacttttttgtttcttgtttgtttcattttgtttgagatggagtcttgctccatagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctggtctcaaacttttgacctcaagcaatccttctgcctcagcctcccaaagttctgggattataggtgtgagccatcacatccggcctgttactttctttatttaaacattgcttgtgtttgtgggtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagagaaacagcctttaccaggcatgggttcagtatccaagcctgagcaaagagattgctcttaaagtttgtcataagggcacagcttaactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttagagtagttatatttattatttattttaataagtctatatgaaaaataacctcaacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgcttccattttttgctttctaggaaacagtggcaataaatttatctggtaaggcttttatcattttatttcatagagatggcatcctttagagtaataggccaatttcagagtaaaataatgttactaatttcagtgacatattatgggatcttgttatttctcatacaattctacctgctcagcataaagcatttatcaggcagtttgtttaaatttataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcagactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 123 - DNA, 87641 bp, Homo sapiens
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcgggtgagtggtccccagcccgggctcggcggggcgccgggggtcttcctggggtccccgcctctccgctgcgcttgacagtcgggcccggcaacccggcccccgggcggaaacgaggaaagtttcccccgcgacactcacgcagcccgactcccgtagctgcagggattgtgagtttttcttgaaaaagagaaggaaagttcagttgcaaggggcgcggggcacgtttggtcccctttgtgcgagcaggaaaggcgttgtgttggccgcgttcgaggcgagcccccacccccggaaagggaagtttgagaagttggttatctgaaggcggccggggagcagcggcccggagcggcagcctgagctgccaaagcagccagcgcacctgggccactccgcccatggcgatgccgcgtgcccacccagctctttctgagccacccgttcaaaaggccagctcctcagtccttagctcctggagacggccacgctttccctcaggccggcttcttggcccggagtttttggaaacaagtttcaagaaaataatcgatttccaaaagaaagttagctggctccactgacgccttggcatggatggatagggagtggagatgctcaggtgaaaccgagaatccctcactgaatgcctactgggtgctagaggctgtagattttgcctggaacaagatagtcctgtcttcagggagttgatggttctatgcaattatcgtttgttggaaaccgaagggttaaaatcctaactaggctacccacctgatcgctgtctctgaaggtttttaaggaaaaaataaaaataaaaaaatatatatatatattatatatatataaatatatatataattatatatataaatatatataatattaatatatatatgcatgcaggaatgggggttcttaactatttgttatggaaagtgtaaaacctctgagacttcaaaagttagattttttttttttggagacggagtctcgctctgtcaccaggctggagtgcagtggcgcaatctcggctcactgcaactttgcctctgggttcaagcgattctcctgccttagcctcccgagtagctgggattacaggcgcgtgccaccacgcccagctaatttttgtatttttagtagagacggggtttcaccatattggccagggtggtctcgatctcttgacctcgtgatccgcccaccttggcctcccaaagtgctgggattacaggcgtgagccaccgcgcccggccaaaagttagactttttgcagctatgatccaaataacagtatctgcagctgtggtctgggtaaccgagtatttgggcaagtcatagagctttttctgggccttagtttcctcatctgtaaaatggccagcttgaatctgggtaattttacatcatcttcatgtttaacatcttacgtatcgtgcccctcccctcctttcccctggctcttctggtgacttggagatgacccatgtagactttggatgaaatgtagaggagttgacagtccacatcacccggaggcactcattttatttatccagggacatgggcagatttacctttaggtttgtctagaaaaaatgcgcatcacggtcagttgtaaattttagagtgtttgaagtggattgggaactttttaaaaattatggcatacattgaaggtggcatggagatggaagcttttaatcaaattaggaagaggcactattgcaagcaaaaagtcttgacacacatttgagtcctatggttttaataaaatcttagtgtttcgttcttggcgtttttcctgcattgcagtaccagaatgttcaattgtctctcattttcctccagacttttaaaacctaagtgacattttgctaataaatatttaaaatggcacccttaattttctgtggatgttaaaaatcattacaacttttgttccagattataaaagaaggaaattagcaggccctgatgttgttagttaggttctgtttacaaggataaggtttatgatttgcaaattccagacccaatagttcacgagtcactttcatttcatcaatatacacacttttaaacaattagcttaaaaacgtggtggctttttatttgggtatttagacagttttacaaggcccacagatttcatatttttatagaactgaagtttcaaaatggttgaattaatgaatcattttgaatttgtattcatttgattcaaattaaattttcaaagttggccaatggttgaagacagatatattgaagacgagaaacctaattctacttacattttaatttttcatgtaagtaaatagtttcagaatttctctaacgtaattggtaaactgaaaacattttttcaaaatatcttaatgcaagataatatatcaggtaatgagattgtttaataaacaacaagctccttttacgtcacctaaaaaggcccaaaaatctgtcttctgtttagtagcttctgtacttctgtttagtagtatgcaaaggatttaaataaaagaacaaatttcactaagaaatagaaagtttttttttcttcgtttttgacttaatagattcactcttcctaaatgatcaaaattaagaaatgactcttttggggaaaactgtaaagtgcacaataactcttcaggtctgaaaaatatgacttttcaggttcctggaagtagatagattcttattgaggacaaagaatttgtaaaagtgtcatagtgatcaggttcttcacatcactttaataacctgcttattttgtcagggtaagagactagacatcattaggccccaaatctgatcttcagtctactcgtgctttttttccgcctcataaaaacacatttccacctttaggccactcaacatcttatttttaatgagttatgatttatacaaaatactaatcacattttgaactcattgccttcttttcaatgtagcattccctaatgatgactgttgtctatgtagtcaacataactactacatgttttctactcagttatgaacatgactttttaattttttcagtaaggttagtttttaactctggatcaataaggcacctctgatatcattgcaaaaactgggcattttttcttctaccttttcaaccatatttattgagtatctcttgccaggcaggatgctcagacctgggataccatctcagatgaataagacagacctggtctttgccattgaatttaacagctgggagcatgttataagtaaagaaaaggatacgtgttttaactgtttatatttgaaagcattatggaatactggtgttttattttctacacctcattttcaaaagcctcatttttttttgttgttgtatgcactaggaggatgtgcatgttgaatgtttccttctaggtcccattgaatgtatttttgaatcaatttgttgtctctttcctatccctgccttgtcacggagccccagttgggcagcctttaattgcattctccattccatagccagcatgatggacccaatgcgttcatttagtgctctctttgaggataggctggtggtagaagagtgtagggtataaactttggaatcaggccgtcctgggttccagacccacttgccatgtactggctgtgtagcctgttgtagttgctttacctactagtcatccctggtctcatttgtaaaatgaggattatggagttatggtgaggattaaataaaatattgttttaaagtatttaacatggtgcctgcaacatagtaaatgctcaataaatatcagcttctgttattactattaactccttaattgggcttaccaggggcctctgacctggttcccatttgactctgctgcttcacatcccaccacagcccacattttcccagtctatttgtgtcactacacatacacacaatgtgagcaatttaggcagctgttcctttgttcaggatgtctggaactcctgctacctggctaattttcactcatcttttaagacgtagttcaagtgtcatcttcttgaggaaacctgctttgaatgtcccagtttgaggtaaatgtctcctatgagatacagacctctcacttagctggtaacaataccaagccaaagtcatatctttacgtaactctcttgcccattatacctttaatcctctcaatcttattcagttttctatctctgggatctctggcagtgcctgacacatcatttagcacccaggaagtgctgagctgagcctccacttcatcctactgtatctaatgcaactgaggtcgagcatttaactaagcagtcactgtttgttaggtgtttggtccaaatagtaaaatctttactttcagttagaatagttttagttctgatcacaataagtaatttgactgtttttgaagtatggaattggttcttgtattctcatgaaatatggaaaaagatgtttcaacttctgacaaacatgatggaaagctgctagaagttttcatgcaattcctttagccataaattttgaatcagtgtagggccttgaaagccactgcaaaattttaaataaagtcaccagaggaattatccagtagatactgattcctcttttttttttttttcatagaagggtgtcggaaagagaattttattacgaatgaagtgctaaaatctaaatttattttttaagtttcttttttcattgggttttatgttttggtttataagggtgaagcagcgttggttgaagggaagtgtggtcttgtagccaccactgcctactctagagtagcgtggatattatttaggtctgatgcaaaccaccaaagcagttttaaatagggtgcaggggaaacatacttcctggctacagcatggcattatttggccaagttccacataaaagcataactctgttaccttgttagcttctaccctccaggtccttatgtacaacttcagcagatttaagttatgattttcagtagaacagatatgcattcgcagcaagaatgctcaccgcttcttttgcactctctactttcctggtaatattttgctccacaggtacttgttgcttgtgactgaggcaagataatgactcatacttctttgcttggcatgccaaagggtttggaatgctggacaggcaaattgtctcatctcagggagaaggaagagaaagacaattaacatttgagaacctaccctgagacagccacttgatattatgtatctcatttaatcctaggaagaaatctccaagataagttttattatctttattttatggatggaaagatggatcctgctcagggtctctctggagttttgcctgggtgcatgtatgagtgtgtggcccaagcttcttgtgcttgcatgctgctaggttctttcgtgtggtctctatgtgtgtatgcgtgtgttgggagggaggctgaagaggggtgaatggatatcagatttgagagaggggaagcttaccatctaatgtcatcagttcagtgctcctgatttaattgatttggtttgcttgcattatctgcctccttcctgactacatttgtaccacagaaaatcaagataaggcagagtttctttgcataaggaaactctacagcccacagtttgacaatggtgtcttagtggtaggactcatggtgggtgacctgtggtttggccacttatagcagttggacataccccatttgcaaagatgtgtattgtaaaccccaaattttgagtgtgtaggacaatcatttgtgtacaatcgtgtacaactgctgatgagggcaagaagagccgactttatccaacataacaaagaagaaggggacagtttgacttttgaaggggacaatttgaaaacttataggaggttaagattctcttcctcacccattacatcaggagtacttctgccttttacttgccacagtcagctttctaggtcttagcacccaacaagtagcaactatcctcttgggtgtagtcagtttagtctacttatggcctcctgcttagactcttaagggttccctagcatctgtgttttgtttgtaggtttgaagctatcattattagatgagatttagcttcagggcccgtacctatgactggggagattctatctgggaaaggtcaagacatgcagctcttttttttttttttttttcttctcttttctgagggaatattttcctccaatttttttcagctctacaactaaaatatagacctagtatatgaacacaactggcctctgtcctgggccttagatggtactctgctgtcattcttctctggtcagagccatgcctatggggtgaggtgacttttgggccttccagtcttactctcttttcatttttagaccatgatttggttatgtgggaacccacattcgctgtccagaaggccctgaactggtatctgcagtttgcatggatccttgaagccatcttcctgaaggctgtcattgctactggttgtgcaatctctgcacgagggttgtttaagggatagctctgtgtgtgtgtgtgtctgtatgtgagagagagagagagagagagagagaaagagagagagagacagagagcgagcttgggtgtccacatatcacaaggcccctcttgatgtaggatggagcaggcaggggggaggaaggcaaattgattaccagggctcaggatgatgtctctctttaaaccacccatttctgtggaaggactatgaacattgtaggagttctaaagttgtacctggtcttccaagacattgaaaagatatatttgtcagtctaggtagaaggataacacctattttattgagcagtttgctagcttgatttgtaactttaaatgttttgacttatggtacatgggcctctatttgctcacttgccttgggccttcccatgttgggggtggatctgcagcagcaacattcctttgcagagatgttgggtagaaataagttttggttaattgtaccattttttccctggaatagacaacattgaacattaaagaaaaaatgagttactttgtagacatagtgctctatttcctttgggaaatgtagtttttcttagtttgcgttgtcctgaagtgaactttagctctatactttttttctttcctttttttttttttttttttagatttcctagtgccctagttgcatttcttctgtgtattgagagaccaccaggcgggcaaggtgaagtttatctgaatgttttttcctcctattgtaaatattttatttgaaccaaaaaaaggcttggttcttctcaagcctctttaaagaaaacaaggaaaaaggcttctcagtgctttagaagatataagattgtcaaaacttcattttagagaactagggatttggttgaaccaacatgaatgcctttgaaagaagatatgggttgggtgcatattttcagtatatgctgcagcagctctttattaaagtataaatcattacgaagtcttcatttcctatggggcgataacactgctgctttgtggatgactacctgtcacgcccaaatcctgcaaacttttctacatagggaaatgaaattgggcttatttcccctgtagcttttctcaagagacttcatggactaatttcccaataatcatagtagctaccacttattgaggtcttgctactgcacggatcatgctgagtacttcaggtgtattaaccctcaaaacaactttagaaggtaggttatattatgcttattataaatcctccagagtcaataaatttgcctaagtccacctagttagaaaatgattaggctggggttggaaccaagatggtctggtttggggatctagattcctaattgttatactgtactgagactagtctgccttaattgacataaactacttgtccattatagcatgggtgttggaagactagaggttaagagaaataataatatccaacatttttctagtgttttagcattcttcatatattatcccattgcattttcttagtgtaataaaataacactcggtttatacaccaggtagtcaaacatcatgcctgtcttgtgatctcaatggaaaaatgaagtgtatacctcaagtgatacagtcttggctgaatcatggaacaattatgccatcaggaagtttaggtattctgagtaaaacaggcactttatttgaaaggactgggagacttcacagatgcatcaaatatgttgaggatataaatgccaggctcaggtggatttactgtgaagtgcttgaacttaaccttcaaggctacctataccctggtataggtccatctcctggctctaggagaggccctggcaatgtggttaacaagtgtcatcaagtcaaatactacgaaatcttgcagtgccctgaatcttacagctcacatataaaagaaacctgataaaagttttccaaatttgaagtcaatccaaaaaatttatatgacattacctgtaatgaattatgaagctgaaaggaacttttccaaattattcaagaataaattacaaattctgatctacatttctaaagggaagactgaattatttttctattctctcaatagagaatattgcaaaatgttattggaagagatgatcaaagagtgtgcaaccaaaaaatataggagaattatttcagaggtatggcaatcagttaataaaaatatttgttttttaaacacttcatatttgtagtatttatagcttttaaaaatttgttgtttgtatgatactatttaaaattttttttccagagatgagatctcattctgtcactcagtctggaaagcagttgcataatcataactcactgcagccttggagtcctaggttcaagcagtcctctagagtagctcggactaaaggcatgcaccaccaagaccggccagttttttgttttttgttgttttttaatttttgtagagatggtgtcttactatgtaccaagtctggtcttgaacactggggctcagaggaacctgtccacctctgcctcccaaagtgttaggattacaggtgtaagccactgcacccggcctgtatgccattttaattctaaataaatattcactttattcttaattttatattcactttattcttaattttgtattcttcttcttaaagagtgcccctgaaatttacaagcttcagattccaaagacctgagtctttgactaatggtaggatttgtttgttggtttagaaaataaatgttaaaaaatgcctcttcctccttccccccattgcaaacagagactgaaatctgcattgttatttcacaaaaccaaaatatttttcctccaggtttagctaaacccttcatcattttcctactttagagccccatgccaagtagaaaagaagttgcaaagatgtaattatcacaaaccttcatcttggatgaaagataacctagctctgacccttagtttgagattagaaggactctacctaggagacagctggtaaagactaaggtatgttgtaccaggaatctaggtgtctgggtgaccaggctgtctttcttcccactggggctcattttccttctatacagtgacaagaattggactaaataagatttccagtattttctcttctgaaacatttcattctttgttatccctgtactattttgttagtagaataaatcattgaagttgagttagaaaatctttagctaatcaaaatagaaaactaacaaaagtcatgacaggtcagaactgagaaataccacagacttccactggtgttcattggagatgactactattaaaaaaagagaagaaaaaaaaccatagctattttgaaaatttccgactacaggtgtctgagcatacatcctgactaaatagcatgtttacttcagctagagctcactccttcctaaataaaaggcttacttggttttggtggtaatattattcctctttggttaattatggtattttcattctccccttcctctgaattggttaaaatgtctgtgaaaatttttcctaaggtagaaagttatgaaatgctttgctatgcctaggagatgtaaagcctaaaggaactttcatattttttgggaaaaaaaaaaaaggaaacttgtctagatataattagtgttctgttgcctttcaaatatttctctaccacttttcttaaaatattctcagaaaagacagaatttgcaacagattggcagttttcagactgctgttttaggcaggggagtagctgccgcaacctctaattgcatttctgtagagtttgcagacacttgttagcgtagactaggaatctttcaacttttgctgtgagtgactaccttgttactacatatcggatttgcgtctcattctctaacgctcatagtattggggaagaaaaaaagacaatatgatataatttgtccttcaagtatgtgaaaaggaaaaaaatctaataataacattttatgttcattattttggaatcccttaagttatatcattataaaataatctaacaatctcaatacccctgggcactcttacttttatttttataatttatattgttagaatacatttctattctcttaggcctttgttcattctactttctcacttctttaggagcctcattccttcctgaatattacattttatgagttattatatgcatcaaggcccaaagcttgagctccagcattctgaccccgaaaatgatggtttcctatcatcttctgataacagcaactgaagatgttctaataccttgccgcttacaggaggtctggcatcactgagaatttattggaaatgaggattgtgggtcctctccccagacctactgcaacagaatgtacactttcacaaggtccccaggtgattcctgtacacatagcagtttgaaaaacactgctgtaatagcattaaagcatgttccaaagagtagccaaatgatctgcagtggttttagtggatcacatcaggcttgtttctgtcaataaagaagaggagaattcaaggaagagttggcttagttttatgagagtcttttgactcttcctaagccgttttaactaaagctagcagaagacagaaggcactggtagcaagtcaactaaatgagtcagtttttaaccagtctgtttccccagtcatccttcatgagtcttttgtccactgattgtccatcccttgaccatggtgaactgtagaacccaaggacccatttcttttttctttcttgttttttttttttttttgagatggaatctcgctctgttgcccaggctggtgtacagtggcgcaatctcggctcgctgcaacctctgcctcctgggttcaagcgattctcctgcttcagcctcctgagtagctgggattacaggtgtgcaccaacacacttgactaattttgttgttgttgtatttttagtagagacacggtttcaccatgttggtcaggctggtctcaaactcctgacctcgtgatccgcccgcctcggcctcccaaagtgctgggattacaggcacgagccatcgtgtccggccccaaggacccatttctatatcgaactcactgcattaatcatgtttacctcattaggcatttactcacagattgccttgacatatgtaggccctaattcattctggagctattataccacagcatttcttaaaataggtagcactctgctctatacaaagtaggtacccaataaattaatgattcgatgacaggttttcaggaagtggttttactcttcaacattttttaatcctcttttgtcttgaggaacttatttgtctgatgctcagtgaagacccaataaatttctcttgaattgctcaacatttgttttagacttttctgagagtgccactgtaggctttttcattgatttgctcctttattttaatatcataaggcagctttttgtgacttagttacttttgtcttccagaattatgggtccctgtcagttattaatgctcttaattaacagtagccacaataaccagtccttacaagcagtttctgatgtttccaaataattttattttctgacttttttttctttgcctttgacatctgaactatacttggcaagaaaaaaaaacataaaaactttccattgcaactcatatctcatggtgattcctgttgcatcaaatcttaagttatccatcagaaaagttacgcaaaatctataaccatttggttttatttttgcccttgaattatgctaccgtaacacaaacctgaactcttatatttgtcatctgtaaaaatcacctaattggtctctgcttatggacaccctttgttctttctctgtcaataacacaggcattgccctcagttaaatctccccccagatggcattttgaatagctggcctctgttagaaagccttccatggattttatgaatcctagatcatcacatggccttccctttctctttgagcatgggggctgcctcagtgtcccttggctcctaagagagtgccttgtgctgatgggacacaggaccagtttgatgactacgtgcacagatgaagccaaacctcttgcccatcatctattccacccttcacatccctcatgccctggttccacttgaacccagctgcctcacacatcctttttgcttacaaatttcctagcttgtgaccattctccaccacctccccccaagttttaccattctctatttgtgccctacaacggctccaccctttgaaataacgcctggtctaaatgttactttttctagtgggccttccttgattatccatcccactgtgattccttttcctgcccatagcctctccgacaagccttgcattctcattcatatgaccttgtttgccaagctacctgtgctgtctctgtgtgttttaaactattttactagccaggcgtggtggcttatgcctgtaatcccagcactttgggaggccgaggcgggcggatcacgaagtcaggagatcgagaccatcctcgctaacacgatgaaaccctgtctctactaaaagtacaaaaaattagctgggcgtggtggcgggtgcctgtagtcccagctactcgggaggctgaggcaggagaatggcgtgaacctgggaggcggagtttgcagtgagccgagatcgcgccactgcactccagcctaggcgacagagtgagactctgtctcaaaacaaacaaaacaaaacaaaactcttactagaatgaaaactctttgagggagaaacttctgtctgattttgccatagctcttagcacagattctcactaattctgtttatgtgttttgtttgttgctgtttggaattcattgcttttaaaggccgaggaaacttgcttttagatccaaggcggggagtgctatttttttttctcccagatggcttttcaccaccaagtgtaaatgtcaatggcttaaagccacctgtagtattgtttgacagaaccataggcttatggaaaatctcgtatgatctgctttgtgtaaattgttctttacagtggagacttgctctgtctgcagtctttagtttctgtgaattttggggagctgtggtgtgtgggtgttaaggttaattttccatccatcactggctctgcctttgattcatttattctctcatgtgtgaatcttttgcagaaggctcaatgcattatgactatagagaccaggcaaagtcataaagtaaatcacaccatctcacgcaggacaattttttgtcactcctgccttttctctttatgagtcatagatgatttcagtcattgggattgctggaatagggatggctgaaggggtcttggtgcaatgaagagtgcctgaagatactcttctacctacctgagggtaaataatcccatattgcaaaggtgacccctggttgtactttttggaaagccctgttaaaatgatacatgctaaggagacttaaatatgaggcctttcttacctgggtgcttaataggagtgggtttctaaggatggtcttgaatttggccttcagccttctcgtccaccatagtccccatccatcctgaataaacatgcagtctaggtaccacaagtagtgttctcttgtgcaagcacagcttccagctgtgttgcctgcctccctttcagccagatcatcacccatgtagccactcctctatgggaattctggagctaccactgacatcacattacatagatttggactggtagtgccctacctgctctatctatagaggaaaaggagatgaaataagaattttaatattctttttttttttttttttttgagacagagttttgttcttctcacccaggctggagtacaatggcacgacctcagctcactgcaacctctgcctcctgggttcaagttattctcctgcctcagcctcccgagtagctgggattgtaggtgcccactaccacacctggctaatttttgtatttttagtagagacagggttttgccatgttggccatgctgctcttgaacttctgacctcaggcaatccaccctcctcggcttcccaaagtgctgggattacaggcatgggccactgcacctgaccagaattttaatattcttaagtcttaatattctgtggcacttattggaaatggttgaaatataatgcttttaatttagcatgtcattggttcactctcaaaactactgaaaagcacttatctttcaagattttaatgatgatgttggtgaggacgtttgtggtaagtagataatcacttacattattcagcactttacaaagcattttcacaaactcttgagtattggttgttatcagtttattactgagatgcctgtggtgtcttcaggggacaggagagaatatgttaacttcttgaataactgctgcagccgtagttagccccctatgagccaagcctattggctttgttactcccaaggtataacttatttcatatatataagcaacttgactaagtattagatgtctgtgtaagccattttctgtgagtcaaaacaattttgttcttccttatgtctttcttcagaggtacatctttaataagttctgggaagggaagtgaaaaacaatgcttgacctctgatacaatgtactgttttgattatgatcagcactttaataaaatttatcatcaagaaagtctttggagtgagcccctgaaaagcttgggaaagtgattgatatggtgtcacttttcttaaattaccttcccatgttgctttagatgaccagggaggctaacttcactcttgtgctctctaaattgaactgtcctgaagttttaagaaaatgaaatgatcagactcagcagttcaagattgtgttggttgatagcagccacttagacctcagttcactatgggtttctgtgtactttattggtggtcaccaagatgcaatgaaaggtcctgattttgtgaacatttctgcccacacccttctttggtacataccttttgagaatatgtaaaatgtctttcattgttaaaatagctgttaaataatattaaaggcaaaaaaaaaagtcatgaaaatagtcatttgcgtacttcttcaggcagatagaaaactagtaccagccagtgcaatggctcaggcctgtaatcccagcactttgggaggccgaggcaggcggatcacgaggtcaggagtttgagaccagcctgaccaacatggtgaaaccctgtctttactaaaaatacaaaaattagctaggagtggtgggacacgcctataatcccagctactcaggaagctgagccaggagaatcacttgaacccaggagacagtggttgcagtgatccgatatcgcaccactgcactccagcctgggcaacagagcgagactttgtctcaaaaaaaaaaaaaaaaaaaaaaaaaaagagaaaggaaaaagaaaaagaaaaagagaaactagtaccaggaaaacagaaaaaagaagtgatttgaataatttcagtatgattgagacatatgggtgaaagatcaccagagggaaaaatgtctagtctgataactttgaagaaaacatattgaccatgtctagttataataatcttttaataatctcacagtaatagaaagcttcattattttcaaaacagtttcactttcctgtcatctgtaattttaaaaacagctctctgagatggatataattatcctgttttacagatgtggaaatggaggcccagaaagatgaaatcatctgccccagctgtaataggactgcccatccactgagacatagtaaagtatcattaattaatcttttcatcatttttctatttttagtcatgctccctcactgcttaatttgtaagtaaatctaagataaaaatctatagtctcctcgtattttcatattttcatagctaaattgttaaagaggcgatggcagtgtactcatcaggagacttgttcttgcctcgaacattaaaagcccaatttaagactggagaatttcttctttgagggttttgtccacccatcataagagatttcaaactatgtaatgagtcattttacttttccccttttcttatggggacagcttctctttaatacaccgtgtggtctgccctcttggaggttgtgtcaccattatcagtagacaaatgctgccatgtgtaaaaggctatgccagtttctgcagtcctgtagttttgcccctcactagaacttcaagttgcttaacctaatcaggaatacgggcatctttacataggaagtgcacttcttcatcatatagacatagaggtcaggtattattatctttggcttcctttctcagaaattcttaaacatgaatgtctgaataaacatacagagaagaggttgggcgctgtggctcatgcctgtaatcccagcactttgtgaggccaaggtaggtggatcacctgaggtcaagagttcaagaccagcctgaccaacatggtgaaaccctatctctactaaaaaatacaaaaattagctgggcatggtggcgggcgcctgtaatcacagctactcgggaggctgaggcaggagaatcgcttgaacccaggaggtggaggttgcagtgagccgagatcatgccattgcactccagcctgggcaacagaccaagattccatctcaaaaaacaaacaaataaacaaaatatagagaagaacagaacaagaagtgttttgagtagcagaacacgactcacacagacatctaatatttagtcaaattgcttttatataaaagaaggtatacattgaagagcaacagagcctacctctatgactgacattttcaaagaaaatggctaagaatcactttgatggccaggcacggtggctcacacctgtaatcccggatctttgggaggccgaggagggcagatcacgaggttaagagattgagaccatcctggccaacatggtgaaaccccgtctctactaaaaatacaaaaattaactgggcgtggtggcacgtgcctctagtcccagctattcgggaggctgaggcaagggaatcacttgaacctgggaggcggaggttgcagtgagctgagatcgtgccactgcactccagcctggcgacagagcaagactccgtctcaaaggaaaaaaaaaaaagaatcactttgattagcagaaactatttcacttgccatcatagaaagctaagctatacttctgcttttctactactagctttatataaatgttatttttcttgcaacataaaagaaaaattgagtcatattgttttatttaatttttcttgaagaacacattaaattagctctcacactgtggtgtggacttctttctgttttccaccagtgttcttcagggtgatttttccagtgggcttgattaggactgtgtggatcattgtgatgctttgttctcagtggggattttccagcaaagatgagcttcattaaacaatgactgggttcatggatttataattggagtgattttcttcaaactgtaataaatttcagtgttacctttttctgaacgccctttttaaaagggattccatagcaagtcttctggaataataccttttatataattctttaaaaactgtaatttttacatactgattcctgttaaggcagatgttattgtatcaagaaaagactcaaattttgaacatattaaaaatagtgtttcttcagatctggtggataggtgatgctcaatatatatttgtttaatggaataaaaaaagaaaaatattaaagatcctaggaagagaaattaagttgcagggatatattgcttgtgtaacgtctgtttagcattgcaattttctgaagggaaggctatccacaactgttaattctgatctaaggaactatttcccttcttaacttctttgctaggttatctaaagggagatatgctttctcacatttgtttccttgaacttacttttaatgttgccttgtagggtcaaaactttagaaatacagctttctcaggaaacttggtcctcagatctttcagacattatcttcctttaagcttattgtcctcttgggaattggcaaaggattcccaccctttaaaaagataggaaattgtaaaatccacacttaaaaattaatctaaaattatttttcaggaagaatttatacaatggcaactaaatgccctgcagccaattatgtttatgattcctgcctcatctccaaatggtactagagtttgagtcatatgagaaaattaattgggttgggcttgattgtacatgtatatgtatataataatgttctggttataatgcagtttgcagtttttctagttacagctcaaggcaaagatgagaagcaacacctatgggcctgactgcctctgtccagtactaccatgccccatctctaactactacattttttcctattgaattctccagtccatgtagcataagtcccttcctgaactcagtttatttttctaaccctggctgcacgttaggatcacctgcgaacttctaaaagaattccaaagcctgagccaagcacctagaagttctgactcattgccctggggtaggactttggcatcattattgttttaaaagatccccagatgattccgatgtggaaccatgttgagaaacactaatctagcctaacccagtgaggttacaaatgaagaatttcaccagagaggtcaaagtacttgatttcccacagcaaagaaattccatttactgggttgaaaactcccatctgttgactttaaatccagcataacaaatatgagcaaggttttagaaggttttggaaactcatctgcagaacagagcaaatacaggcctatctaaaagcatacctcacagtaaagatggttaaaaaccaaaaccggaggaggcagagtactcttggtggggctggtagtggggggaatggatgattttccaaaagagaaaacacttgacctgggtctgaaaggctgggtatgatttaaggcaggcactattgttcacttgttagccccagggccatgctactccacttccttcaaggaaacagagggaagccggcaagtggctgcctggggtgtgtgtccacacaccatatagaggcagttcttcagctctgtcagccatggccaaagcaggcagtatttgaaccaccttggaccactcctgaggggcagcatcagacaccaggcatcctttcagacaccattcttggagtctcttccctccatcacgtaaacctcacagccaacagtgaaggcactgaactccttccaggggctgagcaggctgccttgggcatgctcttcttgaccttaaaatccacctgatagatctggtagggaggtagaaattttggtggtaggaaagccagcaattatcaggtcaaagggtttctgataaaaggagttattcagcagaaaggtaatcagattatgggagccttaagtgccagtttgggctaaattctctgagtcactggcagattgtaagtaggggaatgacgtaataaaaccactgcaaagccaggagtttgtgatgggaagataggaaatccctttctttttttcccacatgggaaataaaaatctaaagatgtgtggggaagctccttagagtgccaggactttcagtatcccccaatttatcattaggttctgtccagacctcgttccgcacacagtagcctagagacacctctggaataaggtgtgacaaaaaacaaggaaataaatttattaattttggaaaatgccttctttttcctaggcctccctcatagacattttcctgacaagtccccacttcaggtttcagaaagagatgcaccatcgtttggaattctgaagaaactcaagtttcaattgagctgagtctcagtggcatgtattttattacatctaatgccattttaatgtacttgaaactggggagatgagggcaattggtacacatgtgtaaaccactacaaaaagttcacctgagtgtagaaggtagccagtagcctaaaaaccctgtattttggaggctgttacttcataatctctattatgaaattgggaaaaattatgtaattatctctctaagatggtcttagatccactgttcaatagaactttctgcagagatgaaaatatcttatacctgggctgtgttaaggtttaaggacagcactggtataagatattttcacctttgcaggaagttctattgaacagtgggtctgagaccatcttagatgatacatgtggcttgaaacgtagcaggtgcaaataaggaactgaatttcaaatatagatatatttttatttcagttaacttgaatttaaatagccacaggtggctcttgggtatcataatgaatagggcagttatggagcatcattaaagtccccattcttctcaagtcccaaagaggtccgttcaggtaatttcttagcacctataatcacagtgggacagattaaattacttgtacttttccattcctgtgctttggaattataggctgtttctttgtcctggaaaccagatagtctaatgtttgtggaaatactacttagtagtgcactgcaattataatactttattgtaggaggatgcagccaggccttttttttttttttttaatcatctgtgtttttagttttaatcttaaaaggattataaaaatagtactgccttgtgggagaaaaatatgcttaaagtctatgagcatggagtggtagggattataaaccgttacaaacttctcctggaaattctggggaaagggaagttaaagcggccaatagaaatctcctaggagaaaacttgccctgaagggatgcttttaattgggttcagtatttatcagaagaaccctgcaaaagtggtttccctgaaggcatttggattttcccctgtgaataaatttcacccaccttggtcacctctgtgctgtattctcctagaaactcacctttatttggcatgctgtgacttaaatcctccaaaaaaaaaaaaaagcctttgaaaaagcctgtgggtttttttttttttttttttttttttctctaaaatgttaatttcctttctttaggcttgtgtgggctttgactggaaacttaatctgtgtgcctgggctctgcattaggtttcagtcattgaaatggggcttaataagaattacttgataccttaggagtcagacgagccttacatttatcttgggctcagggatttgcattttgagaggttgtgccagctgacatgagcctttacaggtttcagcttgttgcaaacctagttgggtccatttctctcacttctgagaccttttgctgctgccactcatagctaacgtgttttccatggaacactactccttgtccctaattgtcttctctccctacctcagcagtgacactacagacagccagtcatttaatacgagactcattccttaagaagttgggatagaactttaattacacaaggcatccaagccagcagtcagggccctttccaatgcgattacttttcaagctctgccctgcttctccttccatttccctctgggccttcgttttcagatctcctcagaagccgaggaacgcaggtccttttgaatttctttagatcagtgttgtcctataggactttctgcaatgatgaaagtatcctgtctattcctggccacatgtggctattaagcacttgaaaatggctggtctgacttggaactgaatgtatgatttcatttaactttagttaatttaaatttataaatccatgtgtcctcatggctactgtgtagctctatctagattatgcccttgacttttgaacaatgtgtcttgggagagttctcttggctctggccctccactttcatgaaccagctcctcccagtggggaaagaagaactctctttgacttcagaactgacttccttttattgctaagttagacaggctaggccttgagcttaaaactcttcaccaactgtttataccctccatacctggcctcaacatgtccttttttctctgtgactatatccttattctttatccagcaacagcaaatatgcattaattttctgcagataaggtttcctttggaacttaaggaagaggtatgaaacttggctttggaggacttagggataggaaagccatcaccaagtgtttatagagtaccaaccaccgtgtgccagccaatgtttgagatttggggaatacagagtgaattaaagtccatgtgtacaagctaataaacaagattctatcaacatgtcagcagataagtacagcgcgagggtctgagaacaatggtagatgcttgtaattttagaagcggttgtcaagaatggcatctttgataatgtgatatttgagcagtaattggtatgaaatcgggatgaagaaggcagatctctgggttaagcgcattctagttggagggaacagcaagtacagtgtcctaaaaacagactgtgcttgtcatttcctcccctcctcccccatggtttctcatttttgcttctctttctaagagttacatttataggcatacatttttacactggacatcacaagaaattgagcgagttcacaactccactggtgctggtaaaaagattatgctaagatggataaaagactatgaaacatagtcaaaatgcacttctcagtcacctctggccatacgattttacacatctgggttctcaccccagaatgagataggtttaatagataagattcagtgtggggcaaatctaaggtgccaaagttaggtacatactagaacttccataaagagttgtcttaagaaatagaaagcattataatttgactttgtagccaaaggtcattcaaaacatttcaaagtttagatcacttattccagttttatctctagtactaaatgttatttcagcacacaaatgtggtcattccccatggatggaaggagccagctgtgttccagaactatgttggaagattgcaccttgaagactgtgtgcatggttctcattttccatcttaaaatcactgctggaatctatcttgacttttccacagcccattgacaactgtcattatgtaaatactgtccttttttctcaccaactactgtggctgatgtctcccctccaaaatttatgttgaaacttaatccccattgtggtggtatcaagagacggagatttgggggaagtgattaagtcatgagtggattagtcccacataaaagggctggaggtaaccagcctggatccttttgcccttccattttctgctatgtgatgacacagtactggtcctctctagaggacacagcaacaaagcaccatcttggaagcaggaaagggggctcttacgagacatcagaactgccagtgccttgattttggacttgtcagcctctagaactgtgaaaaatttctgtcctttataaatcacccagtctcacatattttgtatggcagccaaacagactaagttaccaaccttagtgggattgctaggacttggaaaggagtagccttttttttttttttttttttttaaatacagagtcttgctctgtcgtaaggctggaatgtagtggcacagtcttggccatctgcaacctctgtctcctgggttcaagtgattctcctgcctcagcctcctgagtagctgggactacaggcacgcaccatcaagccctagctaatttttgtatttttagtagagacggggtttcgccatattggccaggatggtcttgatttcttgacctcgtgattcacccacctcggcctaccagagtgctgggattacaggcgtgagccaccgtgccaggccgggagtagatattttaatcacaggaggtagcatcagaaaagttgcagctactcaccacaagagagacctttatgatgtttactgcaaattgcatcaaggtcatgacagcaatgagtaatgcccaggaaaggcgaagatcaaccttacactttttcatctaactgcactgtgagaaaacaagcaaaattgcccagtttaagggcagattctcagattttgtttcaaatttcctgccctttgttgtcctttctagaagccttaacaatacttgcaacttctttcttttttttttttttttttttttacttcctctgcttgaaaaacatgaagggggaagtttcaaagtgtttggtgttatcttagaaaccaaagtgaatctgaatgtgtctttctgtcctttttgtgtcatttttcaaaatgaaagggacctttaagttcatcatgtccaacccatttgtttgactggttggagaacaggcacagagagtggttgggtaattgcccttgaactcaaagccccctcatggtcgattcagagccttctccactgcaacctgctgccattcccagcatggtgaattctcctccagtagaagtcatatagcaatgttttataattaacttttacgtgagcaaatgagctccaggagagaagattaaggaatattgctttccatatatctggatggcccagaacactttttaactaggtacttaaaaatctactacaattgttgttgcccatattcttctgtaattctttcatcagctgtgaatgaaagtacagcagttttatttccttgaaaagtaagccaaacatgattttatttcaatattttagaattccacaatcttaagacacatcattgccttcccatctctgcatgtcaaacttactaattttattagcatgttgcgaaataacacactaagtgtctcaaagccaaagtagatcagctctcgcctgataaatgtgcaggagtaagcagaggatttgaaaattgaactggattctcaagttactgcctgtttgccagacctatgctggttatgaacaatatttcaaaaccagattatttggttctagatcctaaacactcttggcaactttattgtaacgatgattgattccattgtatatttgaaagcatcagggcacagtggtaacaaaaaattattatatttcaatttgtctattcattcaaatttcctgaaaggttttttagaagtcatcaaactgctacattctattgatgagtaggaatagatttaccaaactcatacttatcttgtcatttgtttcctgcaattttctttggtgtgagagagcattgcatggaatgttacctttctagcaagtgaatgcttgtgtggcattttttactgtctagaggattttcacaggtacttcaagcatgtttgctcttcatcatgatcctacatgggacgatttcataaatcaggaaatggaggtttcaagaagttaagtggcccacagctaatacatgtaagagcctgaattcacactcaagtttttaccttaaaactcttgggcttcaccaagctgaccttattatatatgtctcctaaaataagtgaagtaattacaaagaaccaaagcttttgtctaagaaacttattgcttccccaccccttgtatactttcttcaactcctagtagtcacacctgtgtctttgccttgtactggaatgtgtgtaaagttctactcttaaactttttgatggaatatctatttcattgtggagtatcaggaaggatgagggcttgtgtgtcaccattggctttgtcttttatttgctttctctcattgatatgatatgataagttatttcatctctttgacccttaatttctccatctataaaatgttaatgacaaaattgcatggtggttgtgataagtaaatgaaataatcatcacagtacttaatactggactaagcatttggtctgcattcgataaatcatgatcatggtaataataattattaacatcacatagatctgatttctaaagtagatgtcctctggccttgaactgaaatgtgattatacacattagagaattacatgcatgttaaaaatattcatattagagagttaaatcatgactttttgcattctagttaaaccctaatattagaagagagaattgaatgtgcaggtgaaataatcattaattgtaaacattcaggtggccacaggggcctggcaggggagtaggtgacatgaaggagtgtcagggaggaggcaaatttgaggacacagagactttctcaagaggagcatctcagctcacagtcagctgactgttgtcttgggatggtgtgggcccactgtttccaagtcttttttatttctttaagtggaattagaaaaccagttttgcatgtgaaatctctgaattttaaaacttggtttatattttaaaaagaaaagagttcaggccaaacagaacacatctgtgctctgtgtccagctcttgtacccactgtagcaatttctgctttagcttctcagtctgtgcccaagttatttggttgttagaaaccaagcgccttggacctcgttatattactttttaaagggatgcctttcccaaatatggtagtactctggcccttttccagagaaaatatggaaatcatctgttttgaccaatattttcacatgtttaataaaactgtaattgaaaaacctttcaggtaccaggcatgcacaagaaccccgcagcatattttgaaaaactgaagcaaaagcctccacggagaaatttatcagtgaaaattctgctctcacagaacattgatattcggaccaaatcccatgcttagttgaggcaaatggttcatttcaggggctgatttttcagattctctaatagtcactatcttttaaaaatctgttcttaccagattttgtgttagtttctgcattttccattaagctgcctcagtactttgagataaagaattgtttaaatcctaaatgaataacttaattaaaaagcacatcttcatttagaccatccttatttccaaagctcttttgatgaaaatcatttcgtgcatttttaaaaattccctagaagaacttaaagatcttgaggaaaggaccatgtcttatcctgtcccccttccctcaagggtttaaatatgagggctgtcagaaagcagcacattttcgtttaggttgactaattttgctggtaagtaacaaattactttagttgaattggaatgttgtaaaactccgtcagtcgtgtatcattatcttgcctctatcagtctgtgccatttaccaatgttttgaccatcaccaagagagttatttaatcatcttttattttcaataataaattatttccttgttgctacagcactccaagtcctgtcaactgagggagaattgttttctcagttgctgtcactttaggtaaagtaccaactttaaagcacttctcagcagaggcataaagttattattttgagagttcatgaaatagtgctccattctactctttcacttgatctaatataccatttgcatttatatggcttaacttttttaactggcttcctgttcttctcagccccaaaccctacattctggtttttgactcatctcatagtccctgcagtcagtctttgccagataaaggcactgttaaagtgagctttatcaatgaaaaacttaagaatttcatgtattgatgacagtatttactataaactgcttgcttctccccagctttcagaaatttgttttattcactgggtcctattagagctgaaagagcatgattgagaaagttacaattgtttcagctttttgaatatggcacaagtgctagaattctgaaatactgcctttggcaacaatgtgtagatatttccacctgcaagagtcattttaaatgtttagattttgtctcctgttatgtggcctgtatctcagagaggtcccctgccactaaaaacaaaaacaaacaaaaaacagaaaaataaatgaaaattcagcaagcgttggggggactcaaattgtacttcattcttcaatgatacaagaaagcaagaaaaccaagtatgcatttttaggatttatttggggtcattggggctggtaagtgttaaataggaaaggatgcaattgaaattccagctcagttattttatgtttgtcactggagaaagccaattatttttccgttcagctacagcttgtttcattccgtagaagactaaaaaaacttccttgtaaattgcatttaaaaaaatttgagtttaaaggtacagccaagatttcaatttaaagtacctcattggatgaattcatttgagacacaagtaatcattccttaatcccttaatttgtttggtaaatacaaatttatgtttatgcagttttcttaaagcaatcatagcaaactactaaattcatgagccaaaatgctagtgaaactcaaacctacaaagctaaattccctcagttgaacaagtccaaatgaggaaatcacacacataaatgcataaacacacacactcacacacacacttcccgtatcagctctgtctccatttctgacctcatgtttgcatttaaaggcaagtaactgattcacatgaggttgccgttgttaatgttgcctctcaaactagaatataagccataggagggtagggaccaacctggtgtttgttttagatgtcttgttgtgtggagagtatcccagacatttgatatccttaattgttggccagatggtaggtagtttcagtgtgaaaatatatatgtatgtgtgtgtgtgtgtgtgtgtgtgtgtgtgtgtgtgtgtgtgtgtatagtactgggattacaggcgtgagccaccgcacccggcccgtactaggtattttactagaattatttcctgctctaagagattttagagtattgattatgtcattcttgacaggttttaaaaactatattagtattacaaaaacatgtgcatgaaaaggaaaattgatgcttttgagcttatctctttattttctgcccacatggtggtctccctattaggtattgtttctccacttctgatcctggtgcccagaggctatgtggggctgtcacttgaatgaaagctgcatgcatctgccatgacagaatctgccttgcatttgctcatttataatgaaaacattttttaagtacagaaaaataatagaaaattcaaaagtaacagaagggtatgaaataaaaagttgcttctcaacctcagttttctacctatttattttccttttacagggccaaataatgtttgattctcatgtccttgcatctactcccagagaccgtctaaatatataagcatgcatgtgtgtgcacgtgtgtgtgtgtgtgtgtgtgtgtgtattccctttaaaaagcagtaacaggccaggcgtggtggctcaagcctgtaatcccagcactttgggaggccaaggtgggcagatcacgaggtcaggagatcgagaccatcctggctaacacggtgaaaccccgtctctactaaaaatacaaaaaattagccaagcgtggtgttgggcacctgtagtcccagctgctcgggaggctgaggcaggagaatggcgtgaacctgggaggcagagcttatagtgagccgagatcgcgccactgcactccagcctgggtgacagagcaagactctgtctgaaaaaaaaaaaaaaaagcaataaaagcaataacaacaaaacagaaatggtggtgtgtcaaccagggttccagttgcaagcagatggcaccctcaaattagggagatttaaggagagtttagtaaaacaagtacttacaaaggtatggatagagtcaagggaaaccaccacaaaatgggagaaaccatagtgcagatacttaggactagtaattgctatgttgacttgctaggcccaaagtggcaaggagagggaagaagtaaatcttggaaatgacctcctgaagagaacctgtgacctccaagtgagggacttggccagctggaaaagattccacagagggagccagaacacagataccttaaatgtgctcctcattgcttcccttagataccgctgggtcaccccattggccaaacttactggaagcttgagggcaagagagccggttgatgtagtccataaagatgagcctcctggggcagacagtctggtgaccaagggtggagaactgatctctaagggcaatagaagacacccagcccaagtaactctatacattggtctctaccttgcttattttcttgaatgctatagcctgggcttcaacacttataaagatagccacatggagctgccctctgctttttagtcgttgcgttgtgttccttgtttggatttgtctaatttattttactagtcttctcttgatgagtggttaaaaaaaaaacctgtttgtccttacaaacaacactgcagcgaatttatcaatgaatatcataaatttttagaagcgaaagtgcgaggcaaaaggctatttgcgtttgcagtgttgattgatatcaataacatgtactcctgagatgttatacctgtttacaacacagcattatgagaatgtttgtttccccatactttacccagctcactgtgttatctgacttattgatctttttcaaaatgagttaggtgaaatatggtatgcatttttaatctgcatttcacttgttagcaatgaggttgacatgcttcgcttttagagcttattctctggtgatatgatcaggaagtaatatttaaagtagcgtttttttaacacaatatagagaactcatatgatttgttatttgtttccaataagcattgataatgattttaaatggcattaattcttctggcacttgtagaatacttactatttaaaagcaagaattataaggcattgtcatttcacagagattttagagtattcactttgtcatctctgaaaggttttaaagtattattactacaaaaatatttgcataagaaggagaattgatgccttcaggtcacttgtctctgttttcttcctgcacacgccatagtctccctgttagctaaatgatggtatctctagtattgaccttggtaccccagagaccatgtggactgtcagttgaaggaaagcccgatacctctcttctctcaaggtataattagataaagcattagggttcaaacacatttttaaaaactaaaaagaaggtattgtattagaagttccaattagagtgtgcaatagatgttcagcaaaaagaactattcctaaaatgttcctatctttggtttaatcacaaggtgtttgtttggttggttggttggttgtagtaattggccaaggtatctgattggcttggggatgtctttcctgaagaattatacagggaatcctctcagattgcttgactttcttctttgttctgggtgggaggaagtgtgtgactagccaatagccttgtcccaccttgtctcaagggtcggagctgctgttgctagcatcacaggccacagcggctttctgccagatggctgcctcagtatctgactcggaaatgctgcaggcaattaaaaacctcctttcagagaacatgtctttcaattctgggcccatatggtgatcagggcctctgggtttgcaatcatttaagaggtcaggctcaagagaaaagcatatggaaagaactggaagatgagaaatgcctgtaaaaaggtgaagaataggtatttaatttcactaactccaaaatgactggagaaagggaaacaattattaaaaactgggttctccacagccttcccactcaacatatagtgggctggcatcacccagggcagcagctcccttcctatctgtaaggtcagtttcgtgtgtacttggctaggttctggtgcccactaatctcattgttgctgtgaaggtatgttgtagatgtgattaacagctaaaatcatttgactttaagtaaaagaaatcattctctataatgtgagtgggcctcatccaatcaactgaacagccttaagagcaaaagctgaggtttctgagagaaaaaatactgcctcaaaactgcagcattgatttctgcctgagttcccaggctgccagtctgccctataaatttcagacttgccagcccccacaataccactatgctacacctgcaggttaaaaatattcccaaagtacttgtgtattaatatttgagaagcagtactctaaaacagtaaattctatccaccagtttccatggattattctttgagatgttatttaattgtgtcaatttcagtggtcttactatgaatatataacactaatcaagacatccacaggtatttgtagaacaaataaatttctgagtttccccccacaaaaaacactccagaaaacaacagtcggtagatacatgaattcaatgatacacgaatgcatgaattcagtgatacatgaatgcatttctgacaagtgtttatggttattgttaaaccttgagattttacctaatggttcagctaataatagacactatttcaaagatttggactaaggtcatattcagaatttctaatatttatctgaaataagtctaaatcttattaggctgctcatctgaccctcaaagacaatagtacagttccagaaatagacacagctaagcagtcaattcatattctcaagacctggaacctctgtctgtaggcagtgagtgtggggaaaatgtgagataaaatggggaaggtggtatgacctagagtgaaggttttgatattactcatgggcttatttgaagagaagtgaaatattatgggccatgtgatactatcatatgctgagagatgctacccatgttcacttcctttagtggatggctttctaggtgacagatattcttattggaacttctttctggagaactttatgaataacgaatttgcctattaggggtagaaaattctctaaagatggttagctgctcacagagagtctataggaatcgaagtacagtcatctcttggtacccatgggggattggttccaagactcctcgaggagaccaaaatctacagatgtttaactcccttatataaaattgtgtaatatttacatataacctacacacatcctcccatatcctttaaatcatctctagattacttatacataatacaatgtaaattctatgtaaatagttgttatactgtgttgcttagggaataatgacaagaaaaaagtctgtacataattcagtacagccacaatcatcaatttttttaaaaaaatattttgcatccacggttgatggaaaccgcagatgtggaacccacagatacagaaggctgactatatactgccttaatataagaatatcttaactagagagacttagactaatataacaatctggattaaaagtaatgttgaagttgggttagggtttgctatagggttaattaggtgggttttgtatcgttgtttagaggaatatctttattcctagctatgcacatgtatgcacttactttccttcccattcctttggctttttaaacattatgtattaaacgtaaggagatgttgtttgatatctgaggtcgtggctggtaacatcttttcctgtggtttggagtgcacagatgcaatgtcccatacagcaaatgactgttacccttccctcccactggccctcatcccactctgaccagcagtataccacttagcatgttattagtgactcttgaggattccggggttggcttgggatgccttaactggatcttacgggcctcagagaatctgcaaaccttctcagatgatctacaaattttgtatttgtttcttttccccaactccaaagtgtgttcataaggcttttatcaaacttaggtgactccagcaaaggtttagagtagctttgccctctgaacttaactacctattccaccagtacatatggtatgcataaaaggacctgaggacctatatcatatagaggaaaagaatactggtttaaaacaaaggttggaatgtatatgacctcaagggctacctggaattgttaaggtggggagtctcctagggtcaactaatagggagtcgatggctggtgctgaacatgtcctgcatacaggcttttgaaaaaaaattctggttaagctcttgcagtggtagcttctgctgtaacaaggagaaaaatgtggcatccctggctgggttcttgtgaagtaatatgctgtatcttaggcaactttcctcatatacagtgggtgctcagcatgtgcaaattcttattgtacactgcccttcccaccatatgcctgtgtctatatgcagtacagttgcttgtttggcttttcttcaacattcaatggaaaggctttctcttgttgggtctacccatcaagtaacatgtattatatctcgccaggggccccgttacagtggtgctcctggagctgtgcaaattggtggaccttctctctctttctctctcctccccctccctccttgtttcccttcctcccttccttcctctctctctccctacatccttcttccctttctctccctttctttcttctaatggtccttttttcttttccctgttgattgtgttctgcaagcatcggacttaaaccacttgcatttgtcaatacatctgtggccaccactgctcccagcacccatctcatctgttttcatttctgtcttatctatcgctgctcactcctgtcactattctcacgtttctaaggttttgctagaaaaggactggccagcacggagaagaatttctatctgaggtgtgaaagagctaatcacctctccttaggtgcatgtttttcacaagggaactaattccagctatatccaggtgctgtcccctcagcagcataagttgtatatgtgtttgtggtggtggggtgggagtgggggggttgctgttttgttttctgtttattgtgttttttccaactaactataggtctgggttctcaaccttggttccacattagaatcatctgggcagcttctaaaaatcctgatgcctcagttaccttccagaaaaattaaatcagactatctgggagtgggaccccttcagtattttttaaatttcctcaggtgatggatttcaacatgctctccaagttgataaccaccaatctaagctaaaatcctaagatgttggaagactgaatttcaagtaatggaaatttggttttatatttacaaacaacaaaccttcctaatcagcaaatagatgcttgtccaaaacatactctatacaaaaaatacgtatgtatgaaataaacaaaacgtggtttcactttttttttgctttaaacaatgttaaagaaacctaaagtgttattagttgtttcaaaaattgatccaagtataaccatgttagaaaaaaatacatattaattgttgtgtttctcccaaatttcacacagttcagagagtatttctgcctatatttttagctaagcatagagctcttggtctgggagacactgagaatttcaaaatagcttgttacctaaaaataaacttcctgaaatgaacttgaggcccgagagggatgaatggctttatttttttcttctatatttactgttaccacaagaaagcaaatcttaaatttatatacgtttatatttttagagacccaggaaacaggtgctatgcccaagctacaaagacagttgcagggcaaagtatctatgacagaatcctaaaattcacaggacagagagtgactgtggaaaggcattgaaagtgttcctctctaggcaagagcggagggaacatgaggcttttcttaggcctctctaagggttatgccttggaaaagtacctcacaactttctgtggcccagcaactgttccagcaccccatgcggtctaagtgcttaatgtttcttagtctagcatgtaagtattaattcatgtttgctggttgagtgcctagtagccttgtcatacttcactgactgtccaaactcatgtcttaaacatcatcaccatctcattgaggaagaaaatggggaatggggtgttacacctttatttgaactgcccctagtttgcagcctgtattttgcaaagaatagtctgtcttccatattttattgaataaatgtgaatgaatatcacatttataatcacattcctctctaatctgagtgaagaagttctgtatcctatcctacatggcatcaagggccaaacatggactccttgtattcatcctgtgttcactcatttatccaataaacatttttgtatgcctgctatgtgaaaggttctcttcctggcactggagatatagtaggtaagtgaggtggagaaagtttcatggagcttacatttttgtggatagattattagcaagtatgcgatgcagatagtttgtgcagacaataaataaaacagagttgctataggatgaagaggtggcatttgatcagagatcagaaaagtgacaggaagctaaacaaaggtaatagcaagtgaaaggcctgaggagggaatgaacttggcttcttcccagaagggggcaggagattggtgatggtggtgataagggagaggtacagaaggcagatcctgaggtggattcagcttttatttgctgcgatcataactccaatgcctcaccaatgcttgggattgtgtctaggaggcactcagtaagtgttagttaatcaattgatttgcctcaaacacagagagagatcagtagaactagtcccttgaaaagaagacccttatagctctttcaggagtaggtcaggaaaatggcggcaaaatcttgtgcctccagcaacggttcctcctttggtgtggcacttcatgactctgtgaggttatagcctccctgcccagctgagcggtgatgctcgcctggctcccacatcctctgtgctgccctctattttgggtcaccctgacttggtctgtttcctgtcttattcaccagctaaactataatttccttaagggtacttttatttgtgggcccagcactccgtactatgcagtgggcccatctaggtttctttattgaatgataagatttttgtagaaagtggaccttatgacaaccattgacaaaagcaaatggctactcaaccaccccaacccctcaccacccctcaccacggtacaatggattttattacaaattgcatacaccagataattctaatctgatgtgaaggaattattttgcctttcttcagattcattctcatgacatcaagttcatttgaaattgcataacatcttcaggaattcattggcaggctgcctggcagttggataatcatttaatatatctttctctctcctcagttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggtaagcaagccttttaagaagttattctttcttttcccctttttacataatgtattctcatagtacacacagtcagtgtatctctgtctcctaaatgtaaacacctgttccatttccctttcctttagaccatctctctttcgattattaaatgtagtttctaggggtgttctctgcatgtatgtgtacgtttatgtgggtatataaacgtatcatgattataaaatgatcatgataaatgtaaagatcataaaatgatctttaatataataaatctggaaactctttcttgtatcaagaagagggatttgccgcttagtagtcatttaaccgacacctcctcagcaccccatagtgagaccaggagctttgttctcttgaggcaatctcaggtctggaagaagaggtgatgaaaggttggctgttggaagagaaaactaccagccaaaaatggggaatctacttggagaaccacaaaaacaacctgtttttttagtcagaaattctggttatattattcatataaccattgggatagatatgacttctttctctcagctcagaactacatatttcttttttttttttgagatggagtcttgctctgtcattcaggctagagtgccatggcacaatcttggctcaccgcaacctccacctcccaggttcaagcgtttctcttgtctcagcctttcgagtagctgggattacaggtgcccactaccacacctggctaagttttgtatttttagtagagacggggtttcaccatgttggccaggctggtctcgaactcccgacctcaggtgatccactcgcctctgcctcccaaagtgctggaattacaggcatgagccaccatgcccgaccagaactatatatttttatcggatcacattttctcctctctctctctctctctctctcattccctccaactcatacatacatctcaaataataattatacatacacagtggatactcatgaatcatttgattaattcatggttatagattgtgagcatgaacaagaaataaccttgatctttagaagagttgtaattttacaaaagtacataaattcattaatgagatatgacattttgcagacttattctgatgtttttaatttattggccattttaaaaaaagtaacttatgtgtctcctggctagttgacaaacaagaatataaacccaaatatctctcccccttttttgggaatgagtcatttgagacccctagaccatgtaaagctagccttgatgatagatctggaaaccttgcaaacttctgtacataccacgggatgaactggtttcttaagaactgaaggaatgttaacagcaaagacttgtcatgacatacttgccaatatgatatgatacctgtccatgtccacttctaggtaacgctttcaaagaaaggatttggacaaagaatgtgttcagaggagagggaccagtgtggttagaggcctagaaatcatgctgtctgaggaatggcctgggcaattagacatggttagtacagtgaagagagatcgtgggttctgctgatgaaattgaaaggctctcaggtagaaaatataataaacatattctgcataactctgaagggtagagggaggatccataacatttgcaaggcaggcagacttgtgctcagcataagtttagacattttcacaatcatggtttcccaacagcagaacaggcttccttttctgtaagcaccaagtgaagttcaggagaggctggatgaccatatgtcaaatagaatgcaggaaagattgagacaccagactagatggcctcaaagcttccttccgtggtttcttaaatatctacggtggtgtgagcacttgcttttgcaacccaaaaaggctcttttaattaagatttttgttttcctgaccagtaatacaagcccaaatcattaaatgtgaatcaagtctctctagaatagaggctttgctagcctcaaaaaaatgtgagcatgtcgaagagaggaggcctccctgtcttttctgtgtcccagctataaagggtaaatacaatgaacattattttgacctgtgctggccaaagaaaattctcccgtgaagccaggggtgttgataatgagaaggggaagtatagggtacgctatagtgccctccttgatcctccttcatgaccaaggcactcattccctgggagtgttggctgttgaaggatcactgctgagccttccctccagtgatgggagctgcctcattcacgttggacacttttcatgggtagccatcatcccatggctagttgatgcagagaaacaaattcctggttattttgccataatgtggtacatctttgaaggacatcccattttcagagtttccaaggcattcactgaggcctttgctgcaacctgcattatagtttagctttttccttctgtgcaatactgttgcctttagtcgcttacagatgcatctccaaaaacctcctgcacagaactctcacagcctcaaggtctgtttccaggaaacctaaactaagacaggaggctattgtaaaaatagccagtgtggaaactgaaaggctctactatgattgtagatttcagtgttgttgtttttttaatcagttttagtgttttttcattcattcattcattcattcattcatttaactaatgtcagttgtgtgcccattccatataaaatgcttaagctgcctccaaggatagaaatattttataaccaaaattattattattattatttttaaattgagagggagtctcccactgttgcccaggctggagtgcaatggcgtgatctgggctcactgcaacctctgcctcccgggttcgtgcgattctcctgcttcagcttcctgagtagctgtgattacaggtgcacaccaccatcacgtggctaattttttgtatttttagtagagatggggtttcactgtgttggccaggctggtctcgaactcctgaccttgtgatccgcctgcctcggcctctgaaagtgcttagattacaggcatgagccaccgtgcccagcctccaaaattaattttatcatgttggttcttctttcagtggaaattgacaacctcttcagtggctcagagcaaatgttgcaggacaaaaaaagaagtccgtatttacttctttgtatttacctttcctatgctcagctatatccaaaaagagtttgaaaagttagctgtgcctggctgttacaggagtgagtggagaaagcagttaagggctttaccaggtctcaagtattacagttgttttctctctgtgatgttagttctctcagtagctaagaggtagaaaaccggaggctctggaagagctgcccaataattatagagcagctttctttcatggctcacagttccttcttaggcctctataagcgtcacaaggaaaagagaccatgcctttctgtgggcacagcataccttcgttttattacccaaaccaaaaacaacctacacacacacacacacacacacacacacacacacacacacacaaaactgtgggggcagggaggaaggtgttcttgttccatgactacagctgatttgaagactgccaagtagctttggggttaaagatgggtagatttccaaattatacatcatttgttgtatgatcatgccaactttcatttagtttcatttggtgtcctgatagccaccctcaaccaattattctgcttgtcactcttcctgtcacagcagggaccaacttagcaaagccttgctcctcttgtgtctttcggaattctagtttaagaacccttgagccccttcacaagcagacacatgtacctccactggagtcaactctgggctgcatggatgttgacactggcaccattcctgcctggattgtcctaacccatacccttgcccttatccctttgtcaacatattgtcctttaatgtccttgacttaagcactaaaaaagtggtattggtcaaagttgctctttctctcatggggatggccccgcatcttttataggtgcaagctgtgtcttagctgcttcttgcttctagcctgccttccgttttccttgctgtgagcagtgagcctttgtgcatggggcagggaggattaggggaaaattggtgagtgagtacatgcatgcattggctcatgtgtgcactcagaatcttcatagaagattactctagcaaaactgactggaccagattagcccttccttccgctccctctctagacagagagaatgcgattcaagacaacaggtattttgcatctaaaaaggacagaggtgaaagggtggatgtcagactagccttgttggacagtcatccaagatagtatgttcatgagggagcagagggaggtagatagagaggtgatacccttttccaagagagccaaaatgttcttttgttcaattataatagtgggcattaatcatgttgtttaaaaatctaatgtacactgacggccaattgagcatttcctagggcccaaggaaaatgctatgtgagaaattctctgagccctgggctaaattagtcttcaaatatgtgctatgaagtgatactgtcaaagtagttagtttatgacagcataaaatatttcattgaactgtaaatgaagaacaccctgacatccctttccatttcttttatttatttgttttttttgtttgtttgttttttctgaattgctcctttctgtaatttgggaaagactgcagttctttatctgcgatgtttcttcccgtttttctcagcagaaccagctgttgacaaggagtataccctttacacgcaatgctctggggcccagcaaacaaaaaaaagaggaactgtgactatttccccaggcatgctctttgaaaacagtatagctagacaggacagattttgccacttaaactaggggtgtgatgtgaggtttgcattacattcaggatggaagatttaaaattatcctgagtacctaggaatgttctttttttccatgtcttcccctttaatgatttaattaagacttaaatatgtaaagttctccaccaggactgccccgtggaacgctgtctgctccaggtgatgtttataatcacaaatgggttccaagaataaacaaaggaaaaacagaaaagagtagaaaagcataggagactataggacagcctgcgaatgctggagaacaggaaccagctgccgttgttaggaacaacttcatgaaggaaaagtattccagattgcctttctgtctggaggccatattattcatttattctctttctctctctccctctcccctcgcttccaatgaatctcttcactctaggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaaggtgagttttcttctcttaagggtgtgggacctgagatctgtgccaattttttgtatccttggtctgcagtgtcatagagcacattcctcctgtggtggattgcatacagtggattaggagctcattcagctggtggaaagaggggcttggggagtagcagggtttgttctggttctcatcaaatatggttgactggggcaaacattattatttgtctttgacaaatagtttctttcacctagagcagtgtttctcaaagtgcggcctcttgagcagccagcatcagtatcacctgggaacctgttataaatgcagattctcaggccccactaaatgagaaacatagagggtgaaccccagctatctgtattttaacaagccctcccagtaattctgtgcagctaaaatttggtaactattgttctaaagatttggatggggttgtttaatcttggaggaggactttctttataactgatgttgtttcttgtacatagtcccaggatttgtctttagggtacttgtcatcgatcccatttgagagaaacattgcaatacagagaggaaataataagccaaagtttacccctagagccaggagaagagtagattagatactagcctccatctttgaagttcagcgtttactcagcttgaaaggaaggcatacactattccctcaatttttaataagaagagaattcagtggtttttaattacaaaagtagtatatgctcgtcatcaaaaatttcaaacaatccaacagtgtgtgaaaattaaaaatgaaagtacattttcgtcctcccctcactcccaatgcaacagatcatctgtattgacaatgtattagatgcacacacgtctctatcattcattcatattatctcccactccatcctctctcccaatctctccctgtcttcctttctctttccctcctttcatccatctgtccatccttccatccactcatccatctttcagtacaactatctgatcatactataaatattattttgcaacacttttttatacccaaccacttttacaattccttctaaacaagatagaacacatagatatactgtacatcttttaatttagtctcgaatttcatattatctcccacgatggatcttatcatgtccctgttgatggattgtcttcagtttttccacttaatgctacattgaatatctttgtaaaaatatctcatgcatttgtgctaatatttctgcaaggcagattgccagaagtgaaatttctagattagaaatatgtgtattttaaatttgaataagcactactaaactattctcctcctgaaaaggatgtaagcatatggatttccgtgtaccttctccaacactgggaatggataagtcttttaattttaccagcgtggtagtgtaaatgttagtttagtcaacaataggtctgatttaattaaaaaatctttttgaaatacaaatgctggctctacaccctatctctgcggccatgtgcattccacctgcgagaagctatgtgtcctcgtgtttcgtgtttggtgctcagtagcactgcagatccagcttgttctcttcctgtgtccttcacctactgccattctccctatcttcctgtccaacatcccccaggccaacttctcagtgaactgaaggcaggcatgcacatcttgtcagggcaacgctttccagattactcttccttcctatgttctcatcctcatcctgtaaatggtccatttctctcgttttcttttctggttgttttttttttttttttttttttgacggagtctcactctgtcgcccaggctggagtgcaatggcacgatcttggctcactgcaacctctgcctcccaggttcaagtgatcctcctgcctcagcctcctgagtaggtgggactgcaggagtgtgccaccatacccagctaatctttgtatttttagtagagacgagtttcaccatgttcgtcagtctggtctcgaactcctgacctcaggtgaataacctgccttggcctcccaaagtgctagaattacaggcatgaaccactgtgcttggcctcatgttctttatgtgatttgagttaggagggaaatctaaatagtttaatcacatgaaacatggtaacacctgatattctgacttaccaggtcagctttcttcaagtagatcaccttttaaaagaaggcctaggctaagccaaaggaattaatctctgacagtagaatacccaggcatgtttactagcattgaagaaacttttctctccttctgtataccagcttgtctacagtagacaagtttatttcctccaaaaggacaaaagttgataaatggcctgcaagttggatctatattttatcattgaatatctttgtcaaaatatatcatgcattttatattttactatgagcctttcagatactaatgacttccattttcagagtctttcaactcaagtgatcatcatgggcatccctcatatttttcctcttatttattctcagactttcttatgaagtgagataataagcataaagacaatttctcactgtacagtacaggaagcctttcacagctgacgactcaaatgtctgggtgatttcagagtcttctaaaatgctccagaaggtagggggtgtttgctttttaagcatctcttttctgtgtggtgggatatttcttccacctaaaacagcagacattaggagcaacattttatattccatttctccccttattgccaccatctcttctttatcttgaggaatgaaaactttttttttttttttttttgagacagagtctcactctgtcacccgggctggagtgcaatggtgcagtctcggctcactgcaacctctgcctcctggattcaagcaattctcctgcctcagcctctcaagtagctgggattacaggcatctgccaccatgcccggctaatttttatgtttttagtagagacggggtttcaccatgttgatcaggctggtctcaaactcttgacctcagatgatccacctgcctcagcctcccaaagtgctaggattacaggcatgagccaccacacccggccagaatgaaaactcttaatgttgatttgtctactccaagtccaacaaggtggtgaacacaaaagctatgaagtgcattgtggctgtattattagtagtacagtactcttgttggcaagttcctgatctgcagctacacaatggatgataattatgtacatctaccttttttaatatgtaagaaaaaaaagttgagccacaagattttaagtatggatctttatttctagtgctactattaatgatagttaatattcagagaaaacatactgtcgctgtgcagggagctcagccctttccaagcatgacctcatttaatcttatagccaccccatgcgagtaggcactgttaggatccctgtttatgcatgagaaaaccaggcttagagaaatttaacactttgtctacaatcaaacaactagtgggtatcaaagctaggatttataatgggatatgtaaggcactaaaacctgtgaaggttttccttttttccttttttaattctttccttttttcctctttttatttccttctttctctttatatctctgtatgtttccaaagagataatatatgcatatgataaaaaattcaaatgctagacaaattcaaacatctagacaaaatggtgcagagatttaacatttgttccttttgttgttgttgtaaatgaggcttggttgtctgtagaggcagaggaacacggtaacatcttgacatcagacactggtgtcatagatgccctttcctcagaggactgagatcatggtttttagaatgaaagagttaaagaaaccttgctgtttttttctttgaaccgggtacctacccttaaccctggaatccctcagtggggcctagtgccagttcccctgcctccctacagtgaccaagggcaggcaggggtcaagaaacaactagaatggggctggggtctgcactgcacaactgttctctcacattcatgcttccctcccagtctctgaagattccctcctgccagaacattttgtgtagaattctaaggaaatcagagtctatccctgtactaaccaacatataaaattccaattagaagagaagttgtttggattggtcatgatggatggcctggtgacagctgtcagtcagacgagacctgatgggcaccaggactgaaggcagcagcacaggaggtaggagaggaaggaatcctgagcaaatagccatgctgtttacttgccaatgacatccccactttgcaaagacatgatatggttattgatctctcactgaacctgtaagaatcaaacacaacaactcagttttattcatttcataaatggtttccaagtgcagtcagacatttaatttgtggaacactgagcgaagaggtgatttctgctggtttaggtaagagagaaacggtctagtgtaatactcaagaatgagctagatctcctggatttaaggcttattctacagcttattagctctgctatgttgggccagtgacttgacatctccatgcttcagtctcttcatctgtaaaatggaaatacaaagcgggtgggaggtgttgtgaggattgagtagattaatgcatgtaaagtgcttgcaacgttgcctgacatgtcactgtctgttagctgttagcagtagttgggctttttatagagggctggtgacttgtgcttgtctgaatgcaggaaaccaggcctgtgtagccttcggtctgttctaacactgaagttttgtagttgagtgctgactgtggtgcataaactgagcatttggatacctacatatcacaccacaaggttttggaggggctcactttgctttaatccctgtttcatccagtttctctttttctccacatgccttcacagaggcaaggggagcatgctgagtctagaatttctaatcaaagctaaccacatccctgtcattgttggataatattacaaattagacacgttgttcctgttttgactcagaatcacagcaggaagcagctaaataaaactgaaacaacccacaagtgcctttcacataagtgattagggtaatcgcagttctgtacttgccaaagggattcattccctcttcattttttccatggaaagcttgctttgggccacaaggccttctctttgaatgactgcgccattattggccaagtagtgctgataaatggtacctgtgggttgttgtgggatttaaggagatgatgcttgggagcgcccagcacagtggctggcacacagtaggtgcatcctttcttacttcttcttcccctgattaacgagaacactctacaccaagacacatacctcttctgaacggtataaaccgttgctactgaaagtgtctagaccagcagcagcaggatcacccgggagcttattagaactgcacaaccttgggtcctctggggcctattgcattagcatctgcctgtaacaaggccttcagtgatttgtttgcacactgaagtgtgagaagcactggtgtgaactcaccaggtagggatggaaccagagatggaggtcttattaacttcatgctggtaactccctgagctaatgggcccatgaggaataaatttggtctaaagcctggtcatttggaaatgaactaaatatactttactcagtcagcttgtgtaacagagctctccagtggcatgtgggtctttttcagcagtgacaatagtttattttttaaatatactccacaaatgttgttctggtgtggatcttaatgtggagaaaatcagacaccttttcagtaagcatttcttttgtttctgtgatcatgttcatgttagtttattgtatttgtattagtttatctgtgggactatcccttaatatttcccaaaacaagaagacatttgcgaatgttttcaagatgcattgtacaagatactgttttgaactggatcaatgaaggagatgtttggtggccttggaaagccctggagagtaatagtgtggttctaagaagagttggcctgaatcagttcattcttgggttgtttgctaagattgtctgctgaaggtgggtacgtggaaaacaagatggtaagccaaggaggatgaagggaggcatgctgctggaccacttccagctcccaaatgactggatcttggccatcttgcttttcctgctaacttagaactgaactgcttattctagaaaatgagaggcactggggccatataggaaagggatagcattggacccaagtcctagactttcagtagtttgtttgcaggaccagggtcccaccccttttccaattgaaatgtaggcaaggtggtggcaagcccatggcctaggctgtgggaactcatagaacaactatagtgatgatcgctgccttggattgcagcctactctgaatgtgtgcacctgtgctaactactttcaggtgtgttgtcttgtttcatagactcattacatttttatgatgaagtgaaacccgtgaattggctcctccagacttctcattttaatgacaaaaaagtgggtctccagagaggagctgggattttccaagatctcatagtttgttcctcactttttgtccgtaggagaatcatagaagaaccagataatcttgtctcttatagaaggaatacccttacccttccacattcccgtggtggtggtgtgtttgcttttttatcagtcttaacccatgggaggctgcacaacttacataagaggctacctgttctgtttgccaaacggcagcccagacccatcactgagcatgtccttggcaagaggcacaacctcaggctgacactgtttccatgtccgtgagaaatgatgtgtataaacgatggccagtaagatgctcatctgttgggaagacaacagagggcagggctgagagcatggcttccctgctgattgcctgtgttcagatcccagctcagccgtgtgtaagctcttggttcttggggtaactacttgtttacctctctgaaaaatgggagtagaaataatgaatacttttaataggattattttgaggataaatgtatttatttatgtagagaacttggcacggcacctggcacagagtgagcacttaatgaattttgactgtaaatagttattactgttccactagattcaaatttcttatctttgcctttagctggatgagtgaggagatttgtaccaacgtcatgtattctcctcttccctgcaaattcctccacctgagtcctattgaggtgctccccattataaggagtcctgtgaatcaaagtggtatgtttactgtaaagaatgtggaggatgctgttcactgcattgtattgttatcttcatgaggaagccaggagacatttattttggctctctgttttagaaaggtgttctcctcatgacgacctgtttgcctctgatcttaaggacactttgaagcataccgagcaggggtctgcaaacttctttgataacaggcaagatagtaaatattttcagctttgcagggcagagtctctgtcacagctactcaactcttctgtggtagcagccacagacagtgtgtaagtgattggacgtggctgtgttccagtacaacttcatttacaaaaacagggctcaggccaacccctgatagagatattcatggtttttgtgtttctctctcaaatgctaactaccagaaaagcttagagtcaaatctgaatcatgcttctagcaaatatgtacctacacatttagcatactaatatcactcttgcttaccagtttttaccctgttttctcacatttatattccatttgtcataattatagctcctgtcttgactgtatcttctttcactgtgttttttgttgttgtcgttgttgttgtttttgggaatgggataggactgtaagtaaataaatcaattatatcttgctagcttagaaaccaggacttgagtaaccacttctgactcaaagttcaatctatgtggttaaatagggaagcagaccataagatgtatgcccagtggtgcacgttgctgactcgcaagctatgtgcaggctttagcatttagtgtggtgatgtgtgccctctaacctgagatgttgagagaggggcagagaagaagacttcttgtagccacaaagtttcattccttcctctctcattgttgtagcatttcttttaagtgaaaacagcctttttggtttgctagcctatctctggcaggaagacaaattatttttttacagtatcagacacgcggtttcctgtctatgtttaacttgctagcagaacatctcagccagctggttccctctggacccattgtgtccttaatgtcgttgctttacaccatccagcaaacccactctgtgtactgatcgcatgcattgagcattttgttgacttccgttgttttccgagtaagggaagtcttagaaatgctgccctctttctcccaaatctcattttatgtttgttcagctccaacaccagggagctggcttcttggggaaatgattagttcttgcatgtaagaaatgaaaagagtaaatggtgttttggtagctctgggggattttaggtatgctgccttggaactgtgcactcacgcctcaaaatagctggctttccagctgtgcatttttgtttcaaaagaaacaaaccagatttactttctggtctaaatgcagaagaaaaaataagtgtggaaatatggttgagaaaagttgttagaagaggaagaaaattatggattaaagttgctagtctcattcctgagaagagaaatcagttatttgaggtgatgactcagagctgaagcagctttttgttgtgaaccagccttggttagaaagcacacttggaattcatcaatatggccctatgtctggccaaggaaataataaagattttgcatgatagaggacactgtgactcagttgaaggaagcttagaatgtatttgaactgaattaaggcaaaagcaactcgcttttcaagatttttttttttcctaagtagcaaagtaaacaaagctgcactgaggccagatgtgctttctggttgtgaatatttgtactctagaacctcattctggtatgaatcagcagagtggaatctagtatggacacaggctgtctcaaattccatccactggatatgagtggccaagaaagcagtcggacccatactgctggtgctgtagcaaggttcgggtggttcctctgcagcctcaggtctctcccactgcggcctccatgtgttccataaactccacacccatgagtaatggcaagaagggtccactgagaccttttgctgctttgcgagtgtctcagtgtcccaccaggggaaaaaaaaggctcagggaggtggctaaccactgtgaaattgacttttatttccacccacgtatactccagaggctgtattcaccaccatttggacatctggatgacttgcctttggaaagtccttttgtattctaaatcgctcctgcatgttacctgttgtggaaaatatcaattttgccattacaaattatgcttttttttaaaaacatgttaacttttagagaaataatttatatttgcttatctacttttaaaaatatacatatatatgccttttgttgcctaattagaggatatagttggttccaatgtcaagaacaatttctctgaaatgtagtcattaaaattattcccatgtctttcattttccaggccccatcctattcgaaatacctgtttcttccaccaggctgatgtagttatgcttaggcttggctgcacattggaaacacctgagtagctttaaaaactactcattaactgggtcttactcctgcagtttctgacttaattggtctggggcctggtatcaggaattattttttaattcttcaagatattttaatatgcagcccacattgggaaccactggactcaagacagtttgttctgccaaatctttttatatttttcgtcacgttccccctgtagcctggaaagggacggtaacaattaaagaatggcagctaccacaggaaggagccaaaattatgccttcgaaggttagaggaggagaaaaaccaacacctgttttaccccatccttggaggaatagcaagacactttaagaggggatattattttgttttctacaacaatttacaagcaattgctttggaacaaggtcaacggcctcattgggaataggcatcttagcttttaaaactgattaaattatacgttaaaggaaagcacattttaaaccttaatgtgtccaaaaggttggatggcaaggtttgggtgctactgccttggcagagacaaggcagggaccagggaggctgtgtgcatgattttaggaggtgagaaactcaggtgggaaggaattgcagaagcctgtggttcacctggaaagccagggagagagagaggatgtattctggtgacctaacaggtattgtgaataatgaatatgcttttccaaagcgatctggtctccctgttggagagcatcctgaaataacttaagaaatgtaccttgctttcaggtttcctgagaacatgagggcccctagacagagtacaaggtgtaattcagacagccagccagaaaaagaattaaagaatcagggcaggtgtggggatcctaacaaaacctaagcttttagtagtcagaaaactgcaataacacagaaaagaaaatgaaaaaaaatcttgttccaaagaacatatatcaggtgtgaaactctctttgtgggaggacagatgtgtcatcatttcctggacaaagcctggtaccttgtaggcaccctcctaatgttggttgccctccttttaaagtcagagcaagagaagtagcaggaatctatatcctaaggaggaacataaagggtgaaaagcacagtggaagggatgcctaaaagagcaaaggctgaatcagggttttaatggcctgaaatgaccaattttctaaaacttgacaggtagatgtaaaatcagacatataggttcaaacaatcgattgcaaaggagcacttgtcaaaacactggctgggaatctgctcatgtgatgaagaccccagggtttagaggtgagttaaggtcattttgaaatcaggatgatctggctgaaagaatcaaaacaaaacagaaagaacaaaccatcaggagccttaaactccacttggtggaagaggaggtgagagtcctgctgtaatctttgctacacaagttatattccaagtattatatctgtgtctatcaaaacacatgatgaagaatcttaaatagcaagcgtggtttcagagaacagatcactttacccttagaaaaaaggtcctggcatttattgggcgctatatgctgggcaggctgattttagggtctgataaatctgtcagactttagagtctcatcaatgtatctcttgaaaagtaaccgaggaaaacatggctgttcaacctgaaaatgaaatgatctaggggttgtgagtttcatatccagcaggagtttaatagttctcatcccatagaaaacggattcattttgttactttttgctttagagaacagcagaaggaccaataatagaagcacacagaggctacatttgacttaatgtaaagaataattttaaacatatcccaatatttagactttatcccaatatatctgcagttagaaatattgtgatttgattatggaatgataacaaaggaatgatgtccttctaccataacattttcaggcagaggtttcacctctacctctcatgggtattctagaaagagattatcatactggattagaatacatgcaaggcttttccatctgggagagagataagaaggaaataatacaaaggagactgtgccatgggataggagaggtggcgaatagctttgttctgaaatatgtgcagttggaataaaacaaccacattgattggagagaagacttctttcatcatttgaggaaaaaatactctcaaaatatatccagaatgtcaaacagtgctatcaatagctagaagttaaattaaatccttcattgctagtgagcttactgtccttttgttgtttaattgaaatgactttttattgtttgcctaaattggtgtgctttttactaggatgatggatggggaagcatatctcattctacactcctccaccagttaattgactagaaaattatcatgggccattttctcattggctagtgctgaatacagctgtaccagagctttgcaaacaattccactaagaaattttttgtaggaggaaagcatctctatggcagagtaccaaagaacttaactttatttttgctaaactgtttagcaagaataaaatttacctctgaaacttgaatgtgtaaatgaatcactgagagaacttttaaatgtagattctgattcagttagttgaggacagcgctaagactctgcatttccagtaagttcccaggggatgctgatgactgctggtctgcgggcacacttagaataacgaggtgacaagttattctttatgtaacatgccaacaaaatttttaaaggtacagaaaatgatggcaagatctttgaactctgcaatatgaagcatatatgtgagtgcttagctttcactctctttctgtgtgtgtgtgtgtgtatacagatactaagacacagatacattcacatatatacatctaaatatatatacagtacagtccatattcagatttcttcaaggttaatgggtctattgtttaaattcggaatccagtcaaggacaacacattaaaattgattgttttgcctctacagtgtgtttttttggttttcatgacattgactttgatttgaataggtcagaccatttcatgtactttataaaggcactttgtagatttgtctgatgatttgattaattcagattaaacattttttaaagattctggtgtttttattgtaggaagtttttttaaaacagtaattctgcaaaaaagcaaggtttgccatttgtattcagtcatattagtagcaagacgactacagatgcatacttggatgataaaacaagtttaaaagctcaagaaaatgataactataaaagccaggaatagtgattactttttagaggaagggagggatctccgattgagttggggaacatgaacagacttctggggtggccagcaaaattatattttctgacctgaccagtggttacaagagtgttgatcttatagtaattcactaagccagacacttgttttatgcacttttctgtatctgtgttttattttggaatgaattctttttcacaagagagaaatcagagtaatttctctagttttgagggccatactgtgctcttgggccaagtatattattttaaatacccttaggagaaaggaaagaggaagagagggctaacttttttgggggggggagttgggggggcagggggagatgttctcgttctgttgcccaggctaaaatgcagtggcaccattatagctcactgcagtcttgaacttctgggctcgtgatcctcctgcctcagccttttaagtagctcagattacatgcccacaccaccacatccagctaatttttttttttttttatacagacagggtctcaatatattgcccaggctggtgtcaaactcctgggctcaagtgatcctcccacctcagcctcacgaagtgctgggattacaggtgtgaggcaccatatcttccccccatttttttttaatcatctgagtggcttcaaagcttttgttctttccataccaccaagctatctccttaacaatgaactgtgagatccatttaataattctgaaaatttccagtcacttctgtcactcatagaggccagacttagttgcaaataaggagccatttgcaaatgtcagagtcttgttacataaatatttttttaaagacaaatgtcaaattctttttttttctgtcttccaaagataaatgttagtatgccataaaaaaaaatacaaactggcagaaaacctcaaggggaaatcctgtggtatactttcctttggagtgattgaaaagtaaacaatttgtcttataacttgagtatgcatgtgcgcacacacatgcacacgcgcgtgcgcgcacacacacgttgctctcagcctcttttatgtcctttgttatgccgacaccagttcctaaaaggaacttaaaactgaacctccctaatccactattttaaataaaagtcacttggttaaaaaaataaaagcattaaattaaggccaacttggtaaataaaatcctatgtggatcagttaatgtgtcttgataaaaagcaaatcaacatagctgaatttgggagataggctcctactttaatatttgaagtagtttggcaattcctccactcggtaaaggagtttagggtgaacatttagtgggatactaatttatccgagcaatagaaagggacgtggatgacagtttttcgcacaccttggtgtattagtgcactaatgagcctcagatgccaagagagattcttgtgaagttggcagtgaagctctagccgcaaggatgttcacatgccagcatgttcacctaaagcgagagtatatatgcaactggctgagatccaaagaaggaaactgtgctaaagagagatagctgaggggaaggaagaacttcctgtctcaagtcatgttaattataacattaaaaggacagcattcatttattgagtacttactaggaacaacttttacttaacaagaatacttatttactaagtagacaaaaatgttgtagaagcaaccaaggttcagtatcctcctctgtaaaacgggggtaagagaatctaactcatacatagggttattggagaaataaagtagatcatgtttacaaaataaattgtccggtgcctaacccaacaaagcacatcgtatatgagttatctttcttattgttacaagatttcaaaggagggcttctcctcaaattctacactgcggagctcccttcccactccacagaagctccgacagcatccacagttgtccatgtgcagcacaacaaatcaagccaggcagatctcccattggcactagttaccaacttcctagagaaacccatcaatctcaaaattcctgctctagcaagtcctggaaaagagactagagcccaaatgccttcactctgccaagggagcttccctttttgtgtgtctgtgccatggacttcttgaagtagggaagcctgtggaccccttctcactgtgatgttttttaaatgcataaaatagaacatggagtatttcaaagaaaaccaattacattgaaatacaatgaccaaatattttaaaaatgaatttgtgttatagtaatatatgtttctataataatgctttaaataacaatagcagcagatctaaacaattgaaatgtctaaatggtgagcgtaagtcacatgctgagacgtctgcaacaacaaactcataggtacagctgatactaggaaatattaatttttaattaaaggttagagaaaataaaaaaagatgcaatttttgcccattcaaattcacagacccactgaactctatttatggaacccaggctaaaaatgtttactattatagcctcatttttttatgggccttggataaattccacccttatttttaatgcccttcagagctatatctggttcaatgttattactattcatggaaggtcccaatagtgcaacaattatgttttgagctctgctaagatctaggccatgagaataggctctgagaaaagaaaaagatttgggggttctccttcacataaaactttttatttcctggcaggaaaaagatgcatatttacagagacactactaaactgtggttcttagttcagaacaaaggaatataatccccatacccaaaatatactcctttagacacattatacaagaattgccaatgtcagtcggtggatggctgtaaaatcacttagtccaggctacactaaagaaaaacactttatcaaattgggagcttatataaagtcattcttcccctcccccgcaacccctacccccccatccccgcccgcacaaacacagggtcttgctctgttacccaggctggaatgcagtggcaggatcatagtgtgctgccgccttgaactcctgcctcaagtaaagtaatcctcctgcctcagccaccgtaatagctgggactacaggaagcaccacagtgtctggctaattttttttttttttaagtttgtgtagagacagtctcactatgttgcccaggctagtctcaaactcctaggctcaagtgattctcccgccaaagtgctaggatttcaggtgtgagccaccacacccagcctaaggtcattgccattcttagttggctctcaccaatatgaagtttagagatcaggtatggggttgagatcagaagtctctccaatcaggcaatgctcattgtaaataccagctttgctgttgcctaaatttatcatctgggaaaattacttaaactgtctgatctttagcttccctatctgtaaaatggggtttataataatagcagtttctacctcatagggtttttctatcaattaaatttaaatattctataaaatccttagcacacagccaggaacttagtaagtgttcagtttatgagtttctctgtaactggcggctgatgaaaagaagcatttcctgttggtcttcgactaaaggagatgctggcttgtacctacaccaacagctgttgggttttctagtagcaacccaagggttaatactgccagagggtgtgggtggctcctgtttagataaagccacatcccaaagcttccttccagccctggttgctattgttagagtttttcaccacctctttgaagtttcaagattgacagatgttattcaagaattcctccccctcaaattttttaagtgtaagtcttctaaagaaataacaggaaattttaggagaaagtaaaactttggtttctgacattgaactggggatttctagaatcttcttcagtcagtgccacacataaacttaaggggatttctgtttttgtgtttcctttaggctaaaaaggaattgaaattagcaaatacgactgtttttatagatatttaggaattgtaaaataaaattatccatgatgaatcaacatttcatctggacgttttagtgaattaaggacaaagctaagtaattatgcagttaatatttaaattttttcaaattgtatttctcatatgtgaaaaaaaattgactacatattcacatttggccaaagtgaagtctctccagattctgccaatgaggttattaaaataacacctctagaacaggggtcagcaaagtttttctgtgaagggccagatagtaaatattttaggctttctgggccagataagatctctgttgcatgaacctcttagttttattgttttttaaacaactctttaaaaatggggatggaaatcattcttaggtcataggactatacaaaagcaggccatggacttctgagccatagtttgtcaaaccttgctgtaaaatataaaaaatttgagaagtatcattccacgtaagtaatcattcagcttctaaaacaaacgtttgttgaataccataaattgccccattctgccccaggtgctgtgtatatcatgatgatcaaaacagacctggccactaccctgctttgtcaggagagaagcaatcagataatcaagtggatttctgattataagacattccatgtagttacagacacagagaccggagacaagtgggtacttcaagcaaacacattcattggataccacatataatagaggtggagtttcaggcagggagcattgtggaagtggtaagcctaagtggaaatgccgactgctggatcggctgttgtgtttgaatttgtgttgtgttcatctgcccccttaattttgtttgctgtacaacagggacagtccatacatctccacaagagcatcttttttttcttttgcattcaatcattctgtaattgctttgtcccaccccatttctgccctactcttgcctgttctttgtcccaatccaagcctcccagtgtaagaatttatgtttttaaggatcaatcaccaaattttctcactttccctatacttttaaaatgcattcatatatctttccaaaaaatggtgattttttttttccctcttggttgctggaattctgatatcttggggttacttctctggttactagacccaagattttcatctagaatatatagtcagtggaagttggcatttccactcagacttaccttaagaacaagtaatcatattacacataaaccttaaaaatggatatgtaccagcttcatttctcactgtttcgttagatgaaagtttcagatgctgggccaagcgcagtggctcacgcctgtaatcccagcacttttggaggccaaggcgggcagatcacaaggtcaggagttcaagaccagcctggccaacatggtgaaaccccgtctccactaaaaatacaaaaaaaaaaaaaaaaaaaaaaaaaaaaaaagctgggcatagaggctaaggcaggagaatggcttgaacccaggaggcaaggttgcagtgagcagagatcgtgccattgcactgctgcctgggtaacagagcaagactccatctcgagaaaaaaaaaagaaagtatcagatgctgaagtagctatgtagactggggtatataacctggggttcatcatcatgagccaggaaaatttaggatatgaacacacatgaggagtttaggagtggaggtttaataggcagaagagaagagaaagagaaacaattctctctgtagagaaaggagtctccaagcggaaaggacgggccagtggtgaatgtgctggattttatagtcccgtttgaagaggcggtgtctgatttacatagggctcacagattggttcaatcaggtatgacgtttacatagtgcatggggaagactggtcaccccaccctaatcttattatgcaaatgggctttccagttgatcagcaccatctggtctgttctttgttgtacacatggctgacaaagagaagggaagatggagctgccatcttgaacatgtccttagttcctgctggcattcacccgtgcaagctcccagcttgcctgtctatgtctgaagctcaactttacaggctgctctttgttagaaaatgatttggggctgcttttcattaaaaagaaacaccttaccgaggacttccatacccttactatctgcccaagtaatttcttcttaactcctttatcagtatcatttaggtaatgggttccccttgagagaatttggttatatcctcattctacctggactatattctcatcacttttttttttctctttaaacacctactgtaggtgaaaactgacaaatgaataatcaaaagatccttttctgacacggagtttggttccataccacctacccatttttttcctttctattccgcaggtgcagagtggtcagtatgggataattgctcttccttaagtagatcatatattctttctccttaacatagcactctttccactcatcactgacttttcccattcttcagagaccaacttaaaggcagttttttgctactgtgccttccatgtttctctaagcttttccacattccactaatatatagattacattgtacatttagcccctatcccagatgccatatattgcttacttgtatatatgccctaagtcctctactgggtactctctgagggcagtgccatgcccatcatagacactcagtagtgatatatttaatgaatgattctaggatctgagcatgaggcctgctcattaatgggtactttggagggcagatggatgacacataaagcaatagaattctgcatgtttgcccaatgaaagcagcccagcacaagctcccagtgaactagagctgccttttgctctctcctgtccactgtctgtttctattcatgtccttcttccaaaaaggaaaactatttcaccagagccaacaaggccagcacatgaaacaaagtttgaggcacaagatattatagttagatatctggtgctaaggactctccttgtcagcccacaggggcctgcttcagaattccaagtcaaaaaactgcagcatttccatttttaacttgttttacctttgcggccatgtttccattgttgctattaaatatttcagttccatgaaactacaattcgtatgcacactgaaaagaggaatgttgggtggatgtaagataactgtccaaagagatcctttccatggactcctctccctgtcacccatgggcccagggtagcctgaatgctgatcagagcagaacaagttggagtttgaaaaagagcaaagattttggtgcaaactgtggcacgctctgtgtttttaccagatgtcatacatgcagattttttgaaggcagaagctgtgtcattttttttcatgttcccaatgtcctgagcttagataacactcagtaaatggtttgtctttttatttggcaatattgaggacctgctgtgtgctaagtgcagtttacagtagtgaagaagacatggtaccttccagcatggagttccctgtccgtgggggatggcaagagtagggaaagacagatgtgaaatcaagaggtagagtcatagttcatttagtttaagttgtactgaattgttacctaggaaaagtataaggtgctatgaaaatgtataaaataagacagttttccaagtttttctaggcctctcttaagcagtgacatttaagctgaagtttgaaggaagagcaggggatgacgaacagatggccagaggcagggaaggctgaacgagcatgcacttgcatccctgaaataaaaattaacaatatcgtatctacaaaaactatgcagatgctaaaatctatagatgctcaggcatgaacccacttcctgacagtacttacctaccacatccaactccttctctccttgttttgtttccccatcagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtaagttagagctagtgctagatcccctttaccttgagcctggcctcaccctacctcttgatccatatctcctggctcttatctcaaacagccctgtactctggacactggtctagggaatctagccaaagtatggagtctgccttgagcatactctgctctgtcctgcctgagcatttttgctaatggacagcatttctcctcctatcttcaaatccttcccagttcagcacattttttcctcctggatcaatcctcatttctcttccagcaaatgttttttctttgtttcaagcactgttagtactttacctctattttttccctctcttatggttgtactcagtcctttctgctctatactagctgtagttgtgttggtttctttgtattaaaagcatcgtggaaggcaatctccctgaagtccaaatctacatccacatggtcacccaagatatgtagcacaatgccttgaacattgaaagtaaaataagtacttgtcgactgagtgagcacttccactcttgaagcactctcacagattaaaatggaaatgtttttggctaagaaactattggaaggtgattggaaatcaccacaacatcccttataaatgatgagcccagtgttttcacacagtggagtccatggagagcagcactgtcttctttagccaggtggcaggacacactttgaagcactcggttactgctcagtcagccctgtgtccatggcagcgcacgcagtgttgaggtaaacatcgaaatatggacagactaatgtgccagagtaatgagccatgcaatgacctcttgagaagaaaaaaactctctaatacatgccaataagaaacattccttggaatgataatatcaactcacttggcttccctagatccttgggaaggtaggactttattgttatttagtcagtttatacatactacaacactaaatatttaagtgagccattctctggaatatttttttcctttttcatatggatccgacgtttgcatattatcagtcatagagattagcacaggcctaaaagtcaaaataaaactacatggcccacaagttaaaattataaagtgatccagatttggtcttttactgtgaaaatgcttttatacaatttaatttagtagagatgttatgcaattgtactatatcctttgcacactggaatgtgccatgggataaacaaagattaagactcagtcctaaagtgatcaaaactgatagcaattattatttttaccataagtcttggagtttcaggaataaaaaaaaattcaattttggaaagcaaaaataaacatttaaaatatcacaaatattgtctctcaggttatctgtaaggatgttattgaaaaatgtgatgacataagtcatggggttagataaggcagctctggggtttggcacttccttattttggcatgctttgtttatggtctttagagggttttcagggagagaacatctattttaaaaaataaccatctatctgtacctttctgtgcatttctcattctttaaaacagcactttgattttttaaaaaaatcctctgcacgtgtcaggggccaccatcagctatattgtgaaaataaaaaggcagctggaattaaatgatgggcctcactgtctgtttttgctataggtgggaactgcaagatacatggctccagaagtcctagaatccaggatgaatttggagaatgttgagtccttcaagcagaccgatgtctactccatggctctggtgctctgggaaatgacatctcgctgtaatgcagtgggaggtaggtgtggaccagcatcattgtgtagtggtaaacttgtcttcaaaataagatcatgtgttgcttcgagcattattccaggggttacaaagcagttattagagctagttgagatctgatattatacaaccatcccagaactatttggggttatgctaaacagcctaggtttttaaactgaaagccacatttggagcataaagctttgtatctccttttataaacctttgtataattactcttctcttgacacatctcttcacagttatttaaatatctggcaagagacgaatactaataaatgtataagaattatctctaatgatcatgtgggtaatattcagataagcatctgatttcttttactttgtgttttaagatttttcagaattatgtctgggaaaaagatttgattcaaaatttacttttatggacatgacattgttttattgggcaaaaaaaaaatcattgtttgagatatttgtttaggttttgaaaattctagtgaagaggttattgaggaaggccgtcttcttactgcttaagcctgcaagactgattaggagacctacttttctcctgaaaagctggcttgctctttttatccccaagttcagccacctactgttttttttttcttttaggatcatttttccctgaacacactgtcatagcctcccaggtgccctctgctatgtcttctctgcagttgtatgctgagtccttttcactgttagaggctgttactactattgaccatgagactgtagatagaatgggcaacaaacatctggggtgccagggtgaggctattgttctaggaagtattatcccttgttgtccagaaggcaagaacagttgaggtctacattactataccctttcctgactctcttctcagtaccttggaggacagatgcatgacacataaagcaatagaattctggcatgcttgtccaatgaaagcagcccaacgcaagctctcattgaactagaactgcctttcgctgtctcctgtccactatgtgtttctattcatgtccttcttatttcttaggtgagacagggtcttaggtctcacctgagaaatctgtgcacccaagttcatcctggttggctgccaaatgaagccaaactaactccaccctttttttttttttgagacagtctcgctctgtcacccaggctggagtgcaatggcgcaatctcggctgactgcaacctctgcctcccgggttcaagcaattctcctagctcagcctcttgagtagctgagattacagacatgcaccaccacgctcagctaatatttgtatttttagtagagacagggttacaccgtgttgatcaggctgatatcgaactcttgacctcatgatctgcccacctcggcctcccaaagtgctgggattacaggcgtgagccactgcacccagcctccattccatgtttaactttttgttttgtgataattttagacttagaaaatagttgtaaaaatagtggagtttctgtatactcttaactcaactttgcctgttgttaatatctaacctaaaccatagtatggctatcaaaaacagcaaattaacctggattcagtgttcttaattaatccatatacgtatttgtacttccaagtccccagtaatgttcttttctgaaacaggatccagtctaggatcccgcattgatctaatgtgcatgcctccttagtctccttgaccttgtgagagttcctcagtcgatttttgtcttttatgaccttgacacttgtaaaaagtttaagacagttatttagacggtctctcactttgggtttcactaatgttttctcatgattagattgagattacatattttgggcaaaattaccacagaaatgatagtgtgcctatcttcagtgcgtcatatcagggggaataagatgtccatgtgtctggttattaatgttaaatttggtcctttggttaaagtgggacctgctgctatttgtccatttgtaagtaatacatgcctttgacctgtttctaaagatactaaatacctgtttagcaaaggtactagaactttcttattcatcatttacccactaatttgatgatctatgactaattcctgcctataacaattattactataatgtttacttaaggaagattttctgtttttcttgttccttctatatttattaatatgcattctcctttaaaaaagatctgtctcttctgacaccatcccctgttctttgtttactaattatgtatttatatcagcaggggatttggggtatttgtttcattatatgagtatccagtattgtcattatttattttgttgctcaggttgccacagcttgggtcactggtccaaactacccaacattttgcccaaggcagattcagttggcaccactgctggctctgattcttcatcctgttcagaatatgcatagccaattctccagcgtgggtccgggtcaccccctcccatcctgcaccctgctgaacctcacatgttttcctgagacccccgcatggggatggcacttcctatctagctgacatagttattattatctagtttcttgactgagatttcttcccccaaaacacttccaaaagttaactttgtttttccttgcacagtgaaatttgtttaaccaagtttcagccactgagaataattttatgcttgaaagctttgacagttccaaaatgaatctttagccgggtatgagttgtatcagagacaatgctgttgtcactgtcagaataaatttacctagatttcagtatcattccctatcctttcaactctgttattctataaacatgagctggagattgtgtctctgtctttccctctgtcagtgcagccagcttattaaggccctaggtgagctcccagctttcattgttatcactgactaaaacccttgcctgttgatatttgctgagtgtggaagaatttaagctaatgaggaaggagttcaccaaattttacaaggtctaaaaacagttagaatataaacaagttttcccaaggaaggaacaggatatggtttattcagctagtctcaaaaaaccttttataaccttaggataagaagagacagccctggggaaccggaaagaggccatcccagttctcatttcgtttgatcttaagcccacagtcctatttctcccatctttgctcgggctgcagacaccaaggttatttatccatcctcacgttcgtcctgacacaaagccgttcacttgattaagcgtgtgaactcacgtagtaagctccttctcccaccttgacttcttcttttaaaagcattagtggtttttgtttgtttctttttggcatgtctcaaaaaccttaaagacagattttcagcctagtcttagtttcagaggcttttcttttacattcaaaaggtcctttggaaagtacacgaagcctgaagacagatggattccctccaactgcattcatcttgatgttgtccctgctgtagcttttgtagaaacacagatggaaggacaggttttgacctcaagaagcttgtagtctacaggaaacagttgtttgtttcctctcccttctttttaaaaaacttacacatgcagatatgtttcttatcttacaaattaaataatgaatccccctgtttgatgttagactttaattttaaggtataaggaagagggaaggatgtaaaaggtctttccttaagcttgaacttctgcagtttgcagtatagcagatgtaattaccatttttttaaaatcagcagtcttatttcaaaaaaggaaatgtggaatgtgcttacctttgtatgatgaatcatagatggacagtaaagggaaccagatctccagagtcatcttctctgtaggctctgagtctgtgtgcttgtgggatcatggatcagggccacttctgtgacatgaaaggcttatgatctgacccatcgagccagctaccaagcacctgcagagaagcctgctcaagaggtatggtcctgccgggcgcggtggctcacgcctgtaatcccaacactttgggaagccgaggcgggtggatcatgaggtcaggagatcgagaccatcctggctaacatggtgaaaccccgtctctactaaaaatacaaaaaaattagccgggcgtggcagcaggcgcctgtagtcccagctactcaggaggctgaggccagagaatggtgtgaacccgggaggcagagcttgcagtgagccaagatcatgccactgttctccagcctgggcgacagagcaagactgcgtctaaaaaaaaaaaaaaaaaaaaaagaggtatggtccacctcaactgtgtgcagaaggatgatgggatgcaagtctccagtgaaaacagctaatctacatgacaagtatagtggatctacccactgaaggagagtaagtgtggctgcttggatttctcgggatgactgccattggtaatatggatatagcaccccatcctgtactgagagagtccctagttgtattgatacttttttaagctatggaacattaacctctctgttcccagttgttaatgagctattgcagaggtgactatttgttttactttcttggatgttaacattacagtactcactacttgaagaaaaatgttctaagcagcagaaggtctaactgaatgaagtaggatacaaggattagggacagaagatttcacagaaaactgtgaagtcccacctagcctgcctttaagtgactcataaacatggatattaaggctccaagctcacctccacgccacattctcattctgtgttcatcacttcatcatgatggatgtcttttaggtcttacctccaggctttgtctcatgctatttactggcactggaacacttaactagtctgtttttaacaggcaagtgtggttcagttgtgataaatgcttaggaagggaaggcagtgagctcaaaggactgaatgcccaggttggctacagggagtgcagtgttatggtcagggaatgagacttaggtcagctcttaaaggaagaggaagactctggggcatccttctgagttacttctttactagccagtctcccctgaatgcaggggagcacagggaaaacagagaaagaacagcactacactggagaagcctcacttttatcaggtgagaaaacataaacagatgataatagagctcttcaaaagccaggtggtacagcttcatttcgcacaaaattccaccaggggcctcgggagatgtgttgcagttaggtgaagagagtggtcagagagaaaggcttcttattgaaagtacatttggtccagataaagaaagccataaaggaataattaccacttcttaagcacttgctccacacatcaactcatttaatctaccaaaactctttgaggcctgtactgttattaatcccattttacaataagagaactgaaggctcaggaagtgcgaaagttgtggagccaggaatcaaagccctgttgtctgactctgtagctcacaggccttagtattcctggtatactgctagcctggccaatggagaacgtatttaaaatagtagctatggccatgtacaggtacaggctcacgcctgtaatcccagcactttgggatgctgaggaaggcagatcatgaggtcaggagtttaagaccagcctggccaagatggtgaaatgccatctctactaaaaattaaaatattagccaggcatggtggcgggtgcctgtaatcgcagctactcaagaggctgaggcagagaattgcttgaacccgggaggcggaggttgcagtgagctgagatcgtgccactgcactctagcctgggcgacagagcgagactccatcccccccgccccccaaaaaaaatagtagctatgattcctatgatcagtatggatacgatagtcagagctactctgtgcatcctggcagtagatatgaagccttccagcagaagctgaggagacaatcacatgtttgaggaacattcagtgatggcctcacttctctgggtgaatccctgttaacagaatccaaggctgttaatttgtgtagcaggtcacagtattgataccttaaaatttgagataactgttttatctttatttccctaaagatatatttattcattcattcactcaaaaagtatttattgagtacctattgtgtcgcaggcattgtttaaaatgccagggatacagcagtttaaaaagcagtgtctttctttgagagacaggaagtctagtgaagagccagtattttagggacaggtaatgaacaaagagattatgtaatataatgttggagttgggtggggtgggtgggatgattttagaaagaaaaatagacttgggggatagataatgaaagaggctgtcatttcagacattttaatcctctgaaagaatacaaaagaaaaaaaaaagaaaacaaatctttcagaattgtttgaagtaagaacaagacaagaggaggtgattggtgtgttactgttctacgaaaaaggagaaaaagcttcatgaaatcgccattcagcaaggacagaactggagatggcttctcttttacaaagaaatctctgtcccaggctttcagtctgtttggtgttcatacaagtgtttgtgtgttgtgtggaaggcgggtgaaggcgggtgaaggcggtcctgttcagggccccctttggtgaacacagcaggcaaaatactctcgtcatccccagccaaactggcctgcaagcacactgacttccacatccctagcatttaggcctttgaatagaagctgacacgtagcagccagctgaacaagtatttaatgaggagcaacacaactccaagaagggctccttagtgtattgtcaagttgctgcagccttgtgagatgaaaaaaaaaaaaaaaaaaaaagtgcaaatgaaccaaaaagaaagggaaggggctgggggaagaaagagacagaaaaaaaggaggcgttggagagacggctgaggagagaccaggattgaaacgcttcattttcctggatttcaagggagcacagtctggaaagcagatatgaaaactcgggggtactgctttggggaaaaccatcaacaactttgctgccctgttacattgggactacagtcaaaacagcagctgtgcaccagatgctgactttccgaggaataccattgctgtcccagagacctgccctctgagggttgtggaactgggaagagacaggcaagcgtagttttctcttaagagccttttgagacaaattaaaagaagctgcgagggccgggcggttgcgggtggcttccatcagtgaaaagactgcagagagaggtggcgggagggagatggaagtaagagaaagtcgttctcaagcagtgaaataaagaggttttttagaaaagatgccgtttgaggcactcagggaaattctgaggtgttcagccccgtctgtctggcttcagaaacagtctgagggtgagacaaagacttggtttgatgaactaattctgctgtgtaggcatatgtcttgggtggagtgcctccaaccctggaacaagaatttgagtactagtagtttatttgggaagagattgcaggaaatgccagtaagagaatgaggaaatgagtcaggaaagggaaggaaaccagtaaaggatatcttatcaagtgggttaccaccatgggcaactggagtataactacgagcagaacacacacctcagtgtcataccacctgactcaaaggaagctgggtgttttatctttccaattcccatcagtttgctggagggctgctccaggccgagctgggagggttcactccagcccttctgcctgttcctcctggagttgggccagcctaaccggaagagccagtgcaatggggttgggaggtggcggtgcagctggccctgcagcatcacactgaataattgtagggggcatatgtgactattcttattttgtggatataggaagtgaggcacaaactcttggcatctcttttctaagtcctcatatctactttttaaaggagtcagggcaaaaacaacaaataatacttacaatgcatattgttagctcttccacttttgaagtgctaaactcagtcatactctctaagccttcgctttttctcttagaggcaattccaattttttttaaaaaggtggttcttgttataggttagccaggtgtaacattttctctggactcagcccacacactcctgaacttgctttttatgcagttcttcacaagagagaggcccaaggtcaagcatcatttgatcaaatgtgcaaagaggaactgcattaattctattgccaactatgccccaatctgatgcctgtagctaaaatgagattctcatccttacctcacctccaccaccagtcacatctacttccctaaacccagaaaggacaagtgtttgggtttaatgtgggtaaataataccagctaaggagagggctgctctttgtaattgtttttttgcatagctggcttagaaattacaaataacaaccacccagcagatcccataaggttccccttctcaaggttgtatgctgaggagggccccatcaaggcagggagggacacacttgtcacatttgggaagggcatgttcataccagggactgccccagctgtacttgctctggttaggggagaaatctctgcaatgcttggcagagatgagcaagcatgaaagcttcctaaaaaggcaaaggcaaatttcttcagagtaacagtaataaagtgcacaattctaaatgctcttcctggaatccagtgtactatttgggcctcagttttctcaactgtaaaatgaggatgttggatcccgtctctgaagaccttttcaatattctttgtctgactcatttgaaacccttaaaatatgtttaataacttgtgctcttttttcctgtgtcaaaatgcatctcacattccttaagaagcatttagggcaatgttgctccaagtgtggtctttggcaggtgctggtcctcaaactctctgttacagatttgcaatataaggacagaaaccaagatgtgttttgtgcctttaatagcagtttgatgttgccacaacactcaagtgggattcatttttcttgtaattcatttctactgtattttaccaaagcctttattcccaatgaattgagggcaaaacatctgggcttttataaaaaattgattgagaagtgctcatttgcaagtaataagggaaaaattttaatcacttttaatctcactattccacctaagccacttttgtgaaagaaacagtggttaggagttggggagagatttacatttctttatacatatttgtttagtcatttcatagttttaatcacatgcattttccaaaataaaaatattttaagcaccatcatgaaaaataaataagatacacagtttggacccaaagattttgccaaagtggattaaacatcccagtctccagctgcctgaaaccctggggaaaaagttgggagtgtcaaaggtctcaggccatcaacttgttgccaatcaccagctctgtccagttccccaggactgcctgggctctgttacatgaggtctcatcctaggaacgaccattggtacccacctggctggcagagggctttctgctttctaacctcctctcgcagggttcaggctatctctggccacgatcttcccttcttctgctgagtcaaagcaaatatctgaggcattctgagggacacttagaactgaggagcaattaagaaatgccctccaggagggactggcctccatgttacatggtcatcctacaagtcctaatggaggccctgagaatggcattgccttaatggccatagtaggaaaaatgagcaatgttgcctgatcgctgcaattgaatatcaaagatgttaactgagaggcacatgtatacacactgccaaacattaaaccatcttcctacacattgcagggcatgagaaaaaaaaaaatggaggttgggagtaggatgtccaaaatgagagagaagggtaaagaaagaagaattgcaaaaatccataattagaaagaaaaaagcaaacatgcatttagctgttttggaaaatctatgttacataaataggacatttttcagaagttaaagaaaggtcagcctaaatcatgcacacactgcagatccccatccgtactcctaatctgaaaaactaatattaaaggattagagtatgacagtttaggtcaaatgatgatcctccctccccagacttgtctattttaagcttaggaggaggcagaagagtcataaattctcccagtggggcacaaggagccagtccttttgccagcacctttcagactacccgtgacctcccttccttgtgaaattacccataagtcgaagatgggaagcaggccttgtatcccttgggaatattagggagtctcacaactttccaagattttaggaaaagtaggaagtaacctatttataagtctgtttgttttgggaagggattattgcctttgtcttcctttctaaaatagcattcattaatttttctttaagtaaaaatatgcccaatgccatcttctctcattccccatggaaacttgctttgatccacagagtacctataaaaaaaattacaataaattgtgtagtgtttgtaactaggaagattaggacttggaatgaattggctctgcgtttatagtctcaaggacaaagactttgtctttgttctcaaggactatcagccatgagattgacagctggggtttattctgatcccaacattttcctcctctgatgttggtcatgtcctcctctgtcacttctgaccatgagtatagggattgttgttgatagtcagaggagaaagaactctctgaaatgcttggtagaaaggaaaaagcatgaaagctttctagaaaggtaaaggagtttcatcagagtaacggtaatacaatgtgagattcagaatgttcttcctggtttagtaatttcaccttcacaagaaggggctacatcaaggcttccccagggtagctttgcagctacagtcagattgtgcagattcactgagacaaaggcctagggagagaggagaaagcacttccttggcggctgtgttgggccagctttactagaagtggagtctgacacacttttgtgcaatgatttattgaggataagctctcatgagaaggaagtaagagaagcaggaagaggcatggaaggagttaagtgaacttgtatttcaagagaggtctaacctcagcttgatctcactggaagctctggagagtgtgaattgcaccatagttacccaccaagagccaagagaattggactgttaaacttcaacattaatttgtcatcggctatacgctgcctctgagagtaaggcggtcatgtccacgaatctctaggataggcaactcccattggccaaggacaatcccccagaaaagggtgaaggtgtgagcccttatgagccaacacctgtggcagctgtaggctgctggccctagcttggtcaaggggaccttggcaggcaccaactgcagctgctacataagccaaaacaattgaagatggaaggtctgtggactgtaccttatctaaggaacaatttatatcatatacaaatcctatcctttactattatatggtagtacatatatctcaaggtatggtaccaagggggcatcatatttgattagattggattacaagataaatctgaagaggaacatggaggtagctcagttcagtatattcattttatagaagagaagaagtacatgagagtaaacacttactgggaaccagatctgattctcagttttctcttttgcttgaattcaaccgaactcatatttattaaattcttactacgtataaggcacgattttaggcactgagcagataagtgaaagacaccaaattcagccactgccttgtgccttaggcatttacagtctggttgaagataaggaatgaaagaaaaaaataagagtataaatgctatgcaaatcacaattcagatctcacccaagagcaatgtggattaaatgcttgggtcctttgaggcaaaaagcatgacacacaggaggatagtttgtggtttgtcttaatgtgatgggaggccttcatcccaaattcccctgtatttaaaactataaaaaagaaaatatcctggcagctctactatttggtgaagctgaaaaagataaatattcaagtagagttctggaaaaggggaaaaaagcaaatgaacaaagaacaaaaacaagccgtcccttttcaaaatgtcatcttgccatgaaagcttcttcaattcgttacctagaagtgcaaatgtattgaaagttttactcattaaataagattattttgaagctaaaggccaaagatcctacttactttggagaacagtgttgaatccagcccaatctctcctttcagcccaggcatgttttagtactgggatgttttctatctttttaagtgtcctgtgctctgtttacactatattaatctgctcatttaaattggtgttttgttttaatgtttggccagagtttatgcactgccactttggagagaatctaagattcattcattcattcattcattcactcactcaacaaagcatttgttgacagcctgttggcatgggagacccttgcaattggcaccaagaatacaagaatgagaaagggactcaacttgcacccaaatgctcacagtccagttaggtgagaaaaataagcaggtgaatatattaaataaaatatggtatatgcacgaatagagccctgcccaggatatctaaccaagattgaccctaaggatgttcaaggaagtttttataaagaatttgaccttagttgaagcctgaggccccggtgaagggttacctcctcctttatcattttctttattgaatataccatcagaggaaaattatcgttttaaaattttgttgatgttgttaatctgtcccctctgtcttcccactaaaacagcatttctcaaccttttttaaaatcagtgatatcgtaaggagcctttttaaacaactttttttgtttgcttgttttgttttttattttgtatagatagaggatctcgctatgttgcccaggttggtctcaaactcccggagtcaagatatcctccttcagcctcctaaagtgctgggattacacacatgagccacagcacctggcctgtagacaactttttttctaaacactactctccatgatgtttttctgtagcaaaataggcataatataaaatgtaccatcttaaccatttttaagtgtacagtttactggcattaagtaccttcgcagtgctctacaaccatcaccattattcatttttctgtactgaaatttgctcaactgaaattctttaccccttaaaggataacttttcgtaccctttcctcccaggttgccccctggacaaccaccattatactgtctctgaatatacctgtacaaggtacttcatacaagtggaatgatacaatatttgtccttttgtgtctggcttatttcacttagcataatgtcttcaagattcatccatgttgtagcatgtgccagagtttcattcctttttatgcctcaatacctacatgaaatttaataccacattttaaatctctttgtatactctgggcctttggaggctcacaaaccattgtaatacataagatttttccacttcccaagaaccagtttcacccttttgctgcaatatccccctgtagaaaatgcctgtgttaaaacctaagctccgtgaccctctctatcttgttgtccactgtgtcccccagcgtaacacctagcacattttaagtactcaacaatcatttattgaatacttctctagcccttccccaaccactccttccttcttatcttagccattattattaaaatttgctcttagagtaattacgtatgtatttgttacttagtgcttcatgctccccagccaggcatctcaccatgctcatttcctttggctgcacatgccattctcagtgaccctgtgtttgctggctttcttcacagaagtaaaagattatgagcctccatttggttccaaggtgcgggagcacccctgtgtcgaaagcatgaaggacaacgtgttgagagatcgagggcgaccagaaattcccagcttctggctcaaccaccaggtaaggagtgagtgtttacaaaggtcagtaagattcaaccaagttgcctcttaggtggcagagaattctggaatattgagcttaaatctgagggaaggtcccattgtgttctatggccctgttaaattttgtttataaagcaaatttcaatacagtggataacccaattattataggctccaaccagctgatatgtactctgagagttcacaaatagccattcggaggacatttgccacattttccaagcccccttggtcctgggttaaaacattttgtttgcagcctctgctacttactcctgggccttcacgtcaggagtttatatttgattccctctggattccaaatgttttcttctgggaatcttcagctccataaggaaatacttagcagatgcaaaacaagcagggtttgtcaggcagctgtagtgagaagtgactgtggcatgcagaaggctgtgtacaggtgtttgcaggctgtgctcacagacttgggagaggcctgagtgagcacgcgtgggaaagaggagaccgactcctcactctggaattaaggaaagcaaagaagaggagaatgccctggaaggaacgagaaatctgtctgttgggaacatcctaatggcctcttatttttccttgttaagaaatgctagctaaggctgtccatagcagggcagtcattctggactcataaagaggctgatccaaattgtttgtttgggggcactttgatgagggcaatggtcagagaaaaaagaaaacgataggttgtgagtgagtcagaaccagctatatgtctgacacacccaggaaggagcccttagtgaagaatgagagagaacagtgtggccctatctcactgagaagactgttctttctactgactaaaaccttttattgcctcttttggatgaattccctcaaccatgaaggccgaggctaagttgttggtttccctaagggcaaggcaaattcagataagaaacagaaacaacaaatcaggcacaatcgggaagacaaatggagcaggaagtctggtctgtgccagtcctggcccagagccacttcagcagacagaccttaataaagtccgaggaggttggcgagggggaaccaggctgtggtgggtcacaggcttctctggagttttgagcaaatcctctttgacactaaaactgtaagaatattttgcataaattctgaaatcagaatgtgctggagtgttatgtttctttcaaactctgttgcctcctctgctgtatagttctcgtaatgatgccattattcatgatgataaaattctgaaaagaatttgcataatacattttttctcataatgagatttgttgccctattgatttcaagttaatgcttaatatttaatttaatttactgcctgtaattacagtgccagaataaaataaatgttacttgtgtaccaacaatagcactctactcttaacagggccatctgtcaatactgtcaattaggtgaattatgcaattaatttaacatcatgaactcatcgggtggggagggagagataggctcctaggtgtgtttggaaagttgttggtattagaaaacaagtagaaaaagtgccagctctcccaggtagttttgagatttatccatcccactcccagccacctgtgtgagggatcccattagcaatgttgatcttacaattgggaggagcacactctatttccacctatcagaccatttacttaactcctgcctgctttatttccaaaaaggatttgaaatgataacaaaaatatttgcaatgcaaaataaaaattaagccagtgagagaaaactcttgccaccttcctgggcaggatctcctggatggtctccttggatgggagcttgattcggttagggtgaaccctaggaaatggcatagagttaagcatgcctgacccacataggcagctgtttcacagggttcaacccaatgttgttggagaggaatggagcatcccagaggtcatccttggcagctcgtagaagctgctactgaatcactctacaaaatgtgtggcctatagaaaatgaaaccatgctaatgcctgcatacaattctgacgggggtaatcagccctgttaaaatagaacagtgtatatgacccaactatatgacactctggaaaaggcaaaaactacagagacagtacaaaatcagtggctgccagaaatttaggggaatggagggagggatgaataagtggaatgcagggaatttgaggggcagagaaactattccgcatgatactataatggtagatacatgtcattatacatttgtcaaaacccctggaatatacaacaccaagagtgaaccctaatgtaaactatgaatttgattgataatgatacgtcagtgttagttcatcagttataacaaatgtacctcatagatgcatgcatgatgtcaaggtggagaaggctgtgcctttatggggaaggggttttgtgaaaactctctgtactttccactcaattttgctgtgaagcgagaacttctctaaatagaaaggtgttgaaatgatattaagggccactacatggggaattttcaggtgttgggagtgttagtgtaccccagaagcccagcagaggatcattgtgctgtcaggacctattgtgatcagatagcaccagagccaaaaagtatggtaggttttgagcacagctgccaccagcacaaaccccccaccaccctttccacatggaactggctggcctgcagcagcaggcactcagtcagcacatgttaaatgcacaggcacttttggaccctgcttgcactcactatagcaacaaggtcagcaggccaccttgccttccgcggagcccaccaactcatggtgccctttggatctctttcccgctacagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 124 - DNA, 50155 bp, Homo sapiens
ctgaagaaaggactagtctgacaggaagaattacaaatctggagctcattttggcgtcgcagagggaaggtgggtggagcgtctcgcagtaaattaggaattcagaatgaaaacgtagagtttatttgggtttttagtgacacctcaggattattatacagcagtgtcagacacagctcaaagtaatgatgactgctccccctccgccccgcgggagctgggtgctaagaagggggaacccctcctttgaggggttggggtggggatcctccctttccaacctggatcgggaaggggtttgagaggagtgcggcttggatccccatcctggatctgtgctggagggaggcgggaggctatttgggggtgtgtttgggctcaggatctgggtctgacgctgggatctgaggactttctgggtttggaactgggtgggggagctgggtttggggtgaccgctgggagcaggaggaaataggagagtgagtcgcatgtgaagggcactgaggagggatcttcgggggaatgctgaagttgatgcgtggacttggagaggggaagttgaagtggatgcaggggcctggcgctgcagcggatctgggtggcatgtgctgggattgccaatgcggagctgtgaatggggtcagggtggggctgaggcagtaccagatcttccgcgcctagaggaggttagaagaaaagagcgtcgaacggccacagcctttttccgaaagagactcacacagacacacccatcgctctacccggccctccggggctagcggctgagcggtgctggggctggcagaccccgcccccacgcggcctctcggagccgggagccgatcgggccggggctggggtctggcggcccagcccccggggagcgtggggcgtggccagaaaccggcgctcgcggctgcggattggctgcctggcgggcccgcaggcggggctcccggctgggtcccgcttggcagctcgcggcggcggggaggcggggccggcgggagcccggcagccaatggacgcgcgtcctccgagcagttacaaagggccggagcgaggccgccgcggcggctagggaggtggggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacgggtgagcggcggcgcggcgggcgggcgactgcggggcgcgcgggccggacccggcctctggctcgctcctgctctttctcaaacatggcgcggggccgggggcgcaggtggcggcgccggggcccgggccgggctctcgtggcgccgcgcggctcggcggctgccgggcgaaccgcaagcggggagcggaggcggggcaggggcgtgtgtccgggcgcgggcggacgtgtccggctgcccgaggccgccccgctcgggactccccggggaggtggagtcgggcggagtcgtccgaggtccggggctgccctctggggtgtgagtgggcgagggccaggggcggagagtgcgaggccggcggggactggcagagccgtggctgcccgccgccgccccctgggcacggcgtgaccttgttctggggacccccgccccaagagggtccgtgccagaggctgccgaacccggggcggggtttgaggttggggtggaaggcggctcccgggcggggtgtgagctccgagcctctagggcttcgtccagtgggagtcgggggcgacgtgtggtgagacccctgggtccgcaggccgccctgactcccgcccggctcgacccgagccgaccctgctggaaggggctgctcctccagccaggggggctttgtgtgagaagaaggaagcgcggagatgcgcggaatgtttcttctttcgtgcgtctggggagtgttgaagtgagtccagtaaccagacggctacggattgttttcatagtggaaacttgaacgtttgctcattctgcgggttttggaaattttgggaacgactgtgaattgattaaacgctttttatttcctcgaaggaacatcactcacgttgttccttttcttgagtgacagttaatagtttgattcagacatctgtatagctggttttcaaggaagactgttggctggatttttcaaaatagtaaatcaggttggggtaggtggttggtatccacaaagggatgagtgaaaaacttcgttagcagctgaactgagacactagaagctaaaatacacagcctcagtgttagcaactaaaatgcagtgaaagtacatttctgtttctgaaactggacaaaagatgttgaaatttttttaaaaaatcaagactgacggtgacgattataatcagtcctaatagctaccgtctatgtattgtgcattactacgatgtaaatgcatacactattgtataattacattatttaatcaccacaagtaaactcccaggagtagtggcatttgccccactttacagatgtgcaaagtggggtacagacacgttaagtacccaataacttaagtgctaaagctaggattttcactcagatctcagtttcccaaacctgtatgtcatatatatatataaatatgtatacatcatactatctggcgtagcccatttttcttcttcagtcgtctgatgagcaattggtctttattatccactttggattctgtcctcatgatttgagtatcagataggcttcattccgactcttagcacattgttgagtcccttcacgtgggcctgcattagaggaaacaatggatttttgacattggcctagggaggaaggcaggataactgtgtggacatttgggagaatcagtatagttaggcatgaaacacaggtaacatttccacaccgctattaacttgaataacacagtgcactcttttccaccagaagtagcacaagaagcgttcatgtattcaagtaacagtagtggacttagttgaagacacagaacattgctcagtccatgtcctggaggagtttacagtctccatggtatgcacaaaatacaaagctgtccaggtgcttattactctaagcccagactgcctcagcttgtctgcctcccctgttggttatgatgatgcctcagtccacccttaaaaaacattctgaaaaaggtcaaatgctttttatttcctctgtaacttggcttcccttttaaagacttgcacctttttatgttctgagtatgttttaatgttctctgcccaacttctgtctccaacataggtttctctagggaaattgattccttatccctagtgcacagtttagtaccactatgtctatatgtatatcccatctgagaatgctatttgcttcctttctgccatttcataactttttttctttgaaaacgtgcccccaatccaactcttctatgaatgcctcttgaatgtctcctcctttcttggtatgcagccttcagcttaatcctgcctgttatcctccaaatctagttgctttcccatgtttttctcatctaggcttttctatggctactgccaaactaatcttcctcagccttccccgtgaaggtttataagatttcccatttgtattcagcacttagaacaacacttagcagcttatgattggggccatctctgagtatcctaccagggatctcatttctcattactgcagaccttcgagcaatttctctttctcactgactcctgactgttcagccttttcactacacatttagttttgcccctttttttgggagtgcgagaagttctcagccctgacttcctgtgctggtttagttcttgaattctttgtcttccagaactctgcaacacttaacagtttgtgttgtccatttctactgcctgtgctgctacttaactctacttgaatgcgttataggtacccagaggacaagattcatgccatttctttcttttgtggcctcagaacttagcactgtgttttatattctattccacataaatgcttgttgatttctatttgagcattcctttaatatttatactgttttatgtaagtccagtttatgcaatattaacttgtaattccgtataaataatcaggaaaagttgtatggcgtgttgaaagcaattggttatttgtcctaccttcaccagcagttatgcagaaaatggggcaatacctacttttgcctaattcatgagattgtgaagatcacatgagaaagtggtatttgagtttgaggttgctattctgtgttgttgctaaagagcaggactgatgttcaataagcagttcccactgggccatgtgtgttttggttaaacatcctttctgattggttggtacccttgtagtgccagttgttaaatatttttaatatcatttctatagggaggcattagtattcaaaaagggaaatgattagtgtaagctggaatgattgggggaggcttcttggacactttaggacttacactgactttgaagggtgggtagaattcagagggggatttgatgagtgtgaaagttcttttgaagttgtgtccccaactgtcctggggcctactccaagggaggaaacaaggcttttactgactgactggcaagttactcttcagagttaggttccttattctgtactgtggaatttggatgtattaacctctatcattttttccccaatcctaaaagctatagtacatagctggaaacaaaacataaaagtaatcaaagtggaatgagtgagggagaataacattatgggatgcccagtaggactaggcattcaaatggtggaagtcctaagtatattatcacttcaatttacagatgaaaaaacgactcaggtgaatttcttagggtggcacaggggcagaacagagacaggaactttgattttctgattccatatcttgtgccctatatggtgctttaaaatgtgaaggacttggaggtgggagtgggacagggttgggataggtggttggcatccacgaagggatgagtgacttccttaagtgaagtaggccttgaacttcacagaatttatgaaaagtgaattctaaaggtggaagggagggggaatgattaaagccttaaagttctcaaggaaaaggtcaatttttttttaattgctgataaaaggacctggtatatacttattgattgagaaaagtaggcctatagtagtttggaagatggtcttgagtaagtacagttaattgaattggggtgtagttagaaggctttggtttagaatattagatgatccgctttgttgttgaaattaagagaggaattgacataaaaataatcaagaggaagataaatcttgttcctgtgaggagggccgctcatgtagggaagacccctgtcaaaaggttctaggccttagttgagcagttacagggactcaacaccattcttgtagtgtcattttattgcaccaaatatgttcatgtgtaataaatggaattttgaaaatgccattatcctatggatggcccttctgatgtgagaacgtgtctcttcaaaccacagagccccttgcaaatgtcgacacacctcttgccttttgcagttcttccttggtcatggcttacgtaacacagagttctctgaacagatggactgtggtttgatatcatgtgattgggtcacatctttgcttcctgcttttggaattgagggcagatgctggcatatttctcagggattttttaatgctttgtcccatagaactagcttgaggaaaagttttggagtcttctcagaatttatggtcagttttgacccagcctaactccaatacttaggattacatttaatgccattcttagctgaattttctcaatgtcaaatccaggcagtctccataaacattaaaattgtttaccactctgaattagatccaattttatgtgttttgtttgctttccaggtaagtttcttatggctacccttcttcatcatgaagaaaattggttggtagacttgtaattattcatctcagacatcactttcttaaatactagtggactaagttcagttggttttatggtccaattttatagatcagatcaagtcttttataaagctgctccctcaaagaacaatttctaatctaacttaaaaaaaattgacttgcaaagtatacacacaggttgctttgaaatttcttgaagggttgcaagaatatgctacatattctatctgtcttgtctcgtttaattctctcttctctctttttttttctttgaccatggctaatacggcatcatttagttctcataaccaaccttgaatggtagttgtatagagtaccaaaacttcttacttatttgctgcttaatttccaaactcttaagcccatttgttcccagatacaggtgaccagtgctcagaagataactgtaggttttgataacatcggctctaccccaagattcttttcaactctaaacattatccaaaggtgttagtattttttcatcgtctaatcgtaaatatatatataaaagaaagacactgctttgaatggcacagatgtagactaacagtagttcagccactgagactcaaatgattttgtattaccataaaccccatctgcctgggcaggcagaattgacacaattttgctcagattggaacctagttcatatctatgaaagaagaccctctttgtttccattttatagaccaggaaactgaagttatgctgttaatgaaaggtggagccttcagttaagcactccagggtatgtactcttttcctatacaaatgctcctctacttatgatggggtcacgtacgtccatgctcctttcatatagagtaaatacattgttagagccacttcagcaggaaagtttcctttcccttttttgcaaaccatgagaatttgcttcagattgccttgattacagttttactatttctttgcaactgcaggccattcagatactaacagtctttctttaacattatatttttaggtaatttgaatcttcctgacgagtccagtgatagttgatcacttactatttgtattgatttatacatatattcatagcaaattcttttcttctaaaagttacataagcacaggactgaaaatttgtattagagaaaggaaaaaaaccatcaccagccattattaacatttggcatatcctgcacccatgcttttttttttttttttttttttttttttttgagtataaaaaaccattcttgggctgggcacagtagctcacacctgtaatcccagcactttgggaggccgaagtgggcgaatcacgaggtcaggagttcgagaccagcctggccaacatgatgaaaccctgtctctactaaaaataacaaaaaattagctggacgtagtggcaggcacctgtaatcccagctgcttgggaggctgaggcaggagaatcacttgaactcaggaggtggagtttgcagtgagccgagattgcgccactgcactccagcccgggcgacagagtgaaactccatctcaacaaaaacaaacaaacaaaaaaacagcaacaaaccattctttaatcattctatttcagcagtttatgaaagctaataaaagtgtttaaattgacaaacagcttcagtttacagaggaaagagcttcagtttacagaggaaatagctcatctattcttagcaaatatttagtagtgatcaacatgatgagaaatataggaaaagtaagaggcagtcttgcttttgaaaaaattgatgctgaggaaatatgactacagactcagtactagcaaccacagggactgctttacagaggaggtaggacttgatctctctgccttgcaggaggatagggctttgagtggatgtgtggtggaaaggaggcacttcttggctggagaggatggcatgtgtggagaaagagcattctaagtttcaggatttctaagaggagaaatggaagttcatggtgtaaagggtgggctcagagaattatgggccttgaaaatcaggagagtggttttaatgtggaaaaagaatgtctaattgtgccgcagagggaatggatcagggtggctacccagttggtttgatggcattgagaacggggtgaaatggtgactgtatgacatttgaaacaaagaaatcagaggaattagtagtagggcctgtgtgtggctgttcccttgcttgtgtgctcttccctcacatacctgcatggcttcctccctcacctcctgcaagtctttgctcagatgacacctttttctcagtgaggcttatcctgccaccttttaaaatattgtcatcatcctacagtgctttccttctctgtaacaataccttctaacatactgtatttatttacttatcatatgtacttatttactgtttattgtctccttcctatcattctatgctttgtgaaagtggatgtcttcgttttgttcactaatgtatctcaagtgtatggaaagtgcctggtgcatcctaggcactcagtaaatatttgttgagtggcagtaggtcttagctgtaaagaggtggagtacagaaattcagagtgactccatgaaagaaaaaagaatgactccaagcttttttaggctggataatgcctttaacttaatgagtaatttggcacgaggattaaggggagacgaattctggtttaagcatgttgagtttgaggtgaaggtagccaaataaaattgctcagtagtcagcaaagattaaaaaaaaatggaacctagttggaaatgggagagcaccttaagcaaagaaatggctactagcatctagcattcacctcatattctctctctctctctctgtctttctcttttgggggtaggaggattctagtgtcctaaaacgctaccttaaatggagtttttatttagaccctgaagtcctagcttgtatctggagtcctggtccgtttgctgggatatggttctttcctgttttgcaggttcatgctatttttcccccacctctcttagtaaagatgtatatattcagaattacttgtgatcttctggttgtattgaaattaaccttcagacagtgctgctttctctgcagtaatgcgtttgatcttttgggagtgtggttcttggctgagataaaagagaggaagtttcctgcttgcggcctaggcctcaggtcatggttgctgatgttacaggtgtcagctttactatctcctggagctccctgatggctatccttttaaatgcttttcctgttgtttttctcaatgaaccaaacactggtgcagttgtatccctagaccatctctctttttctatttggattgatctaacttaagtttttctttcagttttgaaggcagattaaattcatgtgacttggttgtcagaaatttaatgaaatatttgtttataggagtagtatataagcaccaacatatctggctgtaattagagtctaatcagtgtatctgtgactcacttttcaaaagaggatagttcctaatttacctgatcgttgtgaagatagtgtacagtagtatttacacttagtacatagcctgacaccagtaggtgttcaataaaggggaattattatatatttaaataagtgaaagaatgtcttctgaaagaagaaatacatgtctgtgtaatgaagaactagaattaattggtagactgaaaggcagaattcagctcaatgtaaggaatgactctctaccatagctgtcaaaatggaacattgtaaggtagtatgttccctgtcaccctggaactattcaggcagaggctagataaccttctgtctgagaaattgtagaaggaatttcttacattaggtaggaggtcggacttgtttatctctaagctctgtttctcctctaaaattctgtacttttgggcataatccaagcttccttgcttactggttttagccaaatatagtctaaatatccctaggattcatggcttcaagatgagcagtatcttgttgctcctgtattatacgagaaaagttagtttatccattgattggcttttattttggtcattttccaaaaaaggattttggaagcttgaaataatagcaaattcagtaagaccaaatctactgaccacaaaagataagaatcagtaagtcaaaaagggaaagaaaaagagaacaattatccgtaagtttagctgaggaaagctttagaagttgaacacaatacttagctctgagttttctggtaaccaaggcaagtaaggaagactgataatttgcatagatctcattgcctatcgagaattcatgaggagactgccaccttccttaataaagtggagccccaaatgccaagattgtcatacagggagaatctccaagtggtaaggggttattgctggatctggcaataatctgattcttgttctgaggcttcccctttaacacgtattgagggttcaatttagtgctgctgcctccatctttcttctccagtttaagtctctgatccaagtatgaacacattagtctttccctaatgccaatggaacagctgatgtaaggctaggacatttaaatcaagctttgctaaaagctggaggataatgaatagagagcaacatgaaactatttagtctggcttacaaagacatttttctcatgcccttatcttttggtgtgtctccatttgatacacttcatcagagtactgctaccaaaggcagagccagacatttaccttcaaacaggtgcaagtcagtaagatccagagtgtctttgcttgggtttcttgtttgaagaactgcttcatttctgagtaatggacgttcggaatgattactttaggagagaccacacttatctgagagtgtggccctactgtactggtctcacagtaatcccagtattcatggaaaagataggcacgtacattagcatgagggcattctgtggttagaagcattctgatttcattgggaaaaacaagcttctctctgttcttgagcagaagcttttatagaagtctttgtacatgggccattgaaaaataaagtgaacaattcgggtttatcactcatgatttgtaaggattcacttttccttttttctgcagttgctgtactacttcaggtctgttccagtgtttccttgttctcaccaccaagactgaacctccttatttttgttcatttgcttcaggaaaaccattccatctagatttcctaggtgtaaacctcactgattacataatagtgtatatttatagttctaggacaccttcttcaggcatcctgttacatttctacattataagattcttaaatatgcattgaattacaaataggtccccagggaaaaggcaaaaacgaatggctttttctgcgagaaactaggactaatatagatatttgggagcactgaacatggaggatagagttaaacttgaaaagacatacagagatagaaaagcagcaactgccctttcatttgtatgcaagcacacgatatatgtatgggttttttattttttgcttgatgtattcatttccaaatcaaactataatgtgctctaattgggtctctttgttcagcacgtggttgttgatttgagtactttctccagttgaaaaactgacattttaattttgttattcaatgtgtgatagatttaaataaaaacacccaagattgtgtattgtagatttccttcaacaataattatatataattattttatcaaaataaacaagttaaagtagttttagttattttgtctcattttacatttgggaaaaaaattacaaatcaggggccagagtctggtcatgtttgtcagtgaggaaagacaatttctgattgccagtcccaccaaagcgttggcagattaacacagcattgtagattactttcctaggaagagatgctccttttttctccctttccattattttgctttccttctttccatggtgcattgtccttttgttttcttccctcttatttcgatgcatgtataaacttgagcctttctgctctcacattctttctccccatgatcataattgtttcttcactttattcttaaaaaaaaaaaaaaaggccacataagtattttatgtagatctcatctatcatttaagttttgtcagatccagcctgctcttgccttaccatgggagaagggaaaggagggaggagttttaagggattttaggcatcaggcagaagtcttaagggaaaactctgcgaggaccaacaggctcagaattagctgtgcattgcaaacagatggtgtgtccctgaggaaatagcgtagttgccctaagcaattgggtgcttccatctgatttagcttagtctctgtaactgggaaaaaggaaaatcttatggaagaaatgagtataatcacctgtgaaccattctaaactattatctagagactagtgattattgacttacatatagatttcataattctgcaagatagtcttcggtgttgtatcatcagttatccaaggtataaataacatcaagacccttatgcctctgagcctgatagatccttatcttttaataaccaaccccccactttcttcagtagccatgatgctactgtatcaatgctaccagcaattggaaacccatattcctaatgccaagtctcggcatgtagattttgaggtctgaaaactttattagcttggttacagtacatctcaagcctaagttttcatatacacatagtttagtctcaaagggcaaatgtttccctgaaaggagttcagtcaacactagatgcttatatctttaggctccaagggagtccaaaatttaatgattaaaaatattataaaaatgcaaatatagaaataatacaaaagctccttccttttggtgggcttttctgtccttgcttggttcaattcagctgtgttcttctaggagactgcaaccacaatttaactgctttgctttggtattttgtttgacaagggagatgaatgtttcagatgagacggagtctcactgttgtcacccaggctggaatgcagtggcgcgatcttggctcactgcaacctctgcctcctgggttcaagtgattctcctgtctcagcctcccgtgtagctgggattacaggcatctgccaccacgcctggctatttttttttttttttttgtatttttagtagagatggggtttcaccgtgttggccaggctggtgtcgaattcctgacctcaggtgatctgcctgcctcggcctcccaaagtattgggattacagcgtgagccaccgtgcccggccttcaattttttgctttaagttagaatcctgtttgcttactttttctgacccaaatgttttaaaaatgttttcctgtgttttcatttaaaagattggttttacctctcacattgagatgtatctggagttggttatttattatggtatgagatttttattatttttaaaatacggatatctggttgactcagaaccatttattggtaaaaccttttttcccccagtgtacaatcaccttcatcataaatcaagaggttgtatatgtgagggtctgtttctctgtaatctctgttctgtttgcccatttgtccttgtgccattaccatactgtcttaattattatgatgttaggagtcttgatatcgagtagtgttaagtctttcaaagattgctttggttattcttgcgatgttgtttttccatataaatttcagaatcaacttgtcagttcccactgaataaaaaaaccctgtggggattctgatttgattttattgaatctacagatcactttatggaatattgacctctttacagtattgaatcttccagttaggaacttgtcacttttctccatttataaatacattttaaaattttattttatctcctttgtaatttctatcaataagtaatattttttaagctttctctgcagaggtctttacctgtcttttgttaggtttattcctagtttttagatttttaaaaaacgttttctatttattactggtttaagaatgattttttaatttaattttttttggtatagtgagtaaccttatattagtgaccttgctagattgactaattgattctaatagttgatctgtaggtcacttttggattttccatgtacatagttgtcctctgcaagtaatgatagttctgtgtctttccagtctatcttccttttgtttatttctgacttactacactcagacttctaatacaatgttgagaagtagtgatggatatctctttcttatttgtgatttcaagggaaaatgacagtcatgcaacattaaatgtaatgcctacttttatgccttttatttaatctgattatttcagaattttttttaaattctgcaatttactgaaatttttaaatatcatgaatagctgttgaattttatcagtttactaagatttttaaaaatcatgaatagctgttgaattttatcagtttttttgtttttgtttacatcacctaaactgccaaactcccttactgttttctttcttttttttttttttttttttgagacaggatctcactctgttgcccaggatggagtgctgtggcctgatcatggctcactgcagcctcaaactcctggggctcaagtgatccttgtgccccagcctcccaaatagctgggactacaggtgcgtgccaccacacctggctcaaacttttattttggcatcttttgtacaatgtttttgtatatcctctacctaaaatgactttcctttcttcactagctttccttaagtcttagtttaggtgtcatatttcagagaaatctcccttttctgtcctctgatctgtgcactttgcatcatcatttatcagtggtgtgttctctgcattgtgaatctgagggcaggaatctcaatcctaattatctctatcctcctaaaggttttttctttcttcctacacaggttacattcactgttgtgttctgagaaaaggtgttcaggccttgctttctgcttctaaaattactaactgcccaggaccatcagttcatttcttcaactgtggctccaacagatctttcgctgtttgctggcccaggtattgctctcctctgccccgagtcaatggcagctgggagtggttaccacttccttctcttaccacagttccttctctaccacagttctgttttgtatgtcattcccctagcccaggatgatcagccactttcatttacgttcattattacaccttattatctgtgcaaccaagccagtctctcctacagccactcgtgctttccaaagggaaaggttgaaattttcggttttgtcctacgtgaggggttgtggggagtaggggtggaaatcactgtagattatcaagtaatcctttttttctttgtgtacttttggaataaatctagattatgttgatgtaactgttaggacatttctgtttcttcatctctaaaggagctgggatctgatatttctgttcatattccttccagcatgaacattttatggctaattagatattaacttatttattagggatattacatatacacactgggtgtgtccctacactgttaatttgggttggaactgaaaatatactttctgtgtgtgcctactgctactgtagtgaagttcttgagccaggtctgttcagtcatattgttgaaaaactgtatgaatatttatgaaggagaaagagctgataggtaccatgaacattcactgttgtatatgcatatggtttatattgtgttctgtgtcagtattgcctaccagagctgtctcaacattagctctgattctctgtctagcatctagaccagagactggcacgtaataggagctccaaagaaatacttgttgaaaaagtgcataaactaatttttgaacattttattatgtgctgggcactgtgctaagtattctatgtatgttatttcattaaccctcaaaccttctgagattggtactgtttgttagtatgttataaatttaggaagtaagttgaagaaatttaggttcaaataagttaagtgacttcctcaggattactcagtgcctgactggcaaagataggattttaacttaagtttttctgtctctgagttccatcaacttaactaccatatccttataatacctacccactagtcaaattaaaatctaataagaaactgtgtaaaagcatacttagattgagaggaaataagaaatttggttattgttttagcactcacctttagacatagaagtttctccatttcttttcagggcctggggtaaggcaaagtgtgcacatctgctctgtatattaaaatatcccctcaactcattgaagtggaacaaaaacaaggtcacttgacaggactgtaattgtaatcacactatacagctttacttcctgccctttagtagtaggaccattcccttgtccttaaacatgcttctaaaataccagttttaatggctatatagtctttcatttatgattgtataaggattcattctgtcattgtattgtcattcacataggttgttttcaatcataaaatactgtaatgaacatctgcaagtttagatttttgctctcacctattgtttcctcagacaactgtaagtagtagaattgatggattaaaagatactttttaaaggctctgactcttctaaaatgtgttgttaaactcctcagatctgctaaccagatctttatgctgtacttgtgtgatttatttcgaatctaagtgaaagcctttgtattagttaccctgttaaatcccatcttgccatttgggcagcctattcttagtgtgttttctctgatatcagttaacattatattggctaattccatagaaactaggagactggaaaatgaagataatgtggaaaaacaagagcttgtgaatttgggagtgccctgttcttttaagatgtgatgtgggttaaatgataaacaatgcatcttaaattctttaaaagtggcagaagtaaatggaatttatctggaaaaaaatcaggcgtttattctgatgccctaaattcaggggtgaaatattatctggactagaggaaaattttatgtacattatatggtgttctctattttgacaagcttactttgatattactgctgcaaggtagccccaggagggttgaattgagaagaactgagtattttgaggaacaaaacctaggatagtaggctggagggaattggaggtcagggttttagccatgtatacagagataagcaacatatttaataaaaagaaaaggagaatctatatagtatgctttactccaaagctggatgagggagaaaagaggacacgtctccttgagaagggggcatgtgttgagaatggagaaaaggggtaaggcagattactcagaagaactggggtagaagaataggttggatgataaaaggggctgacattagtccctgaaagttttttttaaataacttccaacttttgccttcacctttgccagcagtgatgtgatctgctttcagctgtagtgaagcaaactgcataaaggacattgtgcatgttaggtcttttacttgcctgttggtacatgtttgtaatatttggaaatactctcactgcgaagaaaagtatagttgtgctgtagtgggtagggtgaggaaaataagggtcatcaccagcaaagtcagagtgatgaaaaaactggattacaacactctgcttgactttgcatagataagtaagccaagcagagtgtttcctggatgtagttaaaatacaagcttggagcacaggtaaaaggccaagaggcttggagatgtacatctgagatgtaccaaagggccaagtgcaaagtaagtttgggaagtttagtgtcatataaaaactaataaagaaagggtggtactctgtctcatatcctgaaacgttttgaaaagaatattgaatttgaccagaagggcattgctagtgaatttcaaagagagatttcagttgagctctgaactggaggaagatgggtgatagaaggctggagagggccagtaacaagggttgaaaaaggaaagagtattcaagcgtatgcataaaaagactacgggtaggttgtgtagatgatgacacactaagcctgggaagacaaggtttcggtgctaatttttatttctttaacaagggtgatagaaatatctgttccatatattaatactatacacaactgtttacctctcagcttttctagcaagacatatgggcttgtgaattaaccctgggtagccctggcattagatagaattaatagtgcttccatatgtgacctcgagacgtactgaaatgaggcaaccaaggaaatcctttatattgggaccaagagccaagatctcaacttgggatatgttaccccgagagttgttaccccgatactataataccatgaataataaccccaagggtcctgttgtctctttttcctcatgtcacttcctttggtactaactgtcaccatgctaacatctgcaaactttgaaaattctgatttattctgcaatatttggaaatttcactgctagtaattgtatttcctggcatggttctgatataattttctgtgtacacagtagcttttccttttagtgctgaatcacactgaaatccttgtttaacctaagttatagttgcaagggagctatcaagacaaataattacagtgatggtgaagtgaatacaagtcaaacatcccaatctgaaattcaaaaccttttgagcacaccaacatgatgccacaagtggaaaattctgcacataagtacttaacatgacctttgtttcatgctcaaaattatttcaaatattatattaaattaccttcagactatatatataaagcatatatgaaacatgaatgaattttatacttagacttgggtcccattcccaagatgtctcattatgtatatgcaaatattccaaaatctgaaaaaaatcccaaatccaaaacacttctggtcctgagcattttgcatgagggatactcaacttgtaatcttttctatgtatagccaagtttgcacatacataggttacaacaacccatcatgtcttaacctttcagtctggaggctggagttttctttttactttgattgtaaattgtattcagattttagaaatgtaaagcttagagaaatgtgcatctcaagattaagaaagctatgcccactgttaaagactggggcatggaaacaaagttggacagtgtagtagaaaggtcctaaacaggggatttggttcttatttttgctatcaagcagaagagtcaaaactgtaggagtctaaaccaaatcaggtccacctgggagtctttaaagttcagggttacttagcatggggatagtggtatagcaaatagttgcgtaggtttcactcgtgggctggtgataatatagtgaggattcacatccgcctgtaatctgggtagaatatttgtataaatcattttggttttttggttttctttttaaaatttttaaaattgttttgcttttcttaagttttggtttctacattaataaaatgacagaactgaattgcctagatgatattcaaagtttcatgtggttctgttagtctgggattctacagtggaattttgtcactacttttgggaagaagtttacctttggtggcctacgaataaaaaccacattggcacaatgccatttatcatatgggataattctgtgtgtttatataatcatttatgttcgtttccaaatgtgttaataaagtacagtatctcatttgattagctcagatgatgaaataggtcagagaggtattatgtttattttcctgatgaaataaaacatcgtagttagcatcttgaacaatttaaatttgatcatcttacttggtatgccagccactaaggatgaaatcctgccactgagaaagaaaacccagtcaggaaagctttctcacccttatctatctaacaaattgtacatattctccaagttctgacttgaatgctggtgaagcttttcttgataatctcttctaccgcagcagagtagaaacactttgatcattcttctcaggactcaggattttaattatctgtttaatgcctttcccttccaccctagtgaactactcaagtgcaaataccttgtcttactcatctctgcacctcatagcccacactgtacctggcatatagagatgcttagtgaataattgcagaattaaatgaaagagtcaaggtgatgtgttgcagagtgaggagaacttgggctttgggctggcggaaggaggtgtcttcgtttacgttttttagattgaaattttgccatgtatatgcgtttaaaaatttaaaacctagttgaataaaaggttggggggggcagtatccaggggccaaatctatctattaataaaataaatttgaattttttaaaaaaatggcaattaaaactcatgttcatggaaaaaattaagttcttattttagtttttccctaaacgatcttgccgtatcacataacagcagtcttgtagtcaatcaagactgacttcaagtggtgaaatggaattttttaattccctgaagagagaaatctttacctagttaagctttgtgttatcttgatgtttttatttgtctagtgacctcttctgattgaaagagtagttaagaaaaaccctttagtactgactttttcaaatttaccgtaatgtaatgacctctttgaaaggagaagtacagagtgtatttttcataatgttacttaaattctgtagacatgaaactagatataaaacccttatgttcttggctcatacaccactataaaccaaatctgcaaattaaatacaaagacaactacaaaaaaaaacaaaattcaaatgaatacaattattccatgtgacagatgatgtttaggttttgcagtagaaaaaaatagctttaggtctaattccattttaaatgtgtttctgtattttaacttcagtgataataaaagctgtgagtagtgcctcttctcatcagtaatgttatgcaggagggcattaatgacttcaaggccttgttggtaagttcaggatgagacatcatacctaaccaaaacacttgacagcaagcattcctcaaatacaggcttataagttttactgagatgtcatccattttgttcattggaagataaggttaatatcttgacattattgaaatcttcattaaatgattttctaaaccagttattgctggaaatgagaatggaaaaacattgcatacctacaattatatttactgctaacaaatgtttgcaaattgtactacacatgtaggacccatatagcacttgcatataataaagtacatatatggtattggctgttaggctattggcttttgaatatgcatgccatgcctgtattgccatatggtcgattcaaattccctttattttttactctttcttttacaatgaccatgaaacttatgctgtgtgtagtgtgccacaaggacatttggcctgaaggggatcttcacacagctgaagaagcagcagtgaaagcctagtgccagtgttgagacagtggctactcatgatcttgaatgtttatccttgtttttagattatctttgaagtgaaaatatgttctcaaaccttgtacccaacttatacatcctttttttctcccagcatatttgggagacattgttttagcaaatatttttctgatcactatctaaggagccaggattcagagatgtgaaaaacaaaacaagcttggcccttcctgaggcaatgaaagaccctttaacagcaagctataaatagattgatttgtgctgttctaaaggtatgcaaagagcactatggaacatattgaaaggagataccaattattgtgaaggtaagggcgaggtttagagcacataatggcaaagatcctgttgaaatagggtcttaaaggatgagtcagataagaagataggtttaaactagacagagagatggtatatgtaaagaccaaggtcatgaaagacattattattataatggtgagaggtgtgtggccctagatagcatttgccatgtgagaagtaaattggaaccccaaactaaaagtcttgttaggctaggtgtttagcccttatctcatcagcataggggagccatggtgatctgagaactgggagagtattcagggcaatattttttatgtatagcggttaccacattgtattacagtgttctccttcacttgtcattggagctcttcaagtgctgtgaccattagttattaatctttgtgtgctaagcttttggtagagtaactgataaaagtaatgcttagaaaacatgggttgaatgactaatcatgagtaaagaggatttaggagagaattatgacaatgtccttcggtggtagttttaatgctttgtgggtcacagactccattgtgattgacttggaaagcttttccttgaaaatgtaaatacatataacatttggcttatagttttatgggattcatgtacctctgaagccagtccatgaattcctggttcagaattcctccttaggaaatcatacccagacagccatcaccatcacaccttgtcatgaataattactgtctcttttagcagtctttattacgattgtgtctctttcttgtcatttccttgagtttctttcatacttaggaagcaaatagctgacctgtctatgaataaagaaagcgtttttaataatgattaaggtaaaactttactggtctgtaaagataatagacaagtatgtgaattaagccagcaaccaagaaacagctacttgagggagaacctgacattcctgaatttgagttgagcaagtgagttgggagtctgcagggccatcctcagacttggtttgctagaaggactcacaggactcagaaaagctgttacagtcatggttatagtgtattacagcaaaaccatacagttaacatcagcaaaagcaaaaggcacccggggtgaagtctaggagaaatcagacacaggtttccaggtgtcccattccagtggcatagcatagatggccttaattctctcaacaacaatgtgtgacagcatgcacgaagttgtcaaccagggaagttcgcttgagccttggtgtccagggtttttactgttggtcagtcacttaggcttgcagcatctgcatgacaggcttcagcccctcagacttctcctacccggccccccagcagtaataggtgttcactgtaaatcacattgttagaataagctgtctgacaaaattggtaccatgtgacccaaggcctcaggcatacagaaatattcttatcagggagaatattccaaaggttcagagctcatctaccaggagccagccaaggccagttttgaagacaagtctttcttgggaatatgcagggtttgagcaactcagtcctgctgagttaaccctttcttgtacagcaagttagctcttcagggagttagctctgtctatcctgcccctgtctgcctagccactccttttctaggtagagtggaccttgctgttcacgtcatagatggccattccgtgtacctagactcctttttattcctttgccaacaagtaattggaatgtttggatttaagaacatgtctgtgctttgcaatttcatgtgaccatggtgaaattatgcacacattctatcattgtgattcaacaagtattttttgaatgctgctgtgcatgaggcatggtgttagatggcagattgacagaaatgactaatacaggtatctggcctcaaggagtttacagtttcataggagaaagaaaaacaaaactagcaattctggtaagcagtatgtgttttggagagcacttaacttcatcagagagcatggttgaaggtgtatctgtgtgtatgagaaggtgttggtgataattagaaggcttccctaaagaggtcactcctggggttgagccataaagatcaagtagatacaagtgggcatgaagctagtattttgctgccagtcatttctgtagttaggttgcctatgtggttggagcatgtatgtattgttacaggtgtagtctgcttggcttccctaagagaatgccccagtcctggccagaatatacatgtcttttttagggtttgcaccaaggggaatagagagtgtctggctcagtacaaatctgtttccgttactccattatccagaaagccactgaaatggcattagcctacacttaatgggtggtagtgttttcacacattgcttctcaaaggaggagtatgtgaatgtttagtttgggcctggtaaaaaaaaaaaaaaaaaaaaaaaagtataaccattacaaatttaaatgtactttgtttctaatgggaaggcaaatgcttgccttgctttgatgaaattgaacataacaaaatttttctatacttggaagcaaaaaacttcaggaaaaaacctgggtccaaatgttgctacatttccttgggcttccacgtgtatgtggttcttaatataatttgaaacttctaagagcaacaaatagttgttttttgcttctaagagcaacaaacagtgcatagaaattgtgtgataataggatcaagaatgtattattagagtgaatattggataatttcaaactgttaaccttgagattttttctaagaatctttctctttttccagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggtaagttgtataaaatttttttcctagatactacaagaaaaactcttcatactctgtgattttagaactggaagggatcataaaaattgtctaatccagctcattccgtttagaggcaagaagtgacttgtccattgttacagacttataagagtaaccaagatcctgcctcctgggtatgtgttgtttaagaaggtggttccagggtggacttcctctgaggtctgttatacctaaaaggatagataaaagcaaactctgacaaagcccacaacaacatcttcagattgtctctactttgttctcagagtgaatttcttcttccttgtataatgctcctatcttttaaagcaatcacagtcttttaatgagtggggattcagagcagcacttaacagtctagatgttttcattttgtaatttcagcttgttttatgatctttttgcgtaaattaattatacatgatttctagatttttggtccttcacctgtagtttacatttaaaatttcctggggctgggtgcggtggctcatgcctgtaatcccagcactttggaaggcctgaggtgggcagatcacttgaggccagaagttcaagaccagcctggccaacatggcaaaaccctatctctactaaaataacaaaaattagctgggcatggtggcacatgcttgtaatcccacctacttgggtggctgaggcacaacaatctttgaacctgggaggcagaggttgcagtgagccaagattgtgccactgcactccagcctgggtgacagagtgaggctctgtctaaaaaaaaaagataataaataaataaataaaatttcctggcagaaccagcagtttgaagacttcataaactttttaattttaagattccggtttaatatggaagtctgagcacatgtatttaactcttacctctttccccagatcccaaaggaatataaaaatgagggcaacctgtattaatgctagtgggattaatggtagaatgccacccacatgccagcacttgtgaggaacttctgcaatttacagtacagatgacaccagactagtaaagaattgactagccatataagaaaggttagtcatcgaaaagtccagccaataacttagacaaaggatttggggggtgaggttagggtatgggggcaaactctcagttcccttttaggaagcacctggcttcagtgctcagaggagcagacacagttgctcactctccactcaaagttggtccaggccttgtgctaattaaaggaggaagcactgctgtagcgcagaaggaaaaggccagtcctccacctgttcagcatgataatgcagctcccctgtggtaagggttggtcggactacaatatctttgtgactttgatgaaagcatctgcagttataatgtggcaaagaaaaggataattccagaatttcccatttccatcatttgagcttgaaatatctgaatagatatttacaaaaccttgtgaagaagtcaccttatttctcatgtttctaatgaacatatataaacttctcatttccagctctaggataagcaaacagcaaaaaattaccaatgaaaagttaggagttcaaaagaagtagtctgaactagatagattagatgtcatcctgtgaaataggtttaccacatgatagggaagaactttcaaacagtacagggtctattttcagttattcactatgaaatgagaacatttcacagttgttaaaggttgctttcagaagaaaagcccaactgatgaatgtttttaaaaatgcactattgagagcgaacaacagactggatgccataattttatagtcaagtttgggacaagttttaagaaactgtgttacaattcagagaaaagacagttggtgagcatattaagagatatagggaacagatttagatgatccaatatgcttattatcagaattccagaaaaaggcatgaaatcataaagaagacagaataccaggcaaaattaatgaaaaaatattaatccaaacacatataataaaaagtatcaatttcaagaataaaagaattatataagcatttaacacacataaacattggttacctgtaaaaggtgaaaaaaaaaaacaggttcagattttctgcttaaatatcaaagggcaaatggaacatttttacgatcacctaaaattcttgaaataggccaagatttttcatatacaaaggcaacagccttcttgccacaactaagttcagtgtacaagggtgcatggactcttcctgaaagaaattactagaaataggattctgtatgataagagattaatctactgaagatcttaagaatgggaaagatgtgatatgaaagaaatggtggtaagcagtaaaccagtaagactcaggatgaatgtcaaaataattgtaattttctgaaacaaccagaaaatcttaattattaatagaagttacaagaaaatgatctggacttaaaagtccaggaggttaagatagtataaaaagtatatatatgcaaactctgttaaaaaaaaaaagtaaaagatatgttctgcctttaaaaaattggtggacctattggccgggcatggctcatgcctgtaatcccagcactttgggaagccaaggtaggtggatcacttgaggttaggggttcgagaccagcctgagcaacatggtgaaaccccgtctctattaagatacaaaaattagccaggtgtggtggcacatgcctgtaatcccagctacttgggaggctcaggcaggagaatcgcttgaacccgggaggcggaggttgcagtgagccaacatcataccactgtactccagcctgggcaacaagagtgaaaatccatctcaaaaaaaaaaaaaattggtggagagatatatactgaaatgtgagttgtttagaagtgatgaagatgtatgtggttttttttttcgcttgttttgatattttgttgttttttttgttgttgtttttcttgctatgagcatgtactggccttggaacaagaagacaagccaaacattaaaaaaaatatgatttttaaggagatgttaataggtattgttacaggttattggtattagtgacctgatgtgataagtggggaaggtcctatgatattggcggcagttggccttgtaatgatggctgaagaatacaggagtaagtgggtgctgacagagctggtgtgcataaaaggaggcctagtgggagaagactgattcacttgttctgggtttgagccctgtaaactgctgtaatgaggctctttggctaagtggtggcagtggccagctgcaggaattgtgtaggattgggaaaatgggggttgccacctacagtgtttttgtcgttgttgatgtttatttcactcgaggccctttttcagtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtaacataattgtttctcctttttcctaagacatctttttaaaattaagcgatacttattttattagttttctaataagccaacttgctagaatgtgagatagtataaataatattgcaggtttgaacctaataaaaatctttaagcttgatgtatatatgactgtggctggtttaaaatagattggaacttaactttaactgttaaagcgaatcaataagtcagctccatggtggtataaatttcaaagcgttctcacttgtataatctaatttgcttttcatcactgtgaggtagaaaggataagaacaattattctcatatagatgaagctgaaggtcaaagatattcacatgatctgcagctaacccattctattcaggattgtttagcagcttgatgtttacatttgaaaacaggcatgacagaaatgtattcagaattgtgaaggttatttactttttaaacattatatgaaattgtctttcgtataggcctggttttttaaaattaaactaatgaactcttatgtcattttctcacttgagaaaaatgtctaaccaccttcttatttaatgtagttttggcccctaatgacgttttcttttctcagttctatttgttgatatttgtggcatcagaagtagatgagctaattgtcagagtcatcccaaggtggattttggcatagcagtgcttcatgtttaaactgaaagggggttatcttttactttttcttgcatgtggtttggaaaaatattaagagaggaacactcctatcccctgtgtttttagaatttgacacttggtgaagaataaatagatctaggtttcaaggcaagctttgtcattgattggctgtataaccttggttagaacatgtttcctctttgggcttctgtttcctcatcaaaaatatggaacccatactgttgataaaaacacttcaagtggtttgttaagacttttaaatgagatgtactatcctttgaaaagtatgagtcatcttcaaataagggctaaattcatgaataaagtgaaaatttgtaaagcgtatataatgaaaatttcactaattttggtgaaagcccatctctattaaaaatgcaaaaaaattagccgggcgtagtggcatgcgcctgtagtcccagctactcgggaggccgagacaggagaatcacctgaacctggggggtggaggttgcagttagctgagatcgcaccactgcactccagcctgggaaacagactccatctaaaaaaaaaaaaaaaaaaaaattttcactaattttataattgagtgatattaaaggaatgttaaagcagaagttgtgactgggtaagaatataattctgaagcataaaatcacatctaatgttgcagaaagctcatataatgacaaatgtctatttattttaaggaaatgaatatatattggtatgtatgcatatccattcatttaagaatgaagaaactgattttattacctgaattattcttctatagaatttggccatatgtattcaataagagagctctctccttgactactaggacacacacaggctcgcactggagctcacgtcccagaaggcaagcttagggattcctgaaacagttgtgcaaggaagacaatgagagtttggacttagatgaagcagtcttagtactgaaggtgtgatagtctttaggcaggcctggtggacagaggttattttagagctttcctgggacttcccatttattctcagttcagatcttcaaaaagattttgctcattctggaagtcatcctgctcaaaactgtgataatcaaggaccagagtcacagaaaatcaggatggctacagatatttggaattaatccctcaaacctgttctcttgtttctaaacttatactccggaaagacacagcactcatgccacttgccacagtggaataagcccacctaactgattaaaggaattggtgggtgggtggcagttgattactggataagaatatcttcattaaccttttaagatataaacatgagaaacaatggaataattctgtttccattatatatatatatatatatatatatatatatatatatatatatatatatatttctagatccatgagggaccatagctctctgttctctgaaagcttctctccctcctttgatgccttaccctgcaaaaacttgtctgcattgcttgctagctctgtggctttgggcagttaaccaatgtctcatgcttgagttatttcatctttaaaatgaaagtgatggattctgtgcacatcattggattgttgtgagttcaagcaagacaaaatgtttgcatgaaagcacttggtaaattgtagagttatgtccaaatgacaagtgttactcttattgaaaacatacttggaggaaaaatctaacatacagtatcagttgaccacattgtacaaaacttagtttaaggcctcctttgcctgtcatagttcattgtgtactgaattccctccaaacctatccaggcagaagccatcttctggtgaataatagcagaaaatgccatctgtttcccttctattcattataaatccttaatgccaccttaggcatgagactagtgcctgtgaataagtaaactgtgtgtttgtaatactctgtttttagttctttcattaattgaggaaaaggtataagcatttcacattctgaattcatatgtttattacttagtaccgtgaccataattaaggaaaggccctgtctctacctctaaagactgtgcttttaacttgggaacttcagggaatacaatgaagagctgggttctggcagctgtacgccaagtgtgtgagtgtgcacatgtgcatatgtgccagcttttgtaagtgagtcttctaggccagtgtttgttatggcgtgtgcagcttatgagctcttgtaatatatgcatgttgttcgggtcttatttcctgttcactgcatgtaaagctgtggagtccctgtttcccttttgaagttttctctcaaacagttctaaaggtacagaagagtagagcagagaatatagagatctaaattaggcctattcagttttgtctttagaagaaaattgttactttttttttttttttttttggagacggagtttcactctgttgcccaggctggagtgcagtggtgggatctcagctctctgcagccttcacctcccgggttcaagcaattctcctgcctcagcctcctgagtagctgggattacaggtgtgcaccaccatgcccagctaatttttgtatatttattagagaccaggtttcaccatgttggccaggctgatcttgaactcctgatctctagtgatccaaccacgtcggcctcctaaagtgctgggattagaggtgtgagtcactgtgcctggccaattgttaactttttaaaaatgctcaactattcatgtgaagtaatccaatatagataatacagtggatcaagatttgctttttaattttaattgacatctagaatccagtgataaaggggaagacaaaacctttcctcgtcctgttggcctttcttgaccataccatttacacaagtcctgaacctgtcaggtgttttcagaatttgtgtttgtgattcctttttcttttttattacttgtctttgcaatttccagattagtctcctgaaattaactcttaagtgtacttttaagtctgtggtgtggccctctacaaggctttcataaaatgtaataaattagtatctacactaaacaacataattagaattgattatacatagtgcgaaagagctctatgatttaaataaggatttctgacagatctgtttctaactagcagcctccttataaacacaaacagttatttatagttatactgctaactactttacaggaggtggggagggtagagcaagaggaagaaaggacccgtttgagaaacttaagaagaagagcttctgatcgctttaaagatttaacgtttggatttataagcatttcacatcagggaaccaaagagagcagataatttcatttactgtcattgggttaatttgatctagtaagcagctttgagtatagattataaatgacaccaatttatatgtacatagattgtataaataagatatgagtgaggaacatgatgtacactggcattttctttgttagtgtcaatgtaatttaaaatgacacttaccggatggtggataggatattaagtgatggtctcacatatagtgccacttaaatgttgcaggtaagttagtaaacccttttaaatgaagtaagtatggcaatacttaaaaatacatattttggagaaagccaagttccattagtggaaaaacagtgctccattaccaaggtaagttacttagccttgttcttcaagatactagtgttgtctatgtagccagttgtcagcaagtaaattgctttccttgaaatagtttctgtggtgatttttactgacttatcaaaaagccagaatttacttctgtgtttctgcgttcacatccttttttcctcccatcagtgaaactgttacgagattcatctttctaaaataagattttaaaattatcttgcttccagccatggccctttttctcagaaatctttaaaggttcctcttttacctaaagctcttcattggttattttgagcttggtattcagtactcttcatcttctggtgacagcttactttctcttttcactgctttgccacatatatcctctctctgattgcccaagctgcttccctaaaaatgtgtcattcatttccctctacctttgcctgcacattcttcctgcctaaccaccgtacttaagggatagtcaaaattcaacttacttttacaaagcctaccttgaccctctagcaggagtttctggattcttttattatatttattatcttattttccttttttaattagttattttattgcaaatataatatctccccagtgagataaattcctaaagggatagcttaaagtatcagttttctgggtcactcattagtgcctatcatgatgtttgaaacatgtaatattgttgattgtgttgagtactatttatttttacctttaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaaggtctgtaacatttgcttttccttatgttatatataacaagatctctttaagtctttacagatatggtgactaaccatcatcaaagtagatgagacatagatgtctctcatgtagattagacccattaagtcgaatacaatatattagtaacttttagaactaggaacttcttcaagattttcttgactcttgatagcattcctaaaatctcttaatgttttataaaatataaaagagctattttaaaaagccatgtactttgttggtttagtttagggcagttagttattgagagtactcatgatatagaaaagatatataaacttgctcaaaattttgagaatagggctcagatagctgtttccttttaatctcttcctgaccagtaggatgtttcaatatggactattgaccttattaatggggagagtaaaaataacttgtcagtgttctgagttgccaagggctaaatagatgaatcttctggcaaactcaaagagataaattgtttcttcaaccaccctggtaactgtacggacacttttctgcctatcatgctggtgcctgaggcccagtgtcaggtcagatgctgaagaaggaaggaagcctgtcagcagggagtcagaatgagtggggactgcaagcagtgaccttagactgtgctgctgccactttcttagcttccgttaatacctttatgcccatgattcctactttttttttttttgagatggaatctcgctctgtagccaggctggagtacagtggtgcaatctcggctcactgcagcttctgcctcctgggttcaagtggttctcctgcctcagcttctcgagtagctgggactacaggcgtgcaccaccatgcccagctaatgtttgtatttttagtagagatggggtttcaccatgttggccaggttggcctccatctcttgacctcgtgatccacccacctcaccctcccaaagtgctgggattacaggcatgagccactgtgcccagcccccacgattcctatttttactgcctctgtcagagacttgtgtttcagctccactcttgtcatccctacccctgaatcaaatgtatttcccagctttcctatttaaaaaaaaaaaaaaatgctgtcattatctcttagcttggccagacctgtagtcatctttttccttctcccaccttccatttacttcagcaatatttatttattcaaatattaacagtgtttaacctcagttggtaattatgggtgatttttattatttttcttttagcttctctgggttttcaaatttatttacaagcatgtactgcttttttttgttattgacttttatttgtagaaaatttccaatatgtagaaaagcagagtagttacagtgatccctcatcgtccagcttcaacagttgtcaggtcactgccaatcataattgatgtctgatcccacctactctgccctaactgtgttatttgaagctggtcccagacaatatgttttcatctgtaaacacttataaaatgtaatttgtatcttcaaatgatgaggaaatgtttttatgaaacaaccacactaccattgtcagttttttaaatgttatcaaatatccagttaggttcaattctataattgtctcctattaaaaaaattatttattcaaattatgattctaagtccacaagttatatttagttgatatttctcttatgtgtcttaaaatttaggtccccccttcatcttttttctcctctcgcagcttatttgttgaagaaattggattgtttatcctgaagggcctatcacattctggattttgctgattgcatttccatagtgtctcttaacttgttcttctatcttttctgaaaactggtagttagatttagaagctaaacctaattggagttttattggttttctcaaaatacatactaaggatattatatacatcctattgcatcatatgtggaggtgtatagtgtttgattaagacggggcagtgaggtatatgatgaatgtaggtagcgattatcagtggcacctgacaatgtaatacctcttaagttaaaaacaaaacaggccgggcacagtggctcacgcctgtaatcccagcactttgggaagccaaggtgggtggatcacgaggtcaagagttcaagaccagcctggctggccaagatgatgaaaccccatctctactaaaaatacaaaaaaattagccaggcatgatggcaggtgcctataatcccagctacttgggaagctaaggcagagaattgcttgaacctgggaggtggaggttgcagtcagagctgagatcgcaccactgcactccagcctgggcgacacagggagactctgtctcaaaaaaaaaacaacaacaaaacaaaacaaaacaaaaaatagtaatcagtctgaccaaatccttagttctcattttcgtttctgcctttatcaccatttatttcctcccccaactcttaaaacaaccttttctttatttactgtgtttgatgaccctagactttccttgttccttcttacttcttcatagttgtctttgttttctcaactcttactcttctcactggttcatatgaaggtactgattttataagtggtaatttcttccttaagaacatagccacattcatggtttcaaactctaccatgttggcaactctcaaatctccatttgaaagcttaaacctcacccagggtctggattttgtcacattccaagttacaaacacagcagcacaaaatgttggtgagtctgtgccctgaacttctaaccaggctgatgctgtcatctggtggtcaccatgggaactagctgaccctactggctcttccctactccccttctttcttctttgtcaggggttaatgtactttctctgagcctagcccctccacctcagttcctttatcttctcctgatttagttaattccacccccggcagccctttatatttatggccccttacatataaccttccttctatcttgtccataacctgtggtttccctttcttccatctgcctgtcttccactttgtttcttgtatttgtgagcttttcaaaattcagtaatggttaagaggcatgcaaataagctagtgatgtgcctatatcaaggaaaagcaagggtgcgagtttggtcagaatcagtttataaagttcatgaagaacaaattaatactaagtccttttaaatgtacccagaaatctcctccagaatcttctgaaaagtttctattcctttcttaatctcttctaatcagagttggttttcttcttcaaccaaataccttcaaaatagaagctgtttcatgtcaatatggattttttcttttggtttacaaccagcagggaaagaaagagcacagtttatgtacttcttacctaaagaatctagcattccgttttttaaatcttaacagtcttacaaagtaagactttattcttgtataaaaggagaaacaggctccttgtcagtaacaggcaggccgtggattccaaccaggttagaatgactctaagcgtccatcttttactggattgtgctgtctcctaatgttgtaatgctttttttcttcatggcttaattaagcatgtggttttccagctacttctaggttaaattagattgtcgtggaccagtctagcttaggagcctagctagtgtctttaccattattcctatgagaaaacatgttttaaactcgtgttttggcttacagaggaaattttggaacccacgttcctcgttgtttgagtttagtcccagcttttccagttttgctcctgacatttcagttcctatttcagcttccccatgtgttagaggtatcactatttctgtttttctaagctagcaaccttggaatcataatcatcttgtcttgcgtctttgtgaactgtgtacacaatctgtcactaaagcttgtcatttcttgttgaaactcactttcagttttgtcccatactcttccattcccactgtggccacactggtctccggagacttctcacctccttgcttccctctctgttccttccttttttttaaccttctctccttccaggaacagccactgagcacccaacccgacccagagatttttctaggcacttaagagtgccagctctgataccaattatctgtgaagactcaaaaaagtcaccatctttgtctcttaaatgggattaattatacttgccttatctcaagaagaggggcttactctgaggaactaaaggatgtgtacataaaagtataaaacaaacaatgtagaagaaaatgtgaaggaaatacagacttaaggtggcattatattgcagtgtgtgactcaggattgagagtaaaaagtaataaccattgaacaaataaatcataaatggtctgcagcccaaccgaaatgttaattctgttttacagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggtaattctataagcagttctattatttaagctttaaattttcatgaataatgtctatgaaaatagaaggtggaggctgggcctggtggctcatgcctataatcccagcactttgggaggctgaggtgggcagatcgcccgatctcaggagttcatggccagcctgggcaacatgacaaaaccgcatctctaccaacatacaaaaaattagtcgggcatggtggcatgcacctgtagtcccagctactcagggggctgaggtaggaggattacctgagcctgggaggtcgaagctgcagtgagcagacatcatgccactgcactcccagctgagtaatagagagagaccctgtctcagaaaaaaaaacaaaaacaaaaacagtaggtggcctaactggagatatttaaaacaaattttttagatgagaacattttatctttcagttcaaaatttcaggtagagctaggaatctggaaatttgtttagagattctctagtcgttgtaacaaaactgtgattttttttgagttcttaaaagtagcattcaatcttatgatttttgaggatctcagtttcagaattcaggtccaactgaatatatttttatgtgtagtatcaaatgaaatgtgaaagtgctttgtaaacatcaacatgctaggtaactgttatctggccatctaataattatatttgaccttgagataaggagactgcatgagatagttttacagttgaaaaattaaatactaagttttagttatgacatttgtatgctgtagtttttgtgcatgtgggatttcagatgccagtatatctctctgctctagcagttgtccacttgcaacccaatggctcccccactccccactttacatacagcataagtgctagttcacatcttagctccatctttgtagttattattattattgattgtaacagttttattgagttataattcacatcataaagttcacccacttaaagtgtaaaattcagtggtttttagaatactcagagttgtacagccagcaaacactacagtcaattttagaatatcttcactccaaagagaaaccctgtagccactagcagtcactcccctttcctcccaaactccttagccctaggcaacaactgctcctttttgtctgtagatttgcttattctgcacattttatataaatgaatcatacaatatgtggtcttttgtgactggcttctttcacttagcatgttttcaaggttcatttatgttgtagcacgtatgagtacttcagtcattttgatggctaagtaatacttcagtgtatggatatggcatatgtcatatatccgttcgttgatggacatttggtttgtttcttttggccattgtagctaatgctgcagtgaacatttgtgtacaagttgtatgtagtttcatgttttcagttatcttgggtatatacctaggagttgaattactgtatcatatgataactctatttaatggtttgaagaactgccatactattttcttaaagtgcctgaaccattttacattcctgccagcagtgtatgaaggttccaggttttccacattataattattattttttaataacattttctagtggttagcatcaaagataatatacttaatactgagtacattgcagttgatagggaagtgatgttctacatgcttggttcctgggctgctggaatatcagtctatggctaagtttcttaaaaagaattcataaggcaccaacagataaactgataactttttttttgccccagtctttgagttgttcatcttttaaagcatgttattgtccacattttctttaaagaaatataaattcagtgacttttggtgtagtgattcacttgagtttaataatgccgtaagtattgtaggtcatgtgggctgaaatgctttgataatttgggttgggagaagagacttttgaacctaaagatgtgagttgtgattggtattaccttttaagcagtcatgtttaatttttgattctttaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtatacttttgaacaactatatttaatatcttctgaaatcaccttttttcccttctctttcatatatacatatcattgctgaaactcagcttaaacttgcactttattagattgccaacaggtaagaagatctcatggtcttgcctgctctgaagccagagttacctgacttaaaaagatgcctgctgatgaaaggttgcccttccagaaaatatcattaggcatgttaattataataacagtagtaactaacgtttatagggcacctactatgtgccaatcgtctaataggtcttttacgtatattacctcatttaatcccttctcaaatactgtgcagtagctagccctgctattttcatatttcagttcctaaaaatatgcctttcttgctttcttagaacttttgcacatgctgtctcctggagcatactttaccctactgtttctcagcctcatacccacctttcccgtaggaagttttttctagtcctcaaaaatcttaggagtccctgccagggactgtcatagcacactgaactgggaccgttgaggcacttatgcgttatgttgtaactgtttatttatttgcctatatattctattaggtgcaagctgcttgagagcagccttgtattcccagcatccatcacagtgcctaatacatggtagatcctcagtagatatttgttgagtccatgagtcttcaaaagaacttaattaggtaggtgttattaccctttaattcacagatgaggaaaccaccttgaggaggttaaataatatggccagcttcatgtggatgataagccgaagagctgagatttgaacctgggcatttctgacccaaaccccttatcacaagctgtcacagcattttttcaaactactgtcttggccttggagacagctggagagccagcagcattagtctattcaaattgcatgtataattttgagatttctggattccctggggactctcaattttcccatccaagtactaagcaggcccgaccctgcttagcttccaagatcagacgagatcgggcgtgtttagggtggtatggccgtagatgactctcaattctcaaccagctaaggggtccttgtcagtggttgctgtaggtctctgtgggtcctgacccataattttggtaggtttttgaagcttcagtatgaggactggcattcttttgtatctattatttttttccctggagtatattcgtgcccttcctttcatcctcagtgagaagacttctaaattaaaatgcatggtttctacctagtacgtgtataggtggtgtacattaggacacctttaacagtcacaattgttatgtatgtctttcattggaaaccaagatcatgaggcagatagtgtgaaactgctattttagcattttgtgggatttagttgacatcattaatgtgcaaaccagtgtggatatttaatatttttcttgagtctaatatttgttatgtaatattgtgtacatatgtctatgtataaagaaatgtctgaaaggaggttcatccaaatatggcagtaaggggatgattttcaaagttctttttgcaaattttttttaggtacatggcccctgaagttctcgatgattccataaatatgaaacattttgaatccttcaaacgtgctgacatctatgcaatgggcttagtattctgggaaattgctcgacgatgttccattggtggtaaattgctctcctctcccccagtagtttgtcatgagcagaagttgttcaagaattgtcttctttttttaattgaatgaaattatgtacagtccattatctgaaacaggatgtcaccgagtgccagagaaaacaaaggcgatgaaacctttgggaggggacagtgccatggtgtgcacatgcacagctctagcctagtgtattctcttcctgtttccatttgaatctggagactcatcagaacccaaccccttgttatattggaatatagttctttagaatggacagctgcttgagaggctcacctaggaagctgtttctagcatgtacctgggtgtcaaacttattttttttctttgagattgtggttattttctccaacttgatagttacagttacatacacagaatacaattatgttaccattgtgttgtattctagagttagtttgttttaacttctagctttttagatggagtacttttaatgtttactcaggaaacagtctcttaggcttggggacctagacttggctgagacctagtgccttaggtttttgaagcagtgagggacagagtatttctctgtattgtagtaaataggatatattattgacagatgcaagtagagaaagggacttggcaccttaaacttgcctcataagattcaagtctcactgatagggtatatatatccctgtgcaagtgagagcctgtgcacttacagaatagaatctcatttgctgcacaatagggttctaggggaaaatgtcaatctggtcatcacagctcatagtttactgtcatttcaaataggctttattgatctcatggcaatacttagtttcaaggtgtgggtggaatatcaactcagggaagtggcttgtggatacagatgtggatgagatagagaaagctgtaatctctgttccacatacctactttagtaatgaaacactgtaataggtctctcaggtgatcttttaatgccttggcattagctgaataaattcatcaaaatttaattttttttaaactgatacaggaattcatgaagattaccaactgccttattatgatcttgtaccttctgacccatcagttgaagaaatgagaaaagttgtttgtgaacagaagttaaggccaaatatcccaaacagatggcagagctgtgaagtgagtatttctttttgatattaggcaattttctaaactgcttctgcttagtaagcaaaagtttgctacttttctttaaggaaaacttttctttaagaattttctttttcatagcagtcaaaccaatgtttaaaaacagaataatttggttttcatattcaattgtaagcacattgaaagggccatggaacatttgcagtggcctttagtgtatcagaacatagtttagatctgccgggcgaactaaggcacatatttttaaatgaatgcctcccttcagccggggcaacccagaacactagacagttaccggacatgaatgaggagccctgtattctagaccagcctggctaccatttcaagggtctgactctgaacaaatccctttagttctctggactttaatatccctttgcaaggtgaggaactcagataaggtgattacaaaggtgtttcaaatgattttccgttttattcatctgattgcccagataaccgttaaccaggaatttagggaaaatgcttttttccagcagtatctgagctgctcaacttcagctctaacaaaaagttttagaaacgtttttgtaattgtaaatttaaagattcgtaagatgaattttatttaacctctccttaattgctagctgttactattacaatattggtgaagcagagcatattcctccaggtttgaagatttgtagcttaaaaaggctataaaaagctgttcagttcagtagttgattttacgtcttaaactattgtaggactcagcagaacctctgataagcaagagagcttgctacctccaacaaaatcacatctccaggcccaaataaataaaatgtatttcagcatgcttaaggaatttgcatgtgacatagtttaataaatgagagtgctgctagattttgtcttttagaaatttgatctacttgggaggctgaagtgggaggattgctggagcctgggaggtcaaggctgcagtgagctgagggcatgccattgcattccactttgggcggcagagtgagaccctgtctcaaaaaaaaaaaaaagaaagaaaaatttgatgtgaatacttcaaagtacaaacttaaaatttcagtgtgaggtcagatttcttctttgctttgcccagctctggtttaggattcggccttttcaggtttgctaaatgagtcactctttgtccacctgctttccagcactggcaccagtaccctattgatggaaatttatgtaatttctactcatttgctattacaaataatgcttaaacaataacaagtgtatatgtcatttaaaaagaaaatttacacgtaaaaattcttatccagaccaatggaaaatggtgcatgcattaatttttttttttatattttcttgtaggccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaa

SEQ ID NO: 125 - DNA, 97505 bp, Homo sapiens
ccctctcctcccctcccctcccctctcttcccctaccctcccgcgcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggtaaagcctgggcgcccgcgggcctccagctagggaagtgtttgcgtgcgtccgcggccggggcgatgggccgtgtcacatggccgctgcgggtgggggctggggtgtggtgagttcgggggctgtgggtgcgccggcccgggcgtgcgggttcggggccggagagccgggaagggacggggctcggttgcactgcgctgccgcccaggctgacgggggcgggggctgcctgcgtcccttcccctcgctgctctcacactccatagtttgtggttctgatttttaaagccgaagggccagagctcttgtttcaggagttgtggggaagccttgttagggacgcgtaatactttgcctccactttttttttttggtctcgtaacctttgttaacagtggtagtctcgggttttccatggcttgtgtgtactcacaaacacgcacacagctgataactctgtgatcatccttcactcacttgtgaaagttgttctgcgggtggagcctattagtttttatcacacgcctttggaaagccctcgaagtgatttctcgtatttcaaacttggtttttaaaattgcaacttactttgttctcttggagggggatattgtctttgggtcaggtacttttgtcttttacttatccttaaaatgtccttttgatcctaaacagaaaaagaatgcctgggttggttttgttattcctttctcttgaccctttaaaagcaaaataccaccagtgtgttgtcaaccatacctttaaaaaagaaatttccaggtaaaacgaatttgcaagcagcattttccatcaaagtcatgtcttgtttgttgcaatttggactatcttaaatttgggtttgtgaaacttttaaaacgacatgtgtaaaataattgttaataaataaataacttggaataattacatctttttagaaatggtctttgaaatgtgatttaatttccaaaattctttttctctcttctgacttcatatgaattgaacctgatagtttcgtatgaatgaatcgctgataggatgttttccttgagcctagtaataaatttgctcttattatgctgaaaatttgctattctactttaacaccctttaaaaagtttccatcttacagagaagttagtcaaatagttaaatggagtttcaacagttttaatacatgaattagtgaagcagatgaagcagagatgggagaagtaatttaaaatgggcttcataaatgtaccatagtttgagggtatttaaaaaatttgccttcggaaaacccatacaagatatttaaagaatttcctctgccagaaggtcatttagcaaacgtttatattaaattcaaaagtaatacttttatttttaaagttccttagccgttgccgtaaacttagctgtcgtagtaaatataaatagttcacatctttcggcatttctaaagagtgtgcccacttttactataaatattaaactctgctggatttaattgagttcaaggctgttcactggccaggtttaattaatgtaatgtgattggaaacgttcattttggggttttagtaagaaattgctcttagagcttggtttttatacttagccacaccttctaaagtgcggccacaagcattgtaggtgttcaacaaaagtttgggttttcaaggttgtaacctacgtttacttagtcataagtggtcatgtctctacacagtctgtaagtttcatgaaataatagtcttttaagaaactgtgcagggtaatttcctgttgtttgtgtcttatcaggcttggtatgtgttttaactcttgtgtaggaatattggggatggttttggtatttcaacagaactttagtaggaacaaaggttgtttctattctacttcaagatggccagaggttgttgtccccttttcattttcacattgtaaatattagaatcatgttgctataatctttacttcacatttgggggaatatatgtcaatggaaaaactcggtttagctgtgtaaaccgctggccaaagacctattgaatttttacattttgcaaatactgtcagttttaaaagtctttccttgttcttgtttggttttgattctgttggttttgtgctttagggctccaaaaacctcgttttgtagcagcttttttatacaggtgtttttgtaatgcatataaaagctgtatttagtgcagtctggcagatggagatttattcatattcttaggacaaagagtcatttttagagggtagaggggggcatgtcttttagattcttagtcttttgatgggtgtagaagagccatttttaggcccttagtttctgtgagaggtaagatgttttcccctaagtattccaaaggtatgtcagaaaatgtgaaacgtaaggaattcacaaccagttaagagaggttatgagagattatgcatttatatattttattttattttattttgagacggagttcactcttgttgcccaggctggagtgcaatggcacgatctcggctcaccgcaacctccgcctcctgggttcaagcgcttctcctgcctcagcctcctgagtagctgggattacaggcatgcgccaccatgcctggctgattttgtatttttagtagagacggggtttcaccatgttggtcaggctggtctcgaactcccgacctcaggtgatccgcccacctcggcctcccaaagtgctgggattacaggcgtgagtcaccgcgcctggccgatgcatttattttcaacaaatacatttattcatttattcaacaaacagctttttctgtgtgtcaggctctggactaggcaataaagtctcttaacagcaaacaagtacacccctgttccttaatggagttagaaaagtggaaactcatgtcccttgccctattctccagtgtttagagtaagacagttgttagtgtacaaatcaagggcacatgcattactgagccattcctaaagtgagcttgccttgcttcctgtaacatgtagcagatagcactagggaagatgtgaagtgttactcagtgtcactgggaacaatctgtgtattttggggggaccttggcaccagttttgcacagtctatacaaactgaagatacggccagtctttcagaaacatgtttattgctgaacagatgtacacttgtagagctaagcttcatctgaccttaatttgatcacttattgccctttaattacagaagctggttaaggaaagaaagcagagttgaataactcagtgaaaggatcgggaatagtgtaaaaagttagttaaaccgagacccaggattggacagcagtctcatgtagtggaaaggccttgggttttggaatcagagagccctagcctaatattttgtttctcagttacaatactgggcaatttactaccaaccccaggcccttggttttctgacacaaaatggaagtactaaccccttcctcttattcagtgatcacaattcaagtacctagaacattgcctgagatataagggtcctcccaaatgatttcttcctctcttgtagttgtgggtttgttacttgggctctttctaatccaaatgatttgcctacactgttattatggacctattgtaaaatgtatttgagaagcagacaatgaacaacaaaggcctgggatagccaaattgtcccagtccatagcttaaagcttaggagagccttggagacccttaataagaatgtgttggcatttatttaaagtgtttctaacaagcaaagttatctggcttctaaacctgcactagattagaaacaagtagattatgggtactgtgggaggcttagagggggtgtggtgggggctggggagtaggatgttagcctagtgtctcttgtcagaaaaaacagataacagctcggtgaggataatagagataatctacaagacacaaaaatagtcaaagcctgactagcatgtctggggccattgagtgcaggaccagacctgaaagcatagtaatgaatgttcatcaattagcctaaatcatgtttgggaaaatctttttaagagtgcaataatctacgtaatatactttagattgtcactcaggatgattaagaaatgttcttaaaggggttgaagattgtgctatagcttatggcttatttcatgaaagatcacagtagctgttatgaccaagatgtttttcatttgttttgccattcagacagccattcagattccaagctgaaagggtagccagcagtaaagaaaggctgtttcagtgtggtagcaccctatgtcacccctttctttggtgtaagtaatttttttgtcagtctgcaggagtatcatataaattttcacttgtgctttgacagtagtgtatgcttttcactgtgttttgagatagagtatgctcgagatttctaggataaagcaagagtggatagttggccagtctctctgttgagggtttcttgactcttgtcatgtgacttctgcccagtattagcactgataatttttttgatcccctttcttgtaaccttacctcagggttacttcttaaaccatctacaccatcagataattattggtgaccttgtaatatgtagccttggctgtttttaagaatcaggtttttttttagcagtagtacaaaagtactagcctttttggtttaaaaatgcatagttagaggcttattgcttgtcattgatcaattttgatcattttttcaggttggtgtaattgtgatgtattcagttaggacataattcaatgttgattctagatttacatctcaaagatagctcgcagcttcagttcagcaatttcatgtagggagaatataatttttccaagccaggtggatttagacactgcctttagtttggtcagatagccagaaatattagggcaattctgtgtcttctgtgcttgcctcacattgtacagtgtgagtggttctccttggctcagtgggttcctcttatttgtaactgaggcacattgataggacaggtgcttgatgtatctttaggtttgtagtcttaagaaaatagaaattctgacgtgattaattcttatcaaagtttgtgaatttactgtgaaattgtcactaattatcctaggtagccctgtcatttttcaaaatctggttttacattggcctcaaggctgtagagtagtggaaagcgaggatagactttagttgcttctgtttagtacacgtgtctaccttaatgtaaaaatttgcatttccttgaataatctacagtgtcataccttccctcattttgtggggaagggggatgtagtttcacatttaatgtattcagtaggaataatcttgggtgaaccactggtattccatctgttcattagtttgagtctcttaagtcaaaaaagactcttgatctgaggaagtagcatagtgaatctgtgatcttatagtttgcctatgtttaaaagtaaactacattttcatatgctgcttcagctacttccagaaattctgtagagacataatggttaaggtcttgtaaatatcaaggaaacgttccatcctcatcacgtctttcatttcagaatgtgaggtggtgaggccggaggcagtggctcacgcctgtaatcccagcactttgggaggctgaggcgggcggatcactttgaggtcaggagtttgagaccagcctggccaacatggtgaaaccttgtctctactaaaaatgcaaaaattagctgggtgtggtggcgggtacctgtagtcccagctgctcaagaggctgaggtaggagacttgcttgaaccggggaggccgaggttgcagttagccgagatcccgcgactgctctccagcctgggagacagagcaagactccgtctcaaaaaaaaaaaagaaaaaaaagaaaatgtggggtggcaaatcttttttgcagagcctcctatataaaatcctcataaatgatgcagtggaagctgggcccgtgagccttctgccttgacttgagtgaactattgaaactcttttgttgactagagatactttatctgtggtagtaaatgtaaattttccttattgagatccacttttaaaattctttttttttttttttttgagacggagttttgctcctgttgcccaggctggagtgcagtggtgcgatcttggctcactgcaacctccgcctcctaggttcaagcagttctcctgcctcagcctcctgagtagctaggattacaggcatgcgccaccatgtccggctaattttgtatttttaatagaaacggggtttcaccatgttggtcaggctggtctcgaactcctgacctcaggtgattcgcccaccttggcctcccaaagtgttgggattacatgcgtgagccactgcgcccggcctaaaattcttaatagacaggtagttaggttgtagttcatgttagctgatcaattaaacttttttttaaaaaatgttttagttatcaggagggtccagctttggcctgaggttgtgcattggccatttctgctcgaaaccagtagtagtcagacttaaaacatgtgcacacctgcacacacagcagcaactagaaagcctttagagagaaatatgcagaatttcgaaatgtaaaacagataaaaggagtaaagctgttttgtggaaggaagaataggcagttgttgaagtcctgcctgatcagttttcctctcatcctcaccaccaggaagcctttgaagcacagctgaagaacagtaggtcttggagaaatttttgctgtagacctgctctatcttaacaggtagctgccagccacatgtggctatttagcacttgaaatgtggctgctgtgactgagaaactgaatgttaaattttacttaatctaaatttagatagccatatgcagctgatggctactgtattagacagcacagatacccaaggacatttacatcattgtataaagttgtgttgggtggcactactctagactttgctttaattgagcttttatggcctgaggaccccactcacgtgaattgacgtggtattagttgctgcttcagaagagggtcaggatagactttgggaatttgaagagcaattagagtacttgtactttatatttgtgctgatttgagtctgggcctgtgtagtgttgtcataggtgctttttttttttttttaataatctgggaatgataaaccaatatgtaagttacgtgtttacaagttgattatagagttgtggattccacaaaactcattataggtgataggaatataactcttagttaaaaaaaaaaaaataagtagtctctttacacagcagtccctatttaatgtggacttttgctaaaataataattttcttgaattaaattcaagcttgcattaggtttgacagtccataaagttgaacacatgaatgttttctgtttgcttttgtttaaaagacatgacccatcattctccatgggggccgacctaggtttccagttggcagtgtctttccttactagcttacgctttggagagaacatagttgtagtgagaattgaaaaatctgtttttaaaaaattgggttttatgtattttaatttttttgaggttttctattatcctggttactaatgaattatttatttgactaaaacagttatacaattccaggtcattgatgctgctgtttttttctctgccttgtagtatgtttgaacatagattgctaaaaatctcggtctccacagaggattggttccgggactctcctgcaagcaccagaatatgagaacgctgaagtcccttgtataaaatggtgtagaatttgttttatgcacattttattgttattctttaaatcctctctagattacttaatatctaatacaatgtaaatagttgttattctatattgttttagaaatgatgagaaaaaagtctgtacatgttcagtacagtcacagttttttcctgaatattttttatccatggttggtttaatccatgtatttggaacccacagataaggaggattgactgcacagtgattttatattatttctagtgggaccttagatgttctagatgaggcagcaccatcatatttaaagtatttttgttgaaataattaactttggttttctttctaaataaaaattcacataggtatttggggaatattttgtattttcctgcagtttgaagatttgaaatttctcttccctccataccttttaaaagtgcaatctacttttgctttctacatttaatcactatctgttcttgacttcaactttgcaaacatattttttaaccattctttttcacatttcccttcctactggccttccggatgaactgtcaagtttagcagtcttttctcagtgatcatactttcttcagtgtttgctgttattgtttatactgtctttatctaaatttcttaaaatgacacagacacaagttaggcccattcttcttactgtaaacagatgaaaatgttggataaaatataaaagttttctcttatgtatacagttgatcttgagagagaaagtgcccaggtactagaaacttagaaaaatcagtcaactttaagggaagtgtggccttgggggatttactagagataagattcagtagttggggctgaggttataatgccattcaatgaaaggagacagaactgtgggaactgtgtgcttaaaaaaattaaaaaatgaaaagtgttctggtatcattgaaacatctggggcttcttggagaaagaagcctcagacctctctatggaggaactggaaaaacagtaggctttagatggactttaatatcacagcaaggcaaggcagggtacatgaaaacatctacagctgcatgtggaatagtgaatttttgtatacataatccatgactgcaatccaaaattcagggatacccagtgaagagtctctttactggtctgttctttgccatacagttgccttttcaaaggcaagtagctttactaggtttttgtgtggtgttccagagattttatgcatctatgaacaattttgtgtgtatattaccttttagtacaagtggtcacatatgtcacttaatagtacatcttattttgtgtcagtatgtaatgaatgcctttcttcttttttggagtagtgggttgtataatattcttttgtatgggtgtctgtaaatttttttttgagacagtgtctcactctgtcacccaggctggagtgcagtggtgtgatcacagctcactgcaaccttgactgccaggggtcaagttaatctcccacctcagctacctgagtagttgggactgcaggcgcatgcctaccatatccagctaatttttaaaattttttgtagaggtggggtttcgccatgttgcctagatttgtcttgaactcctgggctcaagcgatttgcctgccacggcccctcaaagttttgggattacaggcgtaagccactgtgcctggccgggtgtctgaatatatcatcagtcctctgttgaatgtttccagtcttgtggtattaaaaacaatgctacaacaaataacttcgtttatatagcattttgctcctttgcaggtatgtctgtaagatagatttctaggagtagttcaaagaatatctacatttgtaatttattttagagaatgtactttattcattttttcgaataacacatgcacatggtataaaagtcaaggagaacaaaatagcaaatactgaaaaaagtaagcctcctttacatctcctacctcctgctgcccagttgtgctttccagaaatgtaaccactgttactagcttttcgtttatccttctagagttgctctgtccagtatgatagccactagccaccatgtggctattgagctcttgaaattgagatggaccacaagcataaaatacacaccaattttctaacagtacaaaaacagaatgttaaatatttcaatggtttttaatacggattgcgaattgaaatagtattttggatatattgggttagattaataaaattattaaattatgatttcatcttgtaattcccgctgtgatggcatcaggaaatgggatctttgggagatattgaggtcaggagggtagagccctcatgaatgggattagtgcctttataaaagagaccgttgttagcattctgtcctccatgtgtagatacctgaaaaaagcggcagtctgcaacccagaagagggccttacttggaacctaaccatgctggtaccctgatctcggacttgcagcctccggaactgtgagaaataaatttctgttgtttataagccacctagtctgtagtactttgttataccgtcctgaactgactaaagcacaccaatttttacttttttaatgtggctgatagaaaatttaacaatatgtggtttgcatcctgtttctgttggatagcactggtctaaagaaatccatacatatataaacatgtactaacataagaattccacttaggcaaaatttttttcttttgcgttgtaatctttggaatcagaaatctgctgagatattggtaaagagtggtacaaagctgttctttatggccccatcagtcacccccatccatttatcatttggctctaatcagtgaaggttatgcttccattgacttctacagtgttcactttggagagaaggctgccgttgttttggcttcgtcttttttagcttgctccgatttgcactggttgcctctacacctagtacgccgcagtcattctgagatttccccctcactagcatattagggattgccttcattttttcttctttgttagatctcctattctttgtgtgtgtgtgtgtgtgtgtgtgtgtgtgtgtgtgtgtgtgtgtgtgtgtatttttttttttgagacaaggtcacactctgttgtctagttggagtgtagtagggtgatcatggctcactgcagccttgcactcctgggttcgagtgtagatcgtattcctttttgttttactagtatctccttttgatgagacatattcttcaggaccttcctggagagtgtgttgggggtggggcggtaaatacttggagatgttgcatgtctgaaaatgcctttgttctggctaacataagtctaggttggaaatttttttttgaaaaattatgaagcccagaattacgaagccattgctctcttgactttgtttacagtatactgttgacaaaaccaaagccattttgattgttttctatataacctattttttttcctccttggaaactttaagccctttctttgtctttggcattctggttttgctaccatgggccttcatgtaggtttgttttcatctgttttactggggtcttgatgggccctttccatctagaaactcccatctttcagttcaggggctttttcttaatttatctatttgactcccctactctgcatctctgtttggaactgttgttgggacattggacctctggaaccagtcttccaatttttttcattttctctactgtttcccatctttcttttctactttctggaagatttcttctactttatcttctagcacttctattgatttttttcccccgtttctgctgtcaagctatgcaagagctgttaagttctctgaatgctgcctttgagagcatgctgctctttcttcagggttgctcagtcttatttctctggccatgttgatgttttaaaaatgttttctttctctgtatagtcttttcctgaagctgaatttttctggttttgtttgacgtttttcctcagataaagtaattcttaagaagtggggatctaaaaagctgatcaaaaactcaacatgtgggtgaaacttgtctcctttcagtttcactggagagggatctgagcaggcaggctgtttgttggtaaactcccaatattagcatctatatgcctttcctcctgggtcggtcaggtaccctagtgaagtcttttgatctgaataactgggcggaggtctggctgctagtatttgggagccaaaacccagtggaggaaggggtttgggagtcgacatttaacacagcgtgctcatgttcattcacaccctcttttcttcctacttatacccaggccatctcctagtccagggattttgttttcccctttgcagaaagtaaacgttgaggcagaggattagttatccagagacagtaggggcggaaatctaagaactgaattcctttctacaaagctcttaacaagtgctacctattattccttcccctgcctggccctcagttcctgccgtgacttgctgttggttccttaactttttgaggtttctgtgttaatcaatggttttcagcttttcctacagctagcctagagttagtagtttctgatctgttcaattactgctcacccattttccagccattaaaattttgcttctgttttctccttacctcttctccctatcctcatgaggtttctggtttttaaaaattcccttggttaggcgtggtggctcatgcctgtaatcctagcactttgggaggctgaggcaggaggattggttgagtccaggagttcaagcctagacaacatagggagaacccatatcttaaaaaaaaaattctttatggttttcaataggctgttttcatctacaatgcaatgatgagttaaagttttccattaaaaatttttttaccaataactctccaaaagaattgaaatagaataacgtataactccaagtcagtggggatgaggggtggaaataaagagaaattgatcactccagtataaggcagggaagaagaaaaaagaaaagaaaaatgcataggtattagaaaacacaaaataagatggtagaaaataagctgaaatatctccataaacccaatatgtaatctcagattaaacttgctggctaaaggagaacaaaaatttaaaaaatccaaccaactgtattttacaagtggagatactcctaaaagtatgatgacatagtttaaaagcaaaggaatggaaaagatatactaggtgtaatttataaggtaaaattggaagaattacaggtataaatcaaatctataatcgtagtagaaaattttaatatacctctcagtaatttatgaaagggtagatttaaaaaactacaaggttatgaaggattggaagagtacaattagcaagcacccaacaattacagaagatacattctgtaaggggaatcgcttgaacccaggaggcagaggttgcagtgagccgagatcataccactgcactccaggctgggcgacagagcgagactccgtctcaacaacgacaacaaaaatagtgtcagcgagactctgtctcaacaacgacaacaacaaaaatagtgtctttgatttagtgcatgtaactaagttgaaaagagtgccaagactgatagaggagaaaaagaatgtacaaatgtattggaaatgaagggatggtataactgcagacaaactgagattttaaaactgcaagaatactgtgaacagttttatttctttaaatttggaaacaggtaaagtggacaatttctagcaaaacaaattaccaagttggcttaataagaattagaaacttcactagattatgatttaaaaacttagtcatgtttagaaatatacctataccaggcggggcatggtggctaccactttgggaggccaaggtgggcgatcacttgaagtcagcagtttgagaccagcctggccaacatggtgaagccctatctctatcaaaaatacaaaaattagccaagcatggttgcagtcgcctgtaatcccagctaatcaggtggctgaggcagagcccaggagacagaggttgcagtgagacaagatcgtgccactgcactccagcctgggcgacagagtgagactctgtctcaaaacaaaacaaaacaaaacaaaataaataaataaatatacctgtaccaatgtaaaattttaagtcctcaagcaaaacaccagactacaaatgaagaccccgtatgggcaagtgcaaccaaacgtgagggattaactctaatcttatacaaaatgttacagaaaaattattttgcaaggctactataatcttgataccccaaccagatagtgtgagaaggggatataggctgcattctcaccaaagaacatggcaataaaaattgtagtttgtaaaatgttagtatttactcaaaacaaaaataccatgactaattagggtttgtctcaggaatgtagggatgattaagcattagaaaactcgtaaatgaaattcatcatgttaacacattaaaggagaaaggccatatgataattttgatggacaacgggaaagcatatgataacatttagtacttgttcatgacaaaaattcttaggaaatgaatacaagagaactttcaaaagggtgttaaaaaacacagaagagtacatacggtataattccatctatatgaatttctggaacaggtaaaattaatagtaatagaagtcagtagttgcctgacgggggaaggtggattgactgaaaaggaacgtaagggagacatctgaggtgctggaaatgttgtttttttggggattgtggttacattagtgtaaacatttgttagaattattgatttcatgcccactcacggttcgcgaccctcagtttagagaaattgtagagtgcagcatatggtgaaatgtcttttttagcaaagtgtgtgtgtatatactaggttgcatgtaaaatgtacttttcactgtgggactttttttggttaaaaagtttgaaagtttgaaattttctgccctagaagagcttttacatggtataaaatgatatataccagcctattcatagcaggttgtgagagaggaaaattggaaacctaactagtcatccagagtgaatggacagtgaactgtgctagtcataaaatggaatgccatgtgacagctaaaatgaatgaactaggatttaggattatgtatgtatcagcatggactgaacagtatcacactttcatataaatttataaaatgtacagaactgtattgtatggatacaatatgtagcaaaactgttaaatgaccatgggggaacatcaggatagtgataatctctgagaagcaagagggagggaaatgttatcaaagaggaatacatagggggctttagctgtattcgtatcttatttcttatgtctgatcaagtactgcaaaatgctaagatatgacagctagatggaaagtacatgagtgttgagtgtaatatttttgtgtaattaaagtccccatttacaataaaaaccaagatacctggagaaataagtaaatttgacaagatgtaagattttttatggagaaaatatgcaacttatcaatagataataaataaatggaaatactcatttgcatagtcggagtacttgatatcataaatatgttctccataaactaatataaattcattgcacttccaatcaaaatcctataggatttttgtagaacatgctaaacttaaagtaaccagcaatactacacatctgaaaaataaggaaggggggtcaccctgacaaatatcaagactaactagaaagcagtagtaattaatattttcttacattgatgttaagtgtgaacaaataacagaatgcgtgtgatcagacctttagtaggaatttgttatgcgacagaagtggcattatgacttagcaaaaggtaagctttaatacacaggctgtccttatgagagatggttagatcactgtctcacctcttaaaaccaaatttctgatctttcttttagaaacttaatatgaaaagtaaactaaagcatccataagaatatctagaggggattctctgtattacgtcagggtatttatttgtgcctcacattcttcatttgtaaataatagtacctaaccccagttggttcttaggattcggaattcttgcttactggactcttaggcttaagcactcaataaatgtttcctactatatttagaggcacagcaagatttctttgaaaagcaaggttgtggcataaaagatttttaattaaaatacagctttgtgtgttccaaaagacaacataaaatgaaaagtcattctaaggatttggagatttttttgtaatacatactcagtgatagggtttatgtcagaataaaaacagtaagaaaaggaccacatagttgaggactctggaaagagtatgcactgttgtttaattaaatgtgcagagaatgctatttgtcaaactataatatagagttaataacttgaaggctttactacaagttcaggataattagacctcttaccttattgaaactttccggtgagtaatcgtagaatcctaattttactaaggtatcatttggtaagctgacttattcagctgtaaagatagtctttgtgttcttttgaaatctgcattatgtaagtatcacttattgctggaattagaaatagtgtctgaacttagatttcaattcttgcagatgttgaaaatttatttcagtagagaacttgctgccacaccattgaaggaaatctgtatattctgtaaatgactcattcacgttttgatagcaacttgattataaatctagttttcttttttgtatttcatttgtttttaacctggaacacattgttatctgttccttgtcagcctacattcagtctatttacacttcaaaaatattggctaaaaatgcttcagtttttaaaataaaagcttaactaattgaagatgtattatcagcattacttacaacaaatgttattttattacataatttaaaaattctccggagatattagacagatgtcagccaaccatggttactgagacatgcaaaggtaaggctggcaactttaagtgttcacttagttccaaaatggttttaactcctcttgtaagacatgggacactgaaatcatgtggcaataccaggtcatgtggccattcagatgacccagaataggcctaaacttaagttagtttcatttcagtgaagaaacaatattgtaaaggttttatagaaaacttttagatccccaggaatacagcttaactcataagaaacatttctcctaacgaaagtgtaacaggctgggcgctgtggctcatgcctgtaatccctgtgctttgggaggccgaggcggatggatcatctgaggtcaggagtttgagaccagcctggccaatatggtgaaaccccatctctactaaaaacacaaaaaattagccgagcgtgttgacgcgtgcctgtaatcccagctactccggaggctgaggcaggagaactgcttgaacctgggaggtggaggttgcagtgagctgaggtcacgccattgcactccaacctgggcaacaagagtgaaactcctcaaaaaaaaaaagtgttacagaaactgtttactctcattcctcctaatgctggaaatcccttttttttttttttttttttttgctgtttatacagaagtttcattttttattctttttttaggctaaattcttatgaatggaataattgaaccaaagatacagatacttgtagggagattcttttattttgctttttctatcagtttttcacaaggaacagagagattactcatgctaactcaaaaagaggttttgttctgaggatataattgtggagctggaacaggcctggacagtcctcagaaaccaagcctagagattggctgctctgcttttcttcaagacaccagttgtctctgcctagctctggcacacactcttacttgtacactgactgctagctcccctgagtctactatattttatgctgcctcctggccatgtgatgaacatagttacttacataaaggcatgtataaaactgaccctttagccttcagggttgcttctctttcctcattcctaatagtgatgaatgtaccattacatgccactcagttacattaggtagtcggtcacattagttgtgtttcaatccttttccctaaactgcacgtccagtaggtcattcaaaatgcaaattgtcactggaataaatgaagtaatactcctatcattagcagtaatttctgtcttcagctctttaatctgcactggccttattttcccctcatcttctgccacagtgcttcctgtgcaccgtattttagtgataacctaaatttttcgtctctcctaaaacgtttcctgtctttagaaaacatgctgaactttctgcctgctgtactatctctctcaatacttgtgctctggtgtcaactttagtgtcacctttcccttccaaaggttgaatcctgttctctgtgctaggataagactgtgtcacatgatactacggtgtctgtagttggctcctctagagcatactttgtggcacagagtaggaatccaacaggggccaaaggtagccaagtacactttttgctgcctgatagtcccaggttattagttggtagatgattacatgcgtttgatggagttttgtgtatttgctttattttatcaagttacatactacagtgcttatttatgtgtcgtattataggtctaccactatagacagtttaaccgggctgttaagttcactgttgctcttttatttgcattacagttccctaattctatgcaaacctcactttcccaccatttctactatattgctaaagaaagttacataatcctattattgactcctttcaaatttttagtgtttgaaccctagttggactcccaaggttgccaatgcagtattgttatgtggcattccatacatccctaaaaagggttgacatggccaaatttatgaaatttatgaaatttggcatgctgtgttgcctcttcctggagggaggccttggggccagtctcctgaattgagcttgaggatgcattgattttttttctgtttcgaggggcgtgagtatgattatattaggttatggccattattttctttttttttttttttccagatggagtctcgctctgttgcccagactagagtgcagtggcgtggttttggctcactgcaacctctgcctcccaggttcaagcgattctcctgcctcagcctcacgagtagttgggactacaggcactcgccaccacgcccagctaatttttgtatttttagtagacatggggtttcaccatgttggtcaggctagttctcgaatgcctgacctcgtgatccaaccgcctctgcctctcaaagtgctgggattacaggcgtgagccaccacgcctggcagttatggccattattttctagcaaattataccaagggctgaatatcctcagtttgaggaccttttttgagaacattcttttgataatttaaagtccttttttgagcttttatttaatgtttcttttttagtaaatatacagttgacccttgaacaatggggtggttggggtgctgtcctgcacagtgaagaatctgtgtataacttttgactctcctaaaacttacgacctactgttgactggaagccttaccaatacataaacagttgattaacccatattttgcatgtcacatgcatgataaactgtattctttaagctagagaaaagaaacctactaagaaaatcataaggaagagaaaatacatatactattcactaagtggaagtggatcatcatgaaggtcttcatcctcattgtcttcactctgagtaggctgaggagtggttggtcatgctgtctcacaggtagaagaggcagactgggagtcaggcacattcagtgtaactttatgaaaataagcaatttttgcctgactttttgcattttcatttctccaaaaatgtttctgtgtggtaccagtcctccttacaccttttgctttagtttcagtgcccatgtaatggaaggatctgtgttataaaagaagtcaaaagcagccttcaataattagaaccctatattatatatagctagattgtcctatgtcaatttgttttctggcactgcttcttctgcatcttcttcctcatcatctggagctagtttagaagcactgatctctgttacgtcgtcttctgttaattcctctgatgtgtggagtctgttagcccttgaatttctctaaaaagatccatctcttgaagcccttcactccccacttttttttttttttttccatatccacaatctcttatgatttcctcgataggctctggtgtaaatgctgtgaagtcgggcacatctggatactgttttctctagtaggaatgtatcattttggacttgatggctttcatggttttttctataacagcaatggcatcttccatggcgtaatccttccatactttgatgacactctatcagagttcttttttgtaacattgacggtcttttccatggagtactgtgtgtaatgagccttaaaggtccttatgactccctgatttagagatgttattaatgtgttcagggacaagtagatcactttgacatatttggtgttggaatcatgggattgtgggttaccagcgacattgtccaatgtcaaaagaactttaaaaggcagtcttttactggcagggtacttgacttcagggacaaagcattgatggaacgaatccagagaaaagcgttctggttgccctggcctttttgttgtggcagccggtgtttatcttttcccttcaaggattggaggtcagcagctttatagagaagggcagtgctgatcataaacctggacatatttgcacaaaacagtagagttagcctgtcctttcctacctcagatctggtgcttgtttctctttttgctaataaatgtcctttgtggcagttttttcccctagaatacagcacttgcgcctgcattaaaaacccgttcaggcagataccctttctcctcagtgattttcttaatggtgcctaggaactaactcatctactttggttgacagaagctcctttcctgttatcttgacattttttaagccagcctgtttctaaattctcaaccatcttttgatttcattaaattttccagctttagatccttcaccttaattttgctttaagttgtcatataatgactccgctttttctcaaaccatgtaatagtctataggtacgcctttctttatagcaatcctgtacctacataaaacctgcattttcaatatgagatcaaaagttgtttcacaaaaggtgcaagatcttcacacctgttggcctagctgcagtggcagcttcacaaattttcttttttttttttttttagctgtagttcttacactggattcatttatcttgaaatggtgggcaactgcagctgcagacctcagtctgtggtacataccaagcaattggagtttttcttgtaatgtcatgatttttctctgcttcttgggagcactgtcagcatcactagtggcacatcgtatggatctcatggtattagtcaaggcttatggtattgcactacacatggtgaaaattacatgagaaatgtgagagatcactttttactgtgataatttactggagagaagaactgctcatgcagagatgattagcctcacacagtggatactcgcaacacttccgctcaccgtgatagcaacaggaggtggcgatgaaattattacagtagtacagtatgtactaccgttaattttatgtagttaatgatttaatacttcatctgaatgtttacatttctcaactgtaaatggctccatgtatggtctgtgtttgtgtaagttttgataaattttaactttttatagtagatttttgtatttcatgatggtaaatgatagagtagtatctacatatcttttatgctttataacatacctttttcttagtttttttcagtgtttctaggctacctggtttatgagtttttttcagattgtctcaaatctccaagacattttgcaatgtttcttgaataaaatctgtgtataaatggacctatacagtttaaacccatgttgtccacgggtcaattatatagctctgttacaacaaccattttgtcagtgcctcatgtatgtttgtgatggctgtcatttgggctctcaatttttgtcctcaaaacaataccccttccaccctccatccacgaacatttgcctacatgtacttgcagaggctatctgcatgttgtggacggaaacttccaagcttacatctttggtcacttgcaacctcctcccttctgaaatttgtaatgtgcattggcatgttgaagcttttgagaagttcttcagtaaagaagtctatttaacttaatttaggaacttcttaatgtgtttgtccaggcaccttttaaatttttttgaattgtaatttacattgctaaaatgcacagacttcaaatgttcagttctgtgagtgtttttgagatagagtctcactctctcgcccagggtgctggagtgcagtggcacgatctcggctcactgcagcctctgcctcctgggctctagtgatcctttcaagtagctaggagtatagacatgcacatggctaacttttttctgtattttttgtagagacagggtttcgccatgttgctcatactggtcttgaactccagaaatcaagcaatctgtctgcctcagcctcccaaagtgctgggattataggtgtgagccactgggctcggccagttctgtgagttttggtaacttgtactcatgtgtgattacctctcaagatagaaaacattcaggaattcaacagtggatttacaggagcgagggaataaaacaaagatagagaacacttttgtcaccgtagaaaggtactttgtgcttctgtccaaacatttccacttctcttccttagtgcctctgagatggtcatcttgacttgtcattagattagttttgcctgttgtgggaagccatgaatgaaatcagtctatatttctttgtcttttgcccagcatgtttttgagactgatccgtgttgtggagtgtataagctcattcatatttgttcctgagcagtattcctttttatgagcacactataattatttgttttcttttgatattttggctgtttttagtttttggcgattattaacatggctactatgaacattcttatacaggtttctttttgtggacatacgtatttatttttcctgaatgtgtgatacagggtagatctatgtttaactttttggaacttgccggttttccaattgtgctatataccattttatactttcatttcagcagtttatgaatgttctagttgcttgatgtggtagactgaatcatggtctccaaagatattcaggttctaatcccaagaacctgtgaatgttgttttatatggcaagagagactttacagatgtgattaaattaaggatcttgagatggagagatgatcctggattatctgggtgggctttaaatgtaatgccaagagctcttactagaaggccatagagggagatttgaatacagaagagaaggcagtgtgacgatggaagcagagattggaatgatgtgctctgaaggtgggggagagagcacaagctaagggaagggagcacaagctaaagactacaggtaaccactagaagctgaaaaaggcaaggacgaacttcccctcagacactccaggaggaatcagtcctgccaacactgtgactgtagttcattgaaactgattttgctaaatttgtgctgtgattgcgattatttgttacagcagcagtagtatactaatacactccacatcttcatcaacatttagtagtgtcagaaaaattttaaaccattctagatggtgtgaaatggtattgcattatggttttagtttgcgttttcctgatgattggtgatactaaatacctcttcatgtgctcctgtgtcttttatgacatgtctattattcttttcctgtttaacaaaaaagctgagcttacctttttgtgtgatttttaaattttgttggtttatgttacatacacagatttgagtatcccttatccaaaatgcttgggacccgaagtggttcagattttttccaatttttagaatatttgcattatagctgtatagtacaatgaccgtttttttgggggtgtcatgttggtactcaagaagtttcagattttggagcattttagatttcagttttcggatttgtgatgctcagcctgtattttttttttctttttctatttctttttttttctttttgagacatggtcttgttctgccactcagcctggagtgcaatggagtgatcttggctcactgcagcctccgcacccctgtgctcaaatgatcctcccacctcagcctcctaactgggagcacaggaggcaccacgcccagctattttttttgtattttttgttttttagtagagatggggtcttgccatgctgtccaggctggtcttgaacactagagctcaagcagtcctcctattttggcctcccaaagtgctgggattacaggtgtgagccaccatgcgtggctcaactgtatttctcttgtggttaatgctttttatgttttaaggtcatgaatgtattctgtgttttcctctaagagcttaagattctgctttcccattgaagatggtatgcacttgtggttgaggcttgttattttccatgttgttgaaaagttgttgaaaactagattgaccttgggccttactggaaaatgagttgactgtatatgtgtgggtctatttctagacttgttctgttccactgatctttttttcttatgcctactctatactcttgattactaagtctttttagtaagccttgaaataaggtggtgtaaggcctccagttttctttttcaagaatggtttggttattctagtttttttttttgtttccatatgaattttatatcatatgaattgcttaactctgctggaagtttggtagggattacattgaatccatatatcaaattggaaagaatggacatttaagcaatatgaatcttcaagtctatgaacatgatctctctttgttcagtgtttttcatttttcttagcaatattttgtaattcttagtgttgagatcttgagtatctttctttagatatgtagaaaatatctgttgtttcaagcgtatttcttgaaatttcattttccaaatcttgaccctttatcttgaaaccttgctaaatttacttactagttccagtaagtagattacttgtagattccatgcacttttccatggagacagtcatatcactgtagaatataaagtcagttttatttatttctttccagtctatcttttctttgttgcatagttgtcctgtctacaatatccaatgcattactgaatagaaagggtaaccgtggacatctttgtcttattcccagttgtaagggagagatttaatgtttctttatgacatatgctagctctaggtttttcatagatgtccttttcagattgaagaacattcttttctagtgttgctgggagttttaaattatagatgagtgttgaattaacattttcagataccttttttctcgctcatttgagagaatcataggtgcgttttctcctttgtactataaatgaggtgcttgatttttgaatgttaaaccaattttgctccttgggataaatcctacttagtgatgatgaccttttctattatgttgctggatgtgatttgctaatattttgtttaggatttttgcatctagtagtaacagacctttgctgtgtattagtacgggatcttgggcccaagccggcttgttgtccctttttcagtatcagacagctgttgcttctcattcctcagcatctgtgtgcctttgtctgggactggtggtagcaatgtttcctcccttcccgtggcagtagaatatggtggttattgttacagagtgaaaggcatgtttgtgtgtgggagatgggcaagtaagttttgctccacaaatcccccaactcagcagcacatgtcttttgctctacccttccctttgaggcaggggatctttgcttgcccttgggtttggtagactttcctgcctctcccgtcatagttgaaggcatttgcttcatacgagatgccaccaaatgggaggaaggagctctcttccgttttctgccttttttcaagagcactcagttgaggcccttggaaaagagcttgtgaatgagtgcagattctctttctatcgaggactcccagggattttaactgttatcctagctcggcctttcatccttacttttatctttaatattcagcaggttgaccatgaatgtgttttctttccatatgtggattaatatctgtcatctcttgaaaagtttatggccattatctcttcatacatttttttgttccccattgtctttcatctttctctggcaccccaattaaacccaactgacatttggttttggatattctgagtcccccccccccccacactgttttttccctctttgtgtttcaatttgcatactttaatttggcctgtcttcaagttcactgctcatttctgttaagcccatctaatggtatccttaatttctaatactatagttttcatttctaacgttttcctgtgatcctcttttgtaactttgatatctgtgatgaagttttttcattattcatgttgctatctcttccatcagtttctttagcatttttattatagttatctgattttattcatgttttgactgtttgctactccctgtatcttgtaatttttgattgaatgctgaacatttgtataaaaacaatggagattgaagtaaataatatttacttttagaaaatggtccatcatttcttgttttgtccaagtgtgattttggatctctttttggtttatagctgagccgtcagctttctgaaccatgagaaatttctctatagctcagctgtcaattccttggtcattcttattttctttccccccaccccctctttctctagtcctgcctccaagcttttgtgcccagtgagacatctttctgctattaataccttccagaggtttcttttagcaatcctaccctgtcttcaagttcgctactcatttcagcctcggtagatcaatgtcctgagtatctgggtgaaagttttctcatctttcctgtcctaccgcagcccttggcagctcaatgtctagactctcttgggatcatctttttctcacctttcttgcctgtccctccccccatcccccattgatgagggtagattttttgcatttatgggagatcttaagctccttaggggatctccctcagctttccagtcctgttccccaagctttgacatactttttgcaagtacttagtggaaacctatggggatgagtggttggggtggatgcacacttgctctgtgggatccttgcaatttaatatgtcatgtcggtgtgcatgtaggctggtttcttctttctttcatttatggcaggattattcctcactagccgctccaccaggaaagagaccatccatgcagcctctcttctctcaaggctcaacacttggaatttagttcttcttaggctgctttgtatcctcaactctggttcagagagaccatgattttgtagcttatctggctagttttgattattagaatgaaagtgatgctctgttgtaactttctacgtcctaatcagaagtggaattccttctatggaatactttttaagtatatagtctgataatacataactgacacgttttctgttgtttcataatggttgattttctcagggctacgtttctctattttttcctgttctcaaatcttaactctccatctctgtcctcaagtggtaagtgatcttgtgtcttattttgaaattaaagtcatcaacaaattatttcaactcatagatttatagttgtggaagacttactattcaaatggaattagaacgttttgggggataggatgcagtagttcttggtagtccaagactcttaataaaacaactagaaaagccaggtaatttacaaaatttatatatttagcgatagagaacaatgggtgtaaaaatgattaaagaaagcaaaattttgcaccctgggggaatacctttcacaagtgagctgagaggtctgcagctgatcattgtttttcctgggtacagagtagaggaggcctttgggctgcagcctgagtggcagattggaaatatgaggggcctttaaacacagagaacgccctcagtatattcctaaattctgtagttcagctgggcggaagagataaaccaaaatctcagaaaaggagattgggatattttctagtcctatggtgttgagataaagattctctaggggaagcgacttgagaacaataggtgagagttgaaagcgtttgaggaagtggtgaatacacactgatgattttcaacacacccagtttcttcccccgtagacatttgccaaattctgaagctgcttaggctagagagctaaaccagaagtctcttaaaaacaaagcaattcttatagtatctaggtacctagaagataacgatctgctagcttttgaaatgaaggctctgcagagtctcatcctaggaacagggacaaaccagaggtagtctccttcatagcaaaactgctactcagcagtgttctatgattctggcattatagaggaagtagtaaaagtatatgtatgaaaattgtgttaagtgaaggatgaataagaaaatatctagggtaaccactaaaagaaaagaatgtaacaaatgaatacagaaaaaaattggatatagaatatgtgataaattcagaagaagacaagaaagaaaatataaaacaagcaggcaactaaattagtaattatgttacatggaaatgggctaaatatttcaagtaaatggcaaaaatcatcagactggacaaataataattacctaaatataagtacctagaaagattgagagaaaatgatgcgaaaaggtataccatccaaatgctaactgaaggaaataagtgtggctataccaatcaggcaaaggagactttaatacaataaacagtagtagaaaaagagaactacattttatagtgtaaggggattgatccaccagagttaccacaatcctttatgtgtacccagtaaaatagcccaaacatctataaaccaaaaattttattttgaactaaaagaaacagacaaatatgccatcacaatggatgcacatatataggacatacatacatcacaattagcaggcttgatctaattgtcatatgtagaacattgaaactattaatggtggtattaaccatcttttcccttgcacatggaaattgtactagaattgaccataagctagggccatgaacaaagcctcagcaaatatcattgattttaataattgaatatgttgtttgtattatagtaaataaaaataactagaaaattcctagctgcctagaaataaaacactatgcttttgaataacatatgacttaaaataagaatttatgatggctattagaaaatattttaaactgattgaaaatgaaggtgaactacaatgatctagattgctgctgctgaaatgctaagatgaaatttatagccttaagtctatgcattggaaaagaaagcttttttaaggaggtagaaaaggaataggaaatcaaacctaaagacagtagaagtaaagaaataatgaagacaagagcagaaattagtgaatagaaagtaatcttacatagagaaaattgacaaagctaagaaaaagttggttctttgaaaagattaatgtaattgaccacttagcaaaactgataaaaggaggatggggagggggagagagaacataaatttaaataataggaattgaaaaatgtcacatcactacggatcctacagccgttaaatagaggcatttatgaacagtttatggagaatatgggataggcagagtaggcagaaattttgagtagttagggctggatcattcaatatgggtaggcagcacctttgtgtagctattgagtacttgaaatgtggctagtcctagttgagttgtcctgtaagtgtaaagtactcaacagattttgtagacttagtatgaaaattttttttatattgattgcaggttgaaatgatggcattttggatatattgggttaaatacatcattaaaatgttgcctattttctttccctttttaaaatgtcattagagaacttaaagtacatatgtagctcatattacatttttatagaggttgttatattggctttaagataggtactgttatccttattttacagctgagaaaactggggtgtatagaggttgccatgcagctagtaagtggcatccttgggatttgaacctggccaattggcttcagaatctgttctctgaagcattacactgtttatgggttcttaaaggatattaagtcattttactgttactttttgcaaatattgaaggatttttagtagtagggtgacatgcagtatgcattttagaaagctgtttgcatcaaagaaggtagaaggtggtgactgaaagactagttaaatgatttgtagattgagaaaggagttggagctaaatgtgtcattctaatcctatctaatggactaatttgtcaggcacagatagctctgttgattgtataaagagctcagcctttaatggctctttttaggtctccagattagcttcagattgttatgtgcaacacaatgcattgacacaattaagtacttgttctctggcatcatgctgcttgatataaatcctagtgttggcacttaaaagttgtgttaccatgttgtgttgctataaattgtcctttgtattcatgacacctttctccctaatcatccactttttttccacatttgataactcctttatatgtatttcttagaatttttttttcactgaacttggcgctttctgagctctcccatataccagcattgcgtttcattaccacatgacagtttgatctctctgctaagctccaaacctttgtttctagctgcttatcgggcacctccttctggaatttcatagtcacagcaaatttagtttgactaacacaacacttatgttccccaaatacttcgtattttggcgaattgtattttcattcaactggtttttcaagcaagaacctgtaatttgtaactttttcttaatcaactctgttccttctatgtccctaatagctattcttccttttgtgtattgcaattctctgctggttgatctctctgcccttaaaaacttaccccttctccattccccactgccaataccttgctacaaaggatttcttttgtcctacccgtcccagctcaacagtgtagtttgcagatgaataacacagactggatttgagaataaacaggtaaatacaggcacaatagacaggcaaaaaaaaaaaattgttgaatgcaaaaaggaatgaataaatggcaagctgccaaggaagtgcaaatatttcctcaggaaaatctttcctgacgcctaaagcaaaatcagatggtgtttctttgtgtacctgtaatcccccttgcaatttctcttaattgtcatgtgtattttaatcatggcagtcttcttcactagtcattgaccatcctgagaagagggaatatttaaaaaaaaaaattattcttccatgtggtgcaaaccaaaataatggaattatggagaggttagagcaggaatgcagtttgtgtacattggaaatgaatcttagcatataatctatgaaaattagccatgttctttgatgggaaataaatttgcatcttgtgttaggatcttctttaacgttaagaatatgtgcaaagtgtgcttaaaaactgtttttttcctttaaaaatgttttatccagttttttgtacacacatacacaaaaacatacacaatggccatatcattcagcctttttcatcttttcacccccttttctgcatattggtatatctgcaacccatattaatatcctagatttttgtttatacacgtataatccagttactagttgtaacacgtggcacattgccagattacttagaataaagctgtcacatttgaccttttcaccagcaatgtggaatgataacaatttcttcacatcttctccagcagtaggtattttaattaattcaatttttgccagctagattgggcatgaaatgatgccttattattattttaacttgtacttcctcctctacgtttaaaaactattgtctgatcattatgataattaaggaacaaactaatgaaaatgtaagcatcattgttttcttaaagatacactttgaaaactacaatttcagtatttggggtgtgtgatgtaaagactacagacctctttactttctaaaaaggatgccttttgggaactttattaaatatggcaaattgaacacattcattttcctttttcctatatctcactaaaattgaaggcaaaggaaagaaaagcgtaagagctaagatattaagagcttctggagcgaaacaatttttaaaccccaattaaaggatcaggaataaaagttatgtgggacttaccagtatcagtagtggagtctagaaaattgaggggacagtgctttctaaattctgtgtgaactgataaggaatgacctacagggaattaagcaaaaaaataaaaataaaaaaataatttcaagatatacaaaataaggaatattatgctacttttgtacagcaataaggtgggaatgtggttagttgtatgtatacatgtttatatttgtaaaatgacgctgaatagacaaaacagcttaataaaaatgattcctatggaagagaaaagacaaggtacaattccttaaattgggaagagaaactatctgactttactcactatgcaaattgttatttagatgaaaatgaaaaaaacatgtgttaaaaaatttctctcaagagcaggtgaaaccggactacagcttttctccacggactctgtttgccatgtttatttctttattcttgattacttcacactttacgcattttcccttcttgtaactgtagattttgcctcctattagttatgaaagtttaaaacccgggggagagtgggcttacaaattttcaatgtatttttgtatagtcttttgagattagagtgaagttctaaaaagtaagagaaccttttgtgaaaatattttaattgacactactaagagtttaaaatagtattggtggtgaaaaatcgttaaaagtatctgattttacttgcaaaattactgtattttcccacaagaggagtccttacaacattcttgtttttagaagggtttgtttccatcattcatttaaattcataaagataacgttttcatgggtggagaagtctattgggaaagtcataattcgaatttctatcttgctttgcagtttgctttctatgataagttgaaattattacttgatgttcaaggtagtctctacatcatcctttcaatatttctgctaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtaagttttgttagatcccaggtttgatcaaattatgtcaaggaatctgaaggaaagttactgaatttgtgttcctttcaagttgcctgtaaaaagtgatgattgaaatatgactgtttttaaccttgtataaattgtttttgctagctgacttgttttataaattattttcttgaatagtgaggtttaatcaagctaaataagatacttagatttattatcttcattgcctacatttgtatgttatcctcatttccgtgattgaatgatacttgaataaagaattgaagctttttctatcactaacatagtagcaacctacagttttctcctcctttagtcaaaactttcatcaggggtgaaaagaggctgctcactttttaatgaattttatatggtttttctttgcgttgcagcattgcttccaagaaagaatagtgtgttaggtggcttcttaattgttgtaggcattagtcagaacctgtcttaaagacctgcctcttaggttaggaggacctgttactttaaaagtctgaagttttctgaggataaatttaatcatttacagataagtaccactgtcataagtattgttttttaattaagtgacaggtgttttaaagtgtgttttactacttgtgtacattacagattttggggagattgttaaatgtaagaattctctaaaatgatagtttgcagtgtcataccgtgggctagcatatagcatgtgaaaccattctacttgactttgaactttgagaagtacacttttgatgcttatagataacagatcccaataacaccagtgcagcctgtctagttgcaaatactaacagtagaatgtttcttgccttgtttggtagaccatccatttctttcccttacttgttttatgtatatcttaaaggttgcttttttggtttgttgatttgttttacaaatgcttattgagtgtttgctatgtagaaggcactgtttctagacatatgaggataacagtgattaacaaaacacaaaactcctgccttcctaagggatagaaatacacgataaacaagtaaacaaattaattataatttgatatggtaatgagtgcaaagaagacaaccaaatgcagtgatatgatagaatgaagaattaaaaagctgctttgggtcggattgtgatgcttgcgtggagcttggagaagcagcagccaactgagggaagagtcttctaggcagagggaagagccagagtgaagacactgaggtgagcttcttgtattagaatatttaaaaggagcccagtgtagatggaggacaagacttgcccaaagcttatacagggcatcctagagtgtggtgagagtttgaatgttagtctgaatataacaggatgcaagtaagtttattctgatggattttaaagaggatcttacatatttttacaaagatttttctggctgcgggagagtggtatgtgtgtagtagggtagatggaagcaggaaaattaggaggctgtgaggaatctaaatgcaagacgatagaggctggactggcgtggtggctgtgctagcacacgaagtaaacagatttggcatgggttttagaagtggaactgaggacttcctggtgaatgggctgagaagtcaagctatatttcattcttcattgtgtagtgcttgggatttcaattaggtaaccatttatcatatgcccactatgtgcctggtgtgctcttcctcactggagttaagatacagtgtttgcttttaaactacttacttcctagtaagggagataaacttagaaaaagatggtttcatgaggcttggtagatgttataaaagaagtatgcttggggctatatccagaggaggcttgtggaaagtttccttctggaggaatactggtgattttgagttgagcggggtaaaggaggaattaggagaagcctgtttcatcacatgtagtgcggtggtgtggagattgggaggtgggggaggattggtgaagcgttccaaacaagttgggtatccttagagtataaagtaaggggtggcaaatggccatagtgtgtataggtagtaaggagtcacttcatgctgtgccagtgttcacacttaacctgagggtgacgggtgaggttggggccgtttaagtgccgtagggtctgaaggctcagaagtcagattaatttcaagtgcaacgtgggttgcagcgagaaaactccttgaggctgtcaagaatggaggccgggagactggtatcacttgattgaagggagctgtgtgatacagcagagatagagccatgtttttgcacaacttcaacaaggctcaagttgccattgcagtgaggttatccagagcagagcctgagagagtctaatcttttagggaggtacagcagtactaaaattggccattgctggtatttaacctgtggaggaggtcaccttagtcatagctcttttccttatttcccattctttttacagcctcttttggagatagagatctctgagagctcatattctggagctgcttcatcattaaaaacatttttttctgccctctcacctgattaatgaagttgaagtgataattgtccattatcttgtttttcactattgaagtttccttgaagcgtagaaatttgcctaatttggtggtttttttagatgttgcaaaaatggagatttgttattattgatcatggtctatcaaaaaaattttaactttttacacactgtagcttagtgccatatattttataaagcttgtttttagtagtagaacaattaaattgtgtcaggttattagtcatttcttaacaactaaatattcttaaatgtaagaaatttagttggaattcagggaactcatttatatgtagagtgtaaaagatgggaagtgggatggaaaagatttgttatggctaaatccaaaccttagcttaaacagaattattcaaaatgtgatacacaatggatttgtaagcacgtttactcagaatttcaagtaaaatgttagtaaagtgcctttatggttttataagccaaaaaatacaactaagttcagctgatgaagaacgggaaacaaattgcttaattttaagaaatggcaaatgttttctgttgaaatgtttactgaacagttcctcctctctactttcagccccttaatattagagtggggttaaagttagggcagaaacatagtcctggctttgtgtccctcccactcccctcatctcattactcttgttgcctctggcagtttaaaagctgtagttatagatacgtcactgtcgctcccttcccaccattttctgtggtgacacagagtaatttataggtagagcttaacctcaataaaagctgcagtgagctaaataataaaaaatttcaggaagctttttcatctcaaacatttttgagtccgagggatgggagacaacttggtcgtgaaatcagaatggcaattgatatttagataaagaatcagacataaggaaaaagctttcaatatattattatccacagtaaagcaaaattgaaattgcagtggggatggaggtctgtaaagttaaaagtaaggactatggggtctaaaatggctattttataatattgattatacataaatgtataggaatgcaaaatttattttcataagcataaattaaaaggactttcctaaggtggtactctgaccatgtaatcacatttttgatctttcatcccaaggaaataatcagaatattgtcaaagattcctgatgtttgtttcagtatcattttttccaccagtccattggaatctgtattgtttttaatatgaattagaaaaaacccagtcctaacctttagtttctttaataaagaacacttaagcttattttataccacaattaaacaagaatagcgaaagaaaagtttatgccactctttataaacatagatgcaaaagtcataaataaaatatcagaaactagaattcagtggtttattaaaaacaaaaccacaaaaacataactaggcatggtggctcacgcctgtaatcctagcactttgggaggccgaggcaggcagatcacctgaggtcaggagtttcagactagcctggccaacatagtgaaacccggtctctactgaaaatacaaaaactagctgggtgtggtggcatgtgcctgtaatcccagctactcgggaggctgaggcaggagaattgcttgaacccaggaggcacaggttgcggtgagcccagattgagccactgcactgcagcttgggcgatgagcaaaattccgtctcaaaaaaaaaaaaaaaaaaaatgtctaggtaatgtttattgtcattcaaggatgactcaactacaggaaatctattagtataagataccacataatcatatttaagaagcactttatgatcatcatggatccagaaagggctttctataaaatttgctattcatattaacaaattagaaataagagttttcttagcttgataaagcatacttctaaaaatgttaacacttaattatgaacttttagagattaattgaccaaatttttagtaatgagtatgggtgacccagaaaagtcctgtatttttttttctagtatttatatataaaagtatatcacttttatagtcagcacaattaaatgtttaaataggacttttgggcaatttaattcgtgtctatttatgacaagactattcttgtcttttttctttgaagtcagttttttctgttaaaaggcaattctattttttttagcattctgatatttgtatgtttatgactgtttttgccttcaaaaagtgtatttctagccagacgtggcagcattcacctgtagtcccagctgcttgggaggttgaggcaggagggtcacttgagcccagaaattccaggctagtgtgcagtgatcacatctgtgaacagccactgcactccataccgggcaacatagtgagagtctgtccctttaaaaaaaaaaaaagttacttaaaaacataaagtagcatgtacataactgaaaaatcaaccatgattatacggtggaaaaatcagtctccctcccacccctgttttttcatcacccagttttcctctgtagtgaacgttgtattactagttcctcatgtgtccttccaggatgtttctttttaatgctgccattaacatttggattttgttttgcctcttagaaacgagacagagttttgctcttactgcccaggctgcggtgcagtggcgggatctcggctcactgcaacttccgcctcccaggttcaagcgattcacctgcctcagcctcccaagtagctgggattataggcatgcgccaccatgcctgtctaattttgtattttttagtagagacagggtttctccatgttggtcaggctggtttcgaactcctgacctcaggtgacccgcccgcctcggcctcccaaagtgctgggattacaggcatgagccaccatgcccggccacctcttacagacttttaaacatcagagtaattagtaactttatgcagactgtcttggaatagagcagttgtcattaaaaaaactgtcatcttttatttctaacctcatgttcatacccttttgcttctctaggtaaccaggaatagctaaagagaagtctttttgaacccaaactgtagtattcttccattcttaagcaactgctttttcataataggataattctttcttctcattcatacataggcatgtgcgtgtgtctgtctgtatcgtaatatgtatgaaacactatggtggagggaactctgaatttcaagtttgataacctgtttttgtgtcagcttctttagtattgatgaatgtagatcctagggaatatgactgtactttttttactgttcacagctgtgaaaggcagtagtgctatctgagtactttcacagtatgacttttgggtccattgaaataatgtaaatgagcttcataagctataaaacattatagctaggaatatgatttattggaaatattcagatattctaggtcttcgttctctatttttgtttttcaggagaactcacattaaattgtagacattaaaatgtattgtctctgcttagaaaaagtttttgccaggcaacattgcatgatgtataatttagtttattaaatgtataaaatttgttgataaagtcagagcaataaaactttataaatatgaattagaactttgaggttatggggaatagggaccttttatcagccttatcatccagtttgtcatatacagtttataaatgtgaaagcacttgtgatgaggtcaagtatcacgtgaaacacactttggaaggcactttgctaagccctggaccttatctggtgcctacatttacagttaggtattttgagggggctcctgctccaggacctggtattcaaagtcccttgtgtatatggtatattcttgcatggggcatttttatcacttaccttatcagggaaaatacctacctgccctaggacctttgtccctttataaaaattactgaaattatacctaaattaatcaatttctgtaattttatcatgtaacacctgatgcaatgaacaatataccctcttttcttgtcctgtttaacatattagcttcaggaaagagtcaacctagctaaaataggcatttaaaaaattacagtaatcttttgttttcccaacatccttggtctgtttccagtccttttttttttttttgagatggagtctcgctctgtcacccaggctggagtgcagtggcgtgatgtcggctcactgcaagctctgcctcccggattcacgccattctcctgcctcagcctcctgagtagctgggactacaggcgcctgccaccatgcctggctaattttttgtatttttagtagagacggagtttcaccgtgttagccaggatggtctcgatctcctgacctcgtgatccgcccacctcggcctcccaaagtgctgggattacaggtgtgagccaccgcgcccgactgtttccagtcttacctggaaccattctaggctacccaggcctttttttttttaaagtatttaccatccagcccaaaatgtcatacccaggacattcttatgtgactacattctgggaaaaaccatactgtttactccttccccttcctgtcttgtagtagagtccttccaggcctgtgtggtcctcactggcaatataagtaaatgtatcactatccaaagtgcctgagatagacaatacccacacatggactatggagagaggtgagataatagtaaaacagcagtttaggatatcttgctttaaatcttctgttgtacttgggctaaaatcagaacgtctcttacagttctgttgttttcatttccttttttttctttttctctttttcaatttagatattttctgttgatctacttttgagtttactgatcctgtttttgtgctgtattcagtctgttaagcctacgtaagttcttaatttcaaatatatccttcagttatagtatgttcctttgatattatagaccccaaatctgttgaaattctccattttgtctatttccttaatatatttataatagttactttaaagtcttctgtgtggcagttctaatgtctggatcatctgttggtctgcttctgttattgtccattcttttctttctcaaattttcctgcattttcatgtcatacagcttttattgtatgccatatgttttgtacattatgtaaaattcactcataaagatcttgcaaataatgctctccccagagtatttgacctttcctacctttaccaggtagatagagagaagctccccttaatctaattagcgattgagctgggtggggctagactgccattttaatttggtttagtctgccactggattatacctttcctgcaaacagcgctccagggattttgattgaaagcttgttagactgtcacctaacccctgaaacactgggagattcacttctactttttcgaagtatgaggtgactttgaaagtatgagctctttagcctcagctttaagatctgataagcgtcttgagggggaatactcatgtgactgtcaaaagttctactgttttattcctcagagcttcttttctcagaccaagcctttagcctgcacctagaatctacacgtgactccaggggaggaagtgataggcatttgtcagttcacctagaaagctgctttgctgcagttttagttcatctggatctcattagtttgatagctctccattgtcttttgagcaagttttttttttttcccttttttcccctctagtaagaacattggactgctgtgacctgcttatattttacctggagttggaactatagcagaatgttataataggaaatgttctggtatttaccaaatctggtatttaccccaaatctgagaacagtagattgccagtaacctgcattcaaaattgaggtgctatagtgttcatgcagaacatgcagaaaagacaccctgagtcaagcattgctacagttaaaacctgttactcacctgtaggctgtataaagatcgtgagttcaagagaaggaccccatagtgaaaagatttttggcgagagtagtatatgttaaggtatttctcccttttgttaatccaatttgaaggacttgacgagaacttctcagtttgacatgtgtctgctgaggtttgagagataaatagactggtacttgacttctatctgaaaaagcctaaaaagtgagataaaggctggagctgcccctgtatcggtagaatgaagaaagggcacaatgggagtgggccagcactttgtcagagtttgatgggtcaaaggtggaagaattacccccatggacaaagtagacgttagtaagacataatagttgaagttggcttaccttgaaaggatcaagaggccatacttggttgaagggtcacagtgatccaagcagacaagcctgagaagttcctgcatcaggaactaactataggtgagagtctgcatttggacttccaacctccacaggactccatcacacattactgtcacatcagattacagtccagccagccacttaagatcgtgccccttttctctcagactccctcttcctgctatttcagaaccgggaggggccttaaaaataatagctggagagtactggaagaggtagcgtgaaaagaattaatgagatagtaagattttggctttgctgtggctggattttaatttctgaagacatttattgttaatacaaatatctggatatgactaggaagtgttgaaatctttttgggattttgtgcagacaggataaaagcagcttgggaagagcttgttggagagcaatgactagagtggtggtggaagggagctcactaagtctagtttgtttcatgagctgtctgtatcctctttttgaaaattgagaattccaaatttagtggttgctggggacaggaagaatatgtggggagaaaagagggatgttacgtgtgtctacgtgaaatacatgccattttaacaaaagccttttctttttttttttttttgcatataatcatgatactggttaaattagccagtgatgctttattttcaaagaaatgttacaactacagttttcttctattatcatcatcgttttccttgaagcggtaggttagtctttactctcaaaatccaacttttaactctgactttgggttatgatgggaagcgctatgaaatggtcttggtgctcttatgaaactgtgatcactaataatacttaaattagaactgaaatatataaggagacttctcactaactccttcaccccagccttttgtcttttagaactttgcttatctttatggttagatagatagatagatagatagatagatagatagatagatagatggatagatatagatatagtttctctgaaatttgctaggacaacggggtttgggggcaatgaaagaaggttttatatttatgtttaggatgatagggacattgagagatactgaacacaaatttataatgaagttaagtaatttaaaagggttttcctgtaatttttatatgatgccttatataatttgcatccacaggtataaaacattaatctatgtgcttaaacatttgcctaaacattttaacatgttatctaaacataacctctatgcataaaagcagtttatcacattcagagtgctatacagatttgagttgatttttattttgtgggatgctaattgtcaaaaattgtcagattataaaaacttttacaatcaaagtcaagcattataaaactgtataacttaaaaagttgaatttcatggaatcacattctgtattgtaatcattgttttatggttgatgtaaagtcatcccttggtatccttgggataccccatatctccaaaatttggagacgctcaagtctcttatataaaatggcatagtattcgcatataacctatgtacatcccccaccatatactttgttttggaggcagtggggagacagcgtctggctctgtcgtccaggctggagtgcagtagtgcagtgttggcttactgcaacctctgcttcctgggctccggtgatcctcccacctcagcctcttgaatacctgggattacaattgtgtgccaccatgctaggctaatttttgtatttttggtagagacagggtttcatcatgttgcctagtctgatctcgaactcctgggctcaagcgatctgcctgcctcagcctcccaaagtgctgggattacaagcgtgagtcaccatgcccagcctgtattcttcattgttgtattgttattttatctagtttttcctctagtattttctgtccatggatgtggagcccacatatacagagaccaaccatgtattccagattttatgcacttattttaagattagaataacatgtacttatattttatatttattttgtcatttatgttactatttttctttttaattgttaaaaacagtatatattggccagacacggtggctcatgcctttaatcccagcactttgggaggctgaggcaggtgggtcacttgaggtcatgagttcgagaccagcctggccaacatagtgaaatcctgtgtctattaaacatataaaaattagctgggccaagtgtcataattccagctatctgagaggctgaggcatgagaattgcttgaacccaggaggcggaggttgcagtgagccaagattgtgccactgcactccagcctgggtgacagagactgtcttggggggggagggtatatgtgtgtgtgtgtgtgtgtgtgtgtgtgtgtgtgtgtgtgtgtgtgtgtgtatatgactaaatctagaaaatcgataagctatgttattaaagtaaatgtacctgaaccctttcagtgttagcttttgttttctttaagtaaaaagtttgtatttggaagggcttgaaatacttcaaccatttttagaattgatatttaaatcttttcagtagtagagactattttgtgtgtgggagatactttgttttttcaggggcagcagaaatatcaaacggtatctcagagtagagtttttaataacagcatttggaggtggaggtggaaaatattgagaaagtttttttcaatcatcacctggtccttcttctaagaaaggctatactatatcaaagatgagtagaagtgtcaattttattcttataggactgtgtgacttacaggagtgtgattatggaagttctgttgtctccgcctattttttatttagttattaatatttggaaacctaagctgcttattttaatttggaaggggctttctcaatttacttgtccaaagaaattttctttcctgagaaaatgtctcttacagtgaaatcttcagtttttataattaaacatgttgtgtaaatgttttacatacctgggatattataccagttttattgttttagctttgatttgctatgtttatattacttgtttctttttagtaactatatatggggcggaataatgttaataattaaaaatgtggcctctgtctcttccacttgctggctgtaggaccttagacgtgttactttgtgtttccattacctcatttgtcaaatggggacaacagtgcctgattcatggcactgttgaaggattaagcggtttaatatgtgtaagagcttggtacatagttggtgcttaataagtgtgaactatatgtgggatgggattttatatataaaatttgattttgaagtgaaactgatgatgtcacctatattacatgcaccaagagggcatgaaaaggtttattactcacataatgatgctgtctgagtagagcatggcaggcttccaagttggtccaaaaatgacttgagagagcagtgataggagactggcttggggttttatggtgattagggaatggggctgtgggctggtttttacactgtacatatgctgagacttgcctggtttgaaatttctctaatatcaacaggtggagcacctgggctttcttaccagcttgcccagattcgaggcagaaggggaagaggaaatggtggggcttgaaacctatcagcagtcaagtatcagaaatggagttggatttcttattcaacacaaacaggataaataaaaagaaaaccacacttagatatatcatggtcaaactcatgaaagagggaatcttaaagcagctggtgaaaaatggcacgcagcatacaaatgacaggtgatcagcaacagagaagattgtaaagtgatatatctaaatcaccaacatcagggagtcataacaataaattgtatctgcttaataaaggaacttaaaaatacatgcagcaaaactgggtagaattaatgggacagaatcacaaatccacaattggagagttcaattagaacaaaaaaatcagtaaagacatagaagttttaagttacattattaagttacattattaactacctacgtgatatttatagaatactaaacccaacatgagtagaaatacaagcgtttcaagtgttcatggtaacttcaccaggaaagactgtttacagggcacaagtctcaatcaattttaaaagattgaaatccaaagtatgttctctgccaccaatagaataagaaattaataccaataagacatctgttaagaattggaaattaaaccttaaaattctgacttatgggttattcaggggaaaaatgaggtaaaatatatttcaaaccaaattataatgaaaatacagcatatcacatatgtgggatgtagctgaaagagtgcctaatggaaaattttatagttttaaataatctgctaggaaagaaagttacctaaaaagataaaatagaaagtaagtagaaagaagaaataataaaattaagagtagaaatcagaaagccaaaagcgagttctttggagagataaacgcttgttagactgatcaagaaaaagacagagagcccacaatcacaaatgacctatattggtactgaaagagggattgtcatggtaggtcctacagacagtaaaaagattataagcaaatattataaacaattttatgccattaaatttgatgactaactgtaatgatgaaatttaggttacccccagctgatgcatgaagaaatacaagatctgggtagccctataacaatgaaagaatttgacttcataatcaaaagctttcctgcaaaggaaacttcaggcccacatggttttactggtaaatttaagcatttgtgcaacaaatatcaccaatcttatagacaataaactcagaaaaatgttgttttatgaggctcacataaccctgaaaccaaaacctgacaaagatgcaactaaaagaaaagttaaagattaatatatcactaacatacatgagaaaagaatacatcataattgagttctattccaacaaggttagtttataactttcaaaaagtaatcagtgtaagccagccgcagcggctcatacctgtaatcccagcactttgggaggccaaggcaggaggattgcttaagcctaggagttcaagaccagcctggtcaacaaagcaagaccccatttctatagacagataaaattacccacccaggcatggtggcatgcccctgtggtttcagctactcagaggctgaggcaggaggatcactcgagcccaggggttcaaggctgaagtgagctatgattgcaccagtgcactccagcctgcatgagacattgggaccttgtcccccacccccgaaaaaagaaaaattaatcaggtcagatgcgatggcttatgcctctaatcccagcactttgggaggccaacgcagtaggattgcttgagagttaaggagtttgaaaccagcctaggcaacataagactctgtctccacaaaaaaaaaaaaaaaaaaaaaaaaaagccaagcgtggtagtacattcctgtggtttcagttatttggaaggctgaggtgggagggttacttggacccaggaagttgaacctgcagtgagcagtgatcacgccaccacactccagtttgggtgacagagcaagaccctgtcgggcaaaacaaacaaacaaacaaaaaaactatgtaatttactgcattaaccaaggagggaaactataagatcacctcacttggtcaaaagcatttgacaaaattcatcatccattcatgataagcattcccagcaaatgagaaacaaagagactttctcagtctgataaaaggtatttaagaaacactaacagctaaggatttacttaatcatgaaatactgtgttttccctcaagaacaagacagggatgtctactcttgtgtccttattattttaatagaagacctagcaagcgcaatgagtcaggaaaacaaaatataaaaggtttaaagatctgaaggaatgtttcaaaattctgtttgtagatgacatgcttatttatgtaggaaatcctaaagaatctataaatatagccactaaaacaaatgagtaaatttagcaaggctgcactttatagattcagtgtctaaaaatcaattgtatttttgtaaatactagcagcagacaaataggggtgttaagaaaattcatgaatagtagcatcagtactaaatacttaggaatacattaaacacacacacacaatgacctctgcttaaaatgctgaaaccttgctgagagaagttaaacaaatgaagagggagttgtgattctcatatggccaggtatgctcttaccagactgacactccctcaataacaaactgcacaaaattctaaaaataacatgaagtactggagaataaacaaaaataggcatgttttagaggggattgacactcggaagaaggaaatggcgtaggcgaattttctgttttacagcttttgtccatgcaaagtgtgcagggtaggtaaaattccaacacaaaaccaagtctttctggccttgaagcaccataggtaagacttgggagaatcacaactattggagagtgaggagtgaatatcagcaaggagagtttcagaaagagagccctggattctgcctacaaactttgccaaaatcacctgctgatcccacatgtgtacggtagacagtacagccagataatcagcctgatttgaattgctccaggacagagtttgtggtttgaatgcaaccaggttagttgtctggtgaaacaaaaatgaagacttttggaagattgtaacagaacctctaactaccatcagataaaattcacaatgtctagcatacaatcctaaattacctaacatacaaagaacaaagaaaatgtgaccctttataatgaggagaccaaccctagaagacctacatgttggaattaccatgcagtaaactgatggatacacttgtgaattggaaaactcagtaataagttagagtacttaaattaccctgacttcaagactcaccttgaagccatagtaatctgtatagtgtgatactgacataaaaacagataagatagccccacatagataaacactgtgtgcctatatgattttcaacaaagttgccaaagcaacccagtagggaaaggaaagtctttcaacaaatggtgctggaacagctgaatatccatgtggaagaatgaacatgactccaccttacaccagtgaaaacaaaatatttctggataaattgtagtctaattaaagctaaaactataaagcttttataagaaaatataggagaatatttatgacttgggggtaaacagagaattgttcaaagtatatagaaagcagtgaccatgaaagctgctaagttagactccattggtatacaaaacatattattaaaatacattgttaaaaaataagtcagagtgggagaaaatatttgcaaaacatttctgaaaggattgaatctagaatttataaagatttctataactcagtaatgtaaagatagcctaattttaaaatggacagtagttggctacttcactgaagataaaggtccagtaaagaaatggaaaaatgtgtaatatcggtaggcttcaggaaaatgacaattgaaaccacaatgaaataccactgcacaatcatcagactacctataatttaaagactgaccacaccaaatgttgatgaggctttggaataaccaggagctctctctcatacattgaaagagggaggactgtaaaatcgtactctggaaaatgatctggcaatttattgaaaagctaaacatgcatctatccactgactcaagattttcacttctaggtgtttacccgagaaaaaaagaaatcatatttctatataatgatatgtactttcttgaatgttcatgacaactttattcacaataattaaaacctggcaacaggtcaggtgtctatcagtataagaatgactaaataaatcatgcttgttcaagtaatggaaaacgactccacacacacacacacacacacacacacacacacgtcatatacattaacatggatgaatctcaaaatcatgctgagtcaaaaaagacccaaaagaatatgtaccatattccattcatacatagactttccagaagacacgacacctatggtgaaaagatcagattagtggttgcctctggggatgagcgcatggatgccagacattgagaaatggacatgggtgatgatcttgacagggttgagaagtgtacaatgtatgcatctgagaaaactcaaatggtaccattaagatgtgtgtttcatgctgtgtaaatttaacctaaagaaaaaaagaacagcgaactctagttatgtgcattcttaagtgtctagatttgtgttatctgcagcttttatttttctctctgagacagggtctagctctgtcattcaagatggagtgagtgcagtggtgcagtctcactgcagcctccacctactgggctcaagtctcggcctcctgaatactaggagcataggtgtgcaccagcacacccagctaatattttgtatttttgatagagacggggtttcaccatgttgcccaggctgcccacatacacccttatttttaatgttccaaaaagtaagggatggatagagaggttaagtagatacatgagagagcaaaagaaaacaaatccaaattacagaatttagctgatcaatgtgtagggtgcttactcgtaactttaatggatgtttgaaattttttatcatacagaactcaggagaagatggaaagcttgttcatggaagtatctgagaagttggaataaatacttagaaactgttgagtttttcttttctgagatattcctctccaaaagtttgcttgattctttcgttttgttttgttttttaagatgggatctcacggttacccaggctggagtgcagtagtgcgtcatagctcactgtggcctgaaactcctgaactcaaactatcctcctgcctcagcctcccaaatagctgggactgcaggcacatgccaccatgcctggctaattttttaattattttgtagagatggggtctcactttgttgcacaggctgtttgcttgattcttaagaacgtatagggatccagctgtacagagctttctgcagtcttttgtaatagaattagttgttaaaattgtacttattacatgagcatcaaagaccttggaataaagctattcctcacatatctggacattatttggacttactatgttaccgattaggaagacttggtattagtttattttttaaaattctgtttcatgtgtgttcttataaaattatacaaataacagtaccacaccattgtgtggtgagctctacttagagctctgtacagcttgggtatctggaatgtagacatgctctgttctgatttgaaacttagaatgaaaccctgacataccggaatgcacatttggtgactgtttgtttttgaatggttactatttcattgctacaagataaaatcgaaaaacattttctacacagagtgaaggtttaagccagttaaggaccctgttaaactgtctccagatttaattactgcccaattatgccttaattatgaaggaatgtgagcacttattagctattgttgatgattcaacctttttgaaataaatttcttaatatatttcttttatattttcaatttttattcaggaatatctcaaattttcaagagatacagttttttgcatctgtaatgcagcaacttaaaaaatcatttgcacctacttatttctcaatcaggattgtctacattttgcaaataaaatatggggaagagactggattctgaggcaaataaaaggctatcattcttaatcattgattaaaaatttaagtttaatcaaagtagtcacattgttttcagtgatgtgataaatgacatttaaacatttgtaattgaatactacaatctattttgtgtctttcaattatatttgtagtcaagataaaatatacagccacacatagtacttgtaattatggagacttaaaaaaattattacagtgattaactcttcattcctgagctgtttaaatctaaacttttagtcttaagtcacatataaaaatgaaaggattattttaagtagaaataattatggatgcatagttacagattactcccctagaagtctgtattaaatgagtagatcagtaatcaagagctggagccttaggaaagttccttttgttgataatattctgctaattgactaattttactgagtgttcagcatgcttttaatcttaccaaggtggcaacttaggttgttatcccttttgatttgttaaaaaaaaaaaaaaatacactgtttaggcaagaagatcatgaaaaataataaattagtaaaacaatggggtttattacttttgttattggttgtctaactgcagcagtaaatcttgcagatatggtaggaacagtaaaactggtttaaagggttaccagattctgtgatgcgagccaccttttgcccaaagttggtagtgttttcttcaacttaattttcactgcttctcttttctttctccataacaaagatgtgaataaatatctatatccttaacgcaaaaaaagtagtaaattgaccaaacataatatctggataattggaacaaagtgcaaaatgttaatttagatgtgtatatatgtaggcgagtgtatactttgtaaattgtacactagatattaaattttaatttcagttttcaaaagtcagcttattcttagatgaagaaaatctttgatgtgttttactgaaatacttattgtaaaagttattactagggaaatttgataaggatttctattaggtttattaccaagtcatcctgttagtttagtgattaatatactgtatgccaacaaaggtagttgctatattagtatgtttatgactttaatagctgttttgcctctcctccccacctctttttaatttaagctagatatataagcaagaacattacacagttgatgggggataatctgtctttaagaaactgttccatgcaaagaactttgggactttgcgtgagataacatacgtatgcttgttcatctgtatattgatgcagggacatcattgtagttagttaatggtctgctacatcttatttcaacatattgtaatatttcacattaatttgttagtaaacagtatcaaatttgttcaggcagaatttatgagaccaatttttgctgatatttttcaatacatgagagttttaagaatatcctgaagttagatggtcaaataaatttaggaaatgttgagccaatgtgtttgggatattgctatcattgttataataacttaataatctctttaggatatgttgattttacatagcaagtagtcttagtttaacattttcagacctattttctatccttagtactttgtaaacagcttgatgttgtacaggtttctgtttttcacatttgagtaatgtacagacatttcttgtggacttcctttaatattatttaaatgtatagaaacatacttaagtgcaaacttaacgctaaccaaaagacaaatttatactcagttatataacccacaaaattccaattaacatcaatttaataggtgatggatactatttttacataacttgcaggttactttgaggtccctaatccatttagtcttacacagtgcttgatataaagtagctagcttatgaagacaattgtcattaaatatttgtttgtaagatgcacatttttttcactttgagatgccccttataaataaaattgaaagaggattttcaagtgttacacaaataatgttgcattttaaagtagataatcttagattagtgaaatttattgaatgtgtaaaaagctttttatatagttgttataatcagtgctacttctctaaaatttttcctgcatttgtttcttttaatattttttagaaactggccatacctagaagttataacttacactttttattaacaaaatgaaaacctgggagatacagtttttccccagtgttatttaggatgttatgatttaatgtgataaggaatattataatccacttttgtactatgaaaataccagttgggtcaccaaatatgttgtttgctgggtggtacacaaagggctttgggagctcagggtgttgttgggaaatacattgtggttagacagaatctttaaggaagagtgggtgattaaaactgcctcattaaaacctaccaaaggcatcttaaaaattgacctcgtttgttagacttattaaagaattagtagtaaagttaaaaggtggctaggaaggggcagttaacataaattgcacatggaagaaaattggtaccaaaggttcatgtgagacagaaaggacattgtgtgagaaaagaatgatcagggctcaggctggcatgttattatttgtctcttatagtaatgcccaaactgcgctttaaatgatgcagtataggaagtaatgtgcctctaatgttttagaaccatatctttttatagaagtgtcaagatgacattgacttgcattttattctctggcaatattttcttctgttttatttttacaattttggtgaaaggcaatatacattcacatggctcaaaaatacgtatgtttatgtatgtatacacatacaagcatgcatatacacatacattggaacctctcccttcccactctgcacctcaagtaactactgtccatgatgtatgtgtgtctttatgcatatattagtgagtaattacagatctttttacctgtccttttttaatacagggagtagcatattttagacctttccatatcagttcatagggtgccttcatcatatgctaaattgttctatgaattttttgttgggactttttctgttttggtttttacttttctttgcattcttttgtgtttttccttttttcaggtaaattttttataggtgaagtgcacaaatcatatattcagtttagttagattcaacaaatgcatataccagtgttttaagataaagaaatttcaatcatccagaaagttctttcatactctttcctagcggttcttctggaaacaattactgttgtttttcactttgaatttgttctgccacttctagagcttcgtataagtggagtcattcagtgtagatactttagtgttcagcttctcttgatcagaatattcccaagattcatccatgggtcagtaattctttttcaagattgttttgctattcaagatccttagtatttccatatacattttatatcagcttgtcagttgctacaaaaatatttttgctgaaatggtcactgtaatagatataaaacaaataggcaacaatcattagggaattaggtcagatggacatcttaatattgactcatctgtgaatatgctgtatctctatatacttagcttttaaaaaatatctttgagcaaagttgagtttgggcagagttcacagtcacattgttgatgtttttcccttgtgcctctttctttacagggtatcttccttcttttttcaaactctctggcagccccaaatgtgtcctctgattctaggtcagtaaaactgcagttttctaaaaacaacccccctgcagtgttctgtttgaattctagttgccctgcctagctgtggctggggagtgcccttgggtacacagccacagaaatgcagctctcatccagtacagtttgcagctttgacagttggacctcccttcagcttttgtctgtttttgatctgtgtctgctattttcaaatagttgattattttgttcagagtttatcattgttatatgaaggaaagttagcctaattgaggctgctctgccattactggaattagaacctccattctgttttgtgtattcttttactaattgcatactgttttaattattgagaatttattatgtgcttcagaatctggtaggacaggtctttactatttgttagaattttctggtcatacttatttgttttggcttattacagtatttggactaatacctggatttttaaaacatttatttttattgagattgcatcaaatatataaatttggtagagttaatacctctatgatggtatcttcctgtgtagggacgtatgtttttcttttttgctcagtgcacttttgtgttctttagttatgtttaaaatgtttctttgtatagtttgacacagttttaattacatttatctagatgctgcttatacaactctcactatctaagggggattggttctaggatttcccactcataccagaattagtggatgctcaagttctgataaaaaatggcattgtaagcctgggcacgttgacttacttctgtaatcccagcattttgggaggctgaggtgagaggatcacttgagtccaggactcaagagactttgtctctacaaaaagtgttaaaattagccaatcgtggtgacacacgcctatagtcccagctactcaggaggctgaggctggagaactacttgaggctgggaggtcaaggccgcagtaagccttattttaaaaataaaatggcattgtatttgcatataacctatgcacattttctcatactttaaatcggctgttcccaaccgttttggcaccaggagacagagtcatgaaaggcaagttttccactgaccgtggtggtgcggcaatggttttgggataaagacgttccacctcagtcatcaggcattagttagattctcttaaggagtgcccagcctaaagccctcgcatgtgcagttcacaatagggttcttgctcctatgagaatctaatgccactgctgatcttccaggaggcagagctcaggtggtaatggtctctcccctgctgctcaccttctgctgtgtgtcctggttcctaacaggccgtggaccggtatcagtctgtggcctctgagactcctgctttaagtcatctctatattatgcataatatgtaatacattgtaaatgctgtgtaaatagttgttataccatattgtttttaaattttgtatttttcaattgttgtattttttagttttaaaaatttacttattttttctactttttgatccacggttggttgaatccaaggatgtggaacccttggatacagagggctctatgttttattataaattggcttattttaaaaaatattttttattatgtaaacaggcaatgattttactagctagaagcaaatttaatgttttaaaataaaccttccaattttgttaggcatgataatgatggaactgaggcttaaatataccctatggcagcagttggaaagtggccgaattagggttggggtctagatctgtctgcctctagattgattgcaagttcttaacaattactgtttattcttctctgattcctttcaaggattaaataaagtacaatgtaaacttcatgctctattttagattctggttctcatgtgagtcccagaataacttgagtgaaatgttctgatacagagcagaatagcctcttgtgctacacttttgttaattattttcaaagaatagtctcctgtataccatttctttaatagactcagaagtctgtagaattgaggtgattctgttgtgatttaaactacatcatgctatatgtttccaatagatatttgaaaatatcttttaaataaaccattaatgtcatggtttttaaatcagtatatctttggaaaaaagggaaaggtctaagccttaatttacctggctttttctggcttttatagtctggtaaattttgcagcctgaaaaagcaagagaatctataaaatacttgaatgagatgctggaaaatttcagaacaggttttgttttgaactgtcgggtcactgtagcccccaaagcagggcatgatgtgttcctgcagcctgatagctatgtgacagcacctgtagtactaaagccaaggatgccaggtggttctgttgcctggccacaggaagccagcgcttctcaccattgccctttgaactgttgatccagttaagctcactaacaatgtgtaaatatgaaatttaatcaattgcttgattcattttcaaaagatgttttgaaatactcctttatccgcattgaagttttgatgattttgtaatatgtaagaaatggacttttcagaaaagtacaacttagtacttgagacattggctgtcaaagttccattccaaaacttccttttaagctctctttcccttctctcactgaccagaagttactatgaaatgaaataaaggtagggaaaaagggagaattatctctgagctgcccatattctggagagaaatgtgggagaaaatttttaaggtggtatactaaattagaatgacttcaaagtctatttctttatttattctagagatgagaacaaaataattttcagtaaaacttaaaaatatcatgaccagataacctgaaaatcttaactgtggatgcatgtctatttttattgggatttttttctatattaaaaatcagttgacatctgtttttagataattttttaaaaaactggattataaaatgaagcacttagtaaagctgatggcagaggttttagatcttttgaatacaggaaagtggtaagggcattataggtatgattcattgagctagagggcgttggtgttcacattttaaaaacataatcatgacttatctggagtcacatgttccattttattggcttccttcatatagaaaatatagtaaccagcactacatgcctgtgaaaaagtgaagcaattgtatattttctgggtgaaggaagtattctgtacattctccatgttttacatcatggtattttgaataaccatgcttccatgttcacatcaattttttgtttttcaatttatgcacagcacttgctctgaaatttggggactgagtacaccaaatacgatagatcagtgggatacaacaggcctttacagcttctctgaacaaaccaggtgaatattctgccctctgtcgaatcttagagatcttgtgggaggggggtatattttgaaagacctatatggggttgcttagtataattttgcctaggatgtttccttaatgtaaaataaggcatagcatttaaaatatctgcttgccagtataaaaaatatattaaatgtttcagctgatgttttaatcaatgcaattctagtttgaatcttctttaaattactgtatcccctaaagaataataattttgataactatatatttattttagcttgagatcagattataatctgttgttggcctaatttttaagtagatacatgatgagttttgctaaatttcttgttatcagaatctcatctttatactaataaatacatacttaatgaaccccttatatcacaattaacagtaggttaactcatttttatgttactttttttaatcacttcattttcttttttgcgtatatggtatttgttcatttcatctcatcatattcatcaccatccacatttatttgtgaactacataaatatacctcagttctcaaaacagtcacaactgggtaaagagttgcagtagtctgaggaagttactatcacatcattgttggtatttatcattcttcacactagttccttttctgactcttcagtcacctccagaattaatatccttagaagcatctctaaaatgagtttgatttactaaacatagaagttgacaaagtttttcaagtataactgcataaactctcttttttaaaaaatcagtttttcccaagttgttagcctttcattggcatttgagtcatttatgtgacatatttataagaaacatctgctagtgctgctgcatacttttatcagatccattaaatagtacatttttgttcttgattctcactaaaactaactaaatggctgtcattcttttctttatgcttttattgtactaatttagcccatttgactgcacttttttttttttttttttaaagttccctcctttcttttccccttgcttcccaacaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccaggtaggaatattgcaagtttttttcttggttttgaattaaatgcctgaacttcagtatatttaagtactcttgtgacccaggaaaattttagtgtaaattctaataaattaccttaaattgtgcatattatttggtggtaattaaaatttttttatttttaaaaatttttaatgagaaaacatatctgtttcttggaatagcatatgatttggcatgaaagtgcatatccaggaaatcctgtagattggcagtctgctcagcgctatgctgatgtgcttctacatgtccctgctgcagtaacattttcaagcattttgcacttggagtgcttttagaagtactttaatgacatcatttgtatgtacaccgtttagtaaagcttgtaacaagacttttcatttagttagctgtctacctgaaactattaaaaaatatagcagtagctgcgtttttggaaaatttcctatatctgattttacagataaagacaatgttaagttttccaatggggatttatgaacttttatggtaatataatattaccaggatcacattgttcccaaaagtttgagataaattagaacttggaaatttggataatagactacctaagttagagccataatcagatttgtcattttctcagtaactagtatatatcgagtaggtggaccctagctttaaaaattaagctacaacttctcttcttgttgaaaactttaaaaaaggttcccccactcccctttgctctttgccattaacttggatttcttgaactttttcagttttgcctccagtattagtgccccgacacaccgagatcctaacagaacttccgcctctggatgactatactcactccattccagaaaacactaacttcccagcaggaattgagccacagagtaattatattccaggtatttttgccttctgaatctcctaaaacttggatagatacaaattttgttcataagcattcaagttttagtaaattgtggtttcacttttttaaaaatgcttttgagtttttaatagaaaaattggattcgttgggtgattattttgtgaaatgtataagcctagtacattaaacagttttgtttggagaagagttttactttatatttcattttcttttgcagtgactttaatcaaagtactgtgagaagcagaaaagaaaagatcttagtaagtttgtcttagttgttgaagctaagcgagatgcagaatgtaagcaaaacaaatggtgtaggagaaaagtaccccccaaacacatgtaactgaatatccacccaatgatcactttttcttagataacttggtaatatttaacagaaatataacatttctataagaaatataatacttagttctatagacatagcaacacttacatattataacacgaacgtcagaaaacctcctttaattatgtttcgtctgcatctcagtaatttctgatgaaaattgaattcagctacatggttctcaaattttgttctgatgtattatgtgatccagtaatactccacgatatgatatctggccttttcgttttttatggtttcttttttttttttttggagaacaactaatactttgttacttttcttgtatgttttcctttttgtttggttgatttttctccctagcagaaacagcatgatgttaggatgaggattaagctgtagtgtctcgatttctttcttccttttgtaatattcttttattccactcttattttatacactaaaaatatgtaaggaacttaagagcatttacaaaattcttaaaatacagttttagtacatttaaacaattatttctttcatgtatccatcatggaaataatgcttattcattgaagataattttttaaatgtaaggaagaaaaaaaagaaaagataactaagaaagataagttttttttttaaatagctggttttacaaatgggaagtggtttttgattgttttaatgtatatttctttgattactgttttattccagaagaggatttaaagctgctttatgggttgctaggaaatacaaacttactgaagttaagagagggagagggtgggatgtagtatgataacactaggaggagggaaaacccgggactatgaaacagggcaattgctaggtagaaaagggagtggagttgtgtgaacgttggtgtggggaaggggaggcattttaagtcgttagtgtgggaattactgttattcagccagcaatactaaccttaggtataaacatgcagtcttagggacaacacgcatatccagtaattatttggaaggctattcaccagaatgtttagtggctttcacttgtgaagatgtttgggctcatttttcctttcttttttattcctttaattattgagatttgagtattttataaagtagaaaatcagaagtggattatacccatttgcttttctggacagtggggctttatccggtttcaagcaacagcaaaaccaaagggttcacattttattccacttaaaagaaattttaacattttctcaaaaatgctaatagctttattatttattacaataatggaaaaaataaacacagtaagataacgtattttaaggttcagcatttctttctgattagatctttgaaatacaggttaaactcaaaaagcttagcgccgtttaactttattagctttaacttttaaaatatgcataatatgtacccttatttttatgttctttgagtatatgaagataatttattcttagaatttttgttttaaaaatttgggggtactgacacttaaatgaaaagtttgatacttaaagtttgtggttagtttattgaatagatattgtaaaaggttattgaaggagacccttaacctgtatcttctcttcctctttttttttttttttttttttttttgagacggtgttttgctcttgttgcccaggctggagtacaatggtgtgatctcggctcaccgcagcctccacctcctgggttcaaatgattctcctgcctcagcctccctagtaactggaattatagggatgcaccaccatgcccggctaattttgtgtttttagtagagatggggtttctccatgtttgtcaggctggtctcgaactccccacctcaggtgatctgcctgcctcggcctcccaaagtgctgggattacaggcataagccaccgcgcctggcctcgttcttttgataattttaaaattgtttggatatgtgtctttgttatcttgaatcgctcaaaactgttcagtgtaaatgtaaaactgatgaaagtcttctgaacttatttttcctccctggaattacagttgattaaattgtatacatgtttttattttacatgcagtttattcagctattcagatacctttctgaacataagtgttttattcagacaacatgttggaaataatatattagaatcctaatggttattttcagggagcattttacctctttatacagtagtctatatttgaattgaattttctgcttcaaacacttagactttaccagttaggaatccttggagaaacacactttttagatagaattcagcctggaccaatccggaaccatactctaccatattttaccctatagaacttagtgtaagttgtaagcctgtattatttaatacttttataatccaaaatcttgtgtgttttttaattttctaagtactcataaaataacgatgttcattagattaaacaacaacaacaaaaaattgtagttactgatggttttgcagcctactgattcagatctgaggcatttttaaagttacgtttttggctcttgccccagaatatgtacatataggaatgagcaagatacgtacataatgtgtatgtccagagagtaggattttattaaaagtggatgttaaggattcactgcaaaatttggacaagatcctgaattatacaccctcagtatgcaatattactttttataatattatataacattattatttgttatttggagtgattcattggttatctctggtagctgagagaaaaggtagtgagattatgttgcagctgtgcttgatttgttttaaacttttgtagaaacgccacctcctggatatatcagtgaagatggagaaacaagtgaccaacagttgaatcaaagtatggacacaggtaaaaaaaatgtctttgaaaattcctcagttattagatatacatttcttgtattgtttgaaattcacaaaagatgttactcttaaatttagagaagttgagacgcataccaaaaaagatgatcttctatcttgatttaacatatctgaactaccaaagaggtccatgttgtcactgaaaaattataacgtatgctactctgcagaataattgttattttttattagagtaaatgaaaatttgaaaacatgcacatacttttatttctttttaagtatttgcttctgttgaaaattttagtaaccctatgactaagtatctctctgtgataaaaaaccataattactcaaataacagattttcagaggaatttgggggtgaaggatggggatcagcttttcactgcttttttaacctaatagtgagttttgaattatagtagattaatttcttatgcttagctatcaactccaaaaagtgatgaagaaaaaaattaaagctttaaatcacgtcttacgtaataaaatgtataactcagcagaactaataaactaccagtgaaatcactttgatgtcattgtaattgtccagtttgattcattttacctgtctgtatcttaactgttggacaccttaatatcacaacctgacaaattataccatcagtctttctccacatcttaacactaatgcattcttggttatgataatctaaattatttttaagtggattaacattggtgggggagggaggggttacaataattctcttgtttaaatccgtttttttggactcccaggtaaagaagtttctgctgtagctaatcatacatttgggtgtttaggagtaccagataactaagaaaggtagataatctaatgaacgttggaaataacgtgttatacatcttaatgcaaataatatttgactttccacatatgttttactaaaattagatgacactcttcttgaagcaataatattcttttttgcctgtgatggacagctgttactgtgacatttaaaagtgaatgatgggaaaagatactgaacgtcataaaccacagtgagatactacctcacacctactagatgctataatcaaaaaaggacaataacaaatgttggtgaggatgtggagaaattggagtcctcatatatcgctagtaggaatgttaaatggttcaacactttggaaaagtttcctgttcctcaaaaagttaaatacagagttaacatattgtggccagctatgtatccaagtgaactgaaaacatgtctactcaaaaacttgtacatgaccatttatgcaggcattattcttaatattcaaagttagaaacaactcagatgtccatcaaatgatgaatggatgaataaaatgaggtatgtttctgcaatggaattattcaaccatgtaaaggaatgacagtatagcatgacgtgtggcaacatggatggaccttgaaagcagtatgttaagtgaaataagccagaaaaaaaaggctgcagggattctaatttagtgcacagacacctattcagcaatataactgaaacacaggaggagcaataatacaagtattcgttatgtatgataaatgaatcaaagtacaaaagtggagaataagctgaatcagccagctaaaataattgcagtgttggggctaactttgaacccaacctaatatttctgtttcagtggagcagtgttactggctttctgaatgacaggtttaaaaattactgtatggcaatgggaatatgtgattcatgagatgccaacagttagtttggctgccagcctcttacccaatatcagtttctctcttggggccatggcaagaaacaattctgactgatgcagggctccaatttagaacaaagttggccacctctctaactctggttcataccttccagaaggaaggacataattaaattcatctttcataacctgctgttaaaaataatgaattgaaattttttaaaagggcaaccagaggataaattaggcataataagtaagtgtacgaacaagcacttgttacttttttctttttttttttgatttagattttgctggtcaagactttattcttcctttatagtggatattagagatcaggctggacatcgtaagaaatttataagttcgattaacctttgtagtattgtataatcagtcccttttcaagtcatgatttttatgaacatatttgttcaaacaggtatatagagaaatagaatataatagatcataagatgtggatttcataactcacaattcagttttgtatcttctacatacactgtgcttggtccaagatacacaaagagacttaaagggttttttaatctgcctgtgtcccagaagataaaatgaggtgctaacctccaatacctcagaatgtggccttgtttgggagtagcatctttgtaaatgtagttgtttaagatgaagtcatactgaagtacgatgggccctaattctatatgactggtgtctttataagatagggaggaatgtgctatatgaagatggaggcaggtaactggagttagcacctgcaagctgagcaattcctaggattgttgggaaacccaaaagcttaagagaaaggcatggaacagattctccccttgagcctttgagagagcatggctttgctgacaccttgtcttgggacttaggtccttcaaagctctgaaaaaataaatttctgttgttttaagccacccagtttgtggtattttgttagagcaagccctaggaagctaatacagtgagtattaagattttgagagtatcctactaatatgtacacttaattatttgtaagttatatacaggtacttcaagtacatttaaaaatatatacaaaaattagaaattgaaggatgagattaaataaatagaaaatacattttaattttttcttcttgtaaactactagttttttgtactcctagacagttttcccatacactccacttacaagacttactcctcttaactaaatgcatataatcaaaatagcatagtgagactctgagctagactatctgagtttgaaatgttcctcttacatatgctagctaggtaacctagtttttaaatctgtaaaatagggacaataatagcatttaactcatagagtattaataggactgatatttataaggcatctatgtgttctaacctgtaataagcactgtatgaaggtagttaaaatgttaagaggagttaaccattaagaaaaaggaagatagtggattgcacaaagatgtgaaggaaagtgaagaattgagatccagacacagaagcacttgatttttgtggtttaggatcagctctataaaataggaaagtaagatttttgtcaaaaatgaggggtcaggtttgacaacttcaggataatagtcttataacaatgccttttctctgccatgtgttaaacagtttttgatgtagatgtatagcatgtctttcattagataaattttttagtattttatacttttagtgctgttatacgtttttgtttttacattttattttccagttgttcctaggatatgggaaatacttgatttttgtatattcttttctcctgcattcttgttaaattgactttttggttctagaattctgtagattcttgaggttttctgcatacacagccatgtcatctgttgataaggacagtttttttttgtttgattgttttttgagaaggagtttcactcttgttgcccaggctagagtgcaatggcatgatctcagctcactgtaacctgaacctcctgagtagctgggtttacaggcatgcactaccacgcccagcttatttttcgtattttagtagagacggagtttctccacgttggtcaggctggtctcgaactcccaacctcaggtgatccacccgcctcggcctcccaaagtgctgggattacagccgtgagccactgtgcccggctgacagtttttctttttttccccagtcttcatgcttttttctttttctgtcctaactaagacctacaataaactgttgaagctataagaatggacatttttgcattgttctgattataggaagaacacatttcacaattccccctttaagtatgatgttaattgtggatattttggagattgtatctgattgaggaagttctttttcctttttgttcttaatgttctaattgtgttttataaatggctgttgaattttgtcaaattttttttctgcgtttataaagaggatcatatagtttcatggatttgaattgttttatttttgagaatttttccatctatgtttatgagagattggtctgtagggttttttcccttgtaatgtgtttattagttttaatatcataaaatgtgttggaaagggctttctcctgttttctcgaagagtttctttaaggttggcattatttctttcttaaatttttgatagggctgggcatggtagttcttgcctgtaatcctagcattttaggaggccaatgctggagaattgcttgagcacaggaggtcaagaccaacctaggcaacaaagcaagaccccgtctctacaaaaaaaaatttttttttttttaaattagccaggggtagtggcattcacctgtggtcccagctacttaagaggctaaggtgggagggtcacttgagcccaggaggtggaggttgcattgagccatgtttgcgccgctgcactccagcctgggcaacagcgagaccttgtattcaaaacaaagtttgatttttccagagaaaccatctcttgtaggaaaaggttttttaaattgagaattatttacatttttaattttgtgtatgtgtttgataaacttggattttgttagaaatgtgttcatttcatttaagtcataggattgattaattgagacaggatctcacttcgttgcccaggctggagtgcagtggcctggttggctcacggcagcctcaacctcccaggctcaggcaatcttccccactttagcctctcgagaagctgggaccacaggtacatgctactgcacctggctaatttttgtgttttatttagagataggatttcaccaggttgccaaggctggagaatgtattgatataaagttatttctgatatttgttattcctttcatatatgtgagatccattttaaaatttataatgttagtaatttgactttttaattttttattagaatgtcttgtaatggattaatcagtagtctttgttgtctttgtctcttttctgttttgtttgtattcatctttttgtctgcttacttttcatttaatctggtcttttctagcctcctgtggtgtacatttagatcattgatttgtttataatgtacacatttaaagctataaatttccctctaagctttatgttagctctatattacaaattttatgttgtttttaaattatcacttattttctaattcttcttgattcatgagttatttagaagtttgggtttttcttaggagtgtgaggattttctagatacttcatcaatttctaatttaattctgttaacagtccagcatatagtgtgtgtgactttagtccttggaaatttatgaaaattattttatgctataacttgtaacttatcttgataagagttccatatatagttggaaagaatgtatatactatagtgttccaaatgtcatttaggtcagggtggttgatagtgtttacatcttcttaattctttatgattttttaaaatctccttattttgtcagttatgataagtgttaaaattttcagctctgattttagagtcatctgtttgtgcctttagtcctgtcagtttttgcttcgtgtgtctttaacctctgttattagatgatacacatttggaattatacatcttccaaattaatttgccctaattataaaatgcatttcatattaacatcaccatatcttctttcttacctctggttacatgatatatttttaattgtttcagtctatccgaatctttatatttatggtgtgtttcttgtggacagcatatttttggttttatttaatctaacaatttttgtcttttagttggaaaatttagtccgcttatatttagagggattattgatactggctttaggctaccattttgcaattgtttgtctatttgttctctctggtttttatctgtttgttttcctgccttttagactaatcaaataatttttgtttcattctgtttactctcttggccttttaccagtaacacttagtattattttctcagttggcattctcgtgattacattgtacttatgttatacctagaagtttatttaagttgtaatattttacaacgtcatgtaaaatttaagaactttacaccactctagtttcattcatctacttctgttgtttgtactattattgacatgtattttacttaataaaaatatataaaccccaaagttcagtgttattttttgcttttgatatcaagttgatttttaaaggaaattagaagggataaaaagaagtattttatattcacctacatatttaccagtttggctcctttttgctgctttttattcctttactacagacatttctttcagttgttttagcaccattttgcagagacattcctttctccattgatttacattggctcctttgttgaaaatcaagtgataatatgtatgtgaccctgactttgagtctgctcttaatccaattaaatgaatttttcatttcagatcctttattttttagctatataatttccattttaaagtcttcgataatttgtgtccagttaatatgtaacatggcctgcttttgttgactgttttatctcttgattatggggtcatttttttccccctccatctttgaatatctcttgttttttaattggatagtgggtgttgtatatataataatattagagattaaaatagataacactttctttggaaagaccaactcttttctctatttgccaagttgaggagctgatcctttccctgcccttaggatttgagttggaaaggtgataatttggtgctttaatgtcacatcactcaggtttcagggagggtcagttccctaccttatcagaactttcagatacaaatatggcaagactgcatattcttatttctttccagccttgcccaggacttcctatgctaacatgtactcagctaaagacatgtattaaaactgactggtgaagaggagctctgtgcttgcagcttcttcgattcctgtcgtctgtgcatggccattgaaattttagttggcttctcctttggcaagctcagtcctttgtctgtgtcctgacttggcagatgctgtcagtagtgaaagtgattaccactctctgttaactggggaggagctcatccctctctgtaaattagttcctatggacttatttggatctatatctgtgtgataactttaaagaaaaatagaatttttctttgtttatccactgttttcttactgctatttcagaagcaaaggttttccccaatcttctacatactaactataaggggaactctgtaggagtttctaataaaaacaaaagcagccttttttctcattatgaacagaattatgctctcatagaaaaattggaaatatgtaaaacctaagatgctatcgcactggggattaagttttttaaaacaagaaatgaaaaaatgatcattcatgcattatatatttcataagctgaatttgatgattataatgttgtatcactttggcagggaagcttaatctcttatttctaccattattctgtgtcagataaaagttaaacagtgttctacacataagattatgatacagcatttcaaattatacaacaaatggatgttcattataaaaaattagcatagtcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaaaaattagcatagttaggcaaaataggaaaacttaagcattatatgtaattgcatctagcaaaaaattaaaattttaaaaggttcaacttttaccagaaattaaaaaacaatgctgtaatgaacctcattaaaaaatagctagaaaatgacagagaaattcagtaggatgtcagattctagagttcctgttcttgtttattacactatatgtctggctggttttaggtgacatgggggagaagtgggtgcttttgatacatattgctgaggcttagaatatgactagtgatcatatttgggttaaggttgaagaagcaacccaggatgattcccagttttctggaaggtttgtgaacactttagtctgtattcagtaaattagactttttaaagcatacatttttattgtatatgtttaaggtatataacatgatatttggtgtatgtagtgaaatggttgctgtagtcaactaaatccatcatctcacatagtcacctttttatgtgtgtgataagagcacctaaaattgacttactaaatttccagtatacaacacaatattgtaactgtagtcctcaggttgtacattagatctctgggcatatcttacatatctgcaactttataccctttgacctataatctccctattttccccccaacctgtaatcaccattttattatgtttctatgtatttggcttaaaaaaaaaaaaccccacatatgagattatgccatgtgtctttctatgtccacctaatttccttggcataatgtcttccagattcatccatgccaaaagtggtaggatctccctttttaaggcaggataacattcaattgtgtgtataaccctccatttctttatttattcatctgttgatgggacacttgggttgtcttctgtatctttgctattgtgaataaaagcagcaagagtaaaagcaacgtgccacataacaagggagtcttcattagacaatcagctttttcagcagaaagtttgcaggccaggagagatgggtggtgtatttaaagtgctgaaagaattaaaaaacaaaactgaaattagccgggtgtgttggtacacacctgtggtcccagctactcaggaggccaaggtgagaaaattgcttgagcctaggaggtggaggttgtagtgagccaagattgtgacactgccctccaacctgggtgacagagtgagaccccatctgaaaaaaagaaaaaagtacccctgccaaccaagaatactataaccagtaaagctgtccttcagaaatgaaggagaaataaaaaatttttcagacaaaagctgagggagttcatcagtgctggtgtggtgaggatggggagcaacaggcacactcatttattactggtcagaatgaaaaatggtatagccactttggaagacagtttggtgatttctcacaaaactaactatattcttaccatatggtttagcagtcttgcttctccttggtatttacccaaatgaattgaaaacttaggtctacacaaaaacctgcagattgatgttcatagcagctttatttataatttccaaaacttggaagcaaccaagatgttttaataggtgactagataaataaactgatatatccaattaatgtacaacaggtcctcaagtaataatgtcatttcgttacagtgttgatgattggggaatgttggttttgttgtacaattattttgcttaagtcagtttccaaaaacctatggaagatgttaaatgaagacttactatatatgacattctggagaaggcagaactatggaagcagtagaaagataagtggttactgaggctttgtgggaggtaaagaggactaggtggagcacagggcatttttagggcagtgaaactactctgtttgaaactgtaaatggatacacgtcattatacatttgtcaaaacccagagaatgtataacatagccctaatgtaaattatggactttcagtgataatgatgtatcagtgtaggttcattattataacaaatggaccattgtggtttgcggatgttatagggaatttggggaagcagggcaggggtcatatgggagctttttgtactttctgttcagttttgctgtgatcttgaaactactctaaaaaaaaagtcttttttaaattaaaacaatttaatgtcaccttaaaagatataacagattttttttaaaaaaaaacctgggtgaatatttgcaaatagatgacaagtctaagaactgatttttaagtttaaaaacttacaaatcaagaagaaaaagatagttaatagaattggctaaaagaacagaaatacactgtttacaacaaaaacaagaaattaaaaaattgctccttttaaacctatcatattggcagatgtcaacatgtagtgacacggtgtgaagaaacactagcttataaattcttagtgagatgaaacatttttgagagggtattttggcacttataaaagtttaacacattttatttgacatttgttaatttgtcaaaggtttgacgaatgtatcctacaaatatatgtgaatttgtatgcgaagatacatgcacagggatttctgtagatggtttagctgtaagtagacactgctaattcacactggatctcaaataggatatttataatattctaagtggaagacctgtggtaggtgagactccaatagcagcatttatgtatgaataattcataggctaatcatcagttcgttgcctctggtttttttttttttaaaggcttctattaattgttagcttattttaagtttttaaaatttgtcttttttgtaatctgtaattctaacctgtcacatctgactgaacgcctgttaatttaaatgatcctactggtcatttctaagtatttaatagaggagtaaacagttaaaagatatgaatagttgggcagtttcctccatttctaatagtggctttgtttattttatgttggtttcaggaaacagcagtgaattttagctcattgttccaaatatgttttgacctatcttagttgtacctgttgtgacttgccagcagatttgtgacttgccagcagatttgtgacttgccagcagatttttcaaactgagaaaaaaggaacataacttaattatgttgtggaagaccgtactgtcttctaaaaactaagcatcccttctctgattcatttatttatctaggggctaccatttcacctttattgcctggtattttatgtcatggttataatagtgtgtggtagggaggaggtgtgtaagatggtctgacctatcttactcttttttttttttccctctcgagacagagtcttgctctgtcgcccaggctggagtgcagtgggatgccctcagctcactgcaacctccgcctcctggattcaagcgaggcgacctgcgactccttgactttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccattcttctgccttagccttccgagtagctgggattacaggtgtatgccaccatgcccgactaagttttgtgttttcagtagagatggggtttcactatgttggccaggctggtctctaactcctgacctcgtgatccacccacctcagtctcccaaagtgctgggattacaggcatgagccaccatgcccagcctgacctatcttattctacaattatgctcttggtatacatttgaagcttgggtcatgctcttttaggtaactgtgcctaaacgtgtagagaatgatgatcataaaagaaaatatattttatatttttaataagattatttaacaatgtttatagcaaatgtgttttaaaattgagttgcatggaactgagcagactagttgcgccatgatttttcatatgttgtctgtggtggttcttattttgtatgtttgtgcccccttattttcttgattagatttagcctgtttacccaaaagaagaaacagatcattttctaagaaagtgtaatttaccagaactgactccagaaaatagagctatctgaacaagtcacccttcatagaataatgtctcgtagtaaaccctagaaagttactaactataatttcacagaagaattctaccaaacttttaaagaatatgctgttataatactatttaaacctttgcagaggataaagctgctagattgtcataacattgaccacagagccttacaaacatagcactcatgtaaatcttcaggcttgtattgcttgagactattgatgcaaaaatcctaaataaatattttattactgttagcctgaaagccaatgccatgcttaatgggaaaatggtagaaacattaccctaaaagtcaagagtaagatatccaccgtcatcactgttttatcccaaagtgtgacgctaacccaaagatgattgataaatcttgtagaagggcttttattttagtgctacatgatcaaaattaggattaagagtcaaaagaccaatgattaaatatttgtagctcataccataagaagacttacatccctaatacacataaagagctttcaaacaatcagtaagaaaatgatcaacatcgcaaaagaaaagaacagactatcacaggaaggaaatataatataaacatgtgtaaagctactcaaaattaaaactgtacttgtgaccatgttttcatctagaagcaataacacctcaagcatccctttactatgttgtgactgggaatgtaaactggtacaaccttgatgaatgataattttacccaaatctatcaaaattgcaaatacacaaacctttcgacctggcagtttcttgaagaatgtatctttcagatgtgattggaagcgtgcaaaacggtcaagattagttattgcaatctcaaagcattggttcttatagcaaaagattgaaaatagcttgaatatccatcaatgtgggatcgcgatgttatgtgactaattgatatgtagatagacaaataaggaaacacattgtgaacaatctgatagaataatatagaagatgaaaaacggttaccacttgtatatgaaaagaaaggacacagaacaaaaatgtatttgcttatgtggttcatagagtattttggaaagatacccaaggaaccgtcaatattagatatctttgggaagatgaactgttgggctagaagccaaaactgttgcaccttttatactggaacccccccttctcttcccccgaccccccacaaattaaactaaatttaagcacttacatattctgaattcttggtatttaaattatctttgtattattgttgataattataaccagataaagctagttttatgattacttgatcagaagttctggaaatacttcatttatttttaaatccttttgttttaggctctccagcagaactatctcctactactctttcccctgttaatcatagcttgggtaagttgcacatatgttcccctcatcatttttatactgtatcacctacttaataataaaaatcatctctaggagttattttttatatatccgagaaagggatcctaatgaatagccaaataattatgtatgtggttaaagtagtgctttttaaaaagaatattgacaccatccctcaaaattattaagtcttttctgctggcacatataagaaataggtataatctatttattattgaaatcatattcctcatagaaaattatataacctgttatggctagatttttatggttatgtttattttatgatgtaattaataaaaggtatgtgtattacatatatacacattgacataaatatgtatacatgtatacgtagtatggggatttatatatattatacataatatatataatatatataatatataatatacataatatatataatatataatatattatacataatatatataatatataatatatattatacataatgtatataatatatatataatatataatatatattatacataatatatataatatatatatagtatataatatatattatacattatatatataatatatatatagtatataatatatattatacataatatatataatatatatataatatataatatatattatacataatatatataatatatatataatatataatatatattatacataatatatattatatatataacatatattatacataatatatattatatatataacatatattatacataatatataatatataatatatattatgtataatatataatatatattatacataatatatataatatattatatatattatacataatatataatatatattatataatatatataatatatattatacatattatgtataatatatataacatatattatacataatatgtatataacatacataatatatattatacataatatatataatatataatatatattatacataatatatataatatataatatataatatatattatacatatatataataatatatatatactatatataatatatatatgagagtgtgcacatatatgtacaaatgtgtatgtgtatggtcccttcataaccatgagttcagcatctgcagattcaaccaactgcagattgaaaataatcgggaaaaaatgaaaataacaatacgacagtaaaaactaatacaaattgtatttatttttatttattttttgagacagagtcttgctctgtcgcccaggctagagtgcagtggcgcaatctcggctcactgcaacctctgcctcctgggttcaagcaattctctgcctcagcctcctgagtagctgggactacaggtgcatgccaccacacccagctaatttttgtatttttagtagagatggggtttcactatgttgcccaggctggtctcaaactcctggcctcaaacgaatcacccaccttgacctcctaaagtgctgggattacaggcgtgagccatcgtgctgggcccaaattttaaaatacagtataacaaatatttgtatagcatttatattattaggtattataagtaatctagagattatttaaagtatacaggatgacgtgaatttaagttacatggaaatactacacccttttatgtcagggacttgaacatctaagggtttttagttagggggagccggtcctagaaccaatcccctgtaaatgccaagggatgactatatatatatatatatatatacatacatttctgtattactattattatttttgccctcattttaccctatttcacaatttctcttcggttgttacatgtttggaatttattctacaaaattgtgaggtttttttcttttgcagtattccttatgatatgttttagtcaaactgcagaagctaaatatatagttttccagtgaaataagtagtcttttgactctatggtctgtttctacttgcatgatctttgtgtgttactgctttctggttcttatgtatgagtgggttttctctttttgtagctagggtatctcaccaagagtttgatgttaaaatagacaaatgtcaaaaatatgtcatattttgtatccttttattattactgtttttctttgtgtggcttttgactcattaatctttgctctggctttatcttaccccactttagcttttttatgtgctttagaaatgcaccaagtatggcaagttgactgactttgcctatgattgttttgtatttgaacaggagctagactaaaactactggtaaaacaaagaatccaacataaagtgatttaatgacatgggagaaatttgaaaaaatctggtatgatctatgaaactggagttttgtgtgaaaaatactgaaaatctggtatcatctgtggaaaccgatacagatactatgtctacttcctgagcttttgccagtgcaggctggcatagagcatgtaaagatgattatattaaatctatttttggcttgaattgttcacgcatttcttccttttattatttttttatttttttctttttcagatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggtatgttttattttccttgttgtgaaaaataaatgctgtatactcataatgtaggcattgcatggtgtgccacatcaagagcttgtgtgcagtaaaaccagctttctctctggtggtttaagtgccgacacatttaagtgcacaggcttcactgcttctaatagatcctggtgatgcttcagctgcaaactcttcaacttttatttggcacccttggtactggaaagttcttcaataaatatgtgttaagataagtttaatttgctgagtctctaccagtcataaaattgccatgttcagatttgggggttaatacttttttataaatcatgtttttttgttttgttttgtttttgttttttttcagtttctttatatagctcccaggttttttccccctttggtgagtttatatattaaatgaaatctgcttgctgttcatctgaaatgagatatctaaaacaagaactgcatttaatatagttcaaaatataattcagggacatctcaaaatgtggtctggggacttctggtagtcccagaaaccctttcagctagtttgtgaggtcaaagctattttcatagtagtactgagatgctgtttgccatttctactctcatactctcatgactgtacagtggagtattccagagcctacatgcatatgattttgcaagagatgaaatgtagatttgataatgagactccaattctgttacactagacatgaatgttgaaatgttgccactctatttttttttttttttttttttgctttggaaatatagttgtttttcatagacaaaaatggtgaaatgttgccactctattttttttttttttgctttggaaatacagttgttttttataaacattgttaatatgtaatggatttgatttttaaatgaattttttaaatctcagtttttatatctaatatggtcattttccataatattcacataaacaaaagctctttggggtcctcagtatttccttaacgatgaagtgaaaaagtgtgagaaccattcataattgaacatcattctcatcaccttaaagtaacttcttttaacagtagtttgcttctgttttttttctaattaaccattacctcctgtgagaagtaatgctggttatcaaagtgtgattttgatactgcaaaatgatagtgactagaagatctattacttggttccaagtggaagttctcaaatcttgcttgatgtataaatttggataatcttattaagatacccagtgtcgctgtaggtgctttaactaaaatagttttttgtttttgtgacttaattggggttctgcaaaaaaatttaatgggttttctctgccttattctcttctccctccaaagttttagattgctgtcgttattggatttttttaaattttttatttctagttttataggtgatattgatcagggaatatagcctgaaaaatctctactttttggacttagtgttttcccaatgaccacgtgcatgactgttttacagatattccatagtcttaacagaaccaccgtaccaggttctgtattaaatctggagtgttagttgtttgattagttttcttttgctgtgtaacaaattaccacaaactcagtggcctaaaacatcagttttttacctcacggtttctgtgggtcaggagtccagacatgggttaggcggtcttttcagggtttaacaaggccaaaattgaggtatcagctggcttgtgttcttatctggagcttgaggtcctcttctaaacccacatggttgtggcagaattcagctcctagatgcctcctgaattccttgtcacatggtgccatccatcttcaaagtcagcaatggagaatgtctcttgtgttgaatacctttcatgctttgaatcacttagcctatgacagtctagtcccttttaaaggattgcctgattaaggttaactgatttgctgccttaattacatctgaaaaaatccttaacagcagcacctagtgtttgattaacagagaatgtatgtgcacctcagggctgagactcttaggtgtcatgttagaactctgcttctcacaattttttttttaattcttatatctcatattattttgcatctgtgatctctcagattctgaaagaagtatattaaaaatctcccagtagaattttttctcacctaatcatgcttatacatctagaggttgggtttccaccataatatatagtttttaaaatggcaaatgactttttgatgtttttacatcttttttcttaacattaagtgggatctctaagaaactacagttgtaatgaagatatatttctccaaacattagtgaattccttcaaaattaactcaatcttttacttatcttaatatatatcatttgtatgaaactattttactatgtgtactttttctacattgtttaaatactttcagtcagtacacatgtattttaaaatcaataaaattattgttagaaaatacttgggagaaatatacagtagtatatttaaagttagacttcagaaagacattatctgtgaaaaagatcctggaaataccttatatcattttagaatttttccaagaaaatgcttccaaagtcacactgaaatagtaaatgttacaaaactaatctcatttgtattttgtttcaggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggtatggattcaataatgtacataaacctatcatgtcaacttgcttagtttttcttgttgctaattttaggaatcagtagatgattgcatgctcatattctaaaacttgtaacccttttaaaattactttttaataatgatactcttttgacaatttcttttaccttttttaatcataggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccggtatgaaatacatatttggttcttaaatttccacagtgtaattatgtttcattgcattcttgcatattctggagttcatttgtatctattttcaatgaggttatagagtcagctgatctttatgtaaaataaagttggaggcctccaaattcaaaactgttgcaaattactgagctgccattatggaagatattaaaacatgcacaggcgtgcattttaacgtaattcagagtgttaaatatcataaaaggggtgtatatgaagggttatgtcagtttatggaaggagagatgtttgcacacggtgctcaaggaaaacttgatggcacatgatctagttgtaaaaggtgcattggatttcaatagtcataaatggggtgggcagagttgggaagtgataatcttgacaatagcatagcaattcagtttggagaatagaaaaataaggctggacaattaaattgagacaaactagatgtaggttaagaggaggaacttcattcagaagtagaaggaatacttgctaatgtgccaggcactgtgctgttttaagtgtagtatctaaaaattattatttctgttgtcaattcattctttgtaaggttgaaatatatgaaattgccatcgttgcaggtaacacatggttcaaactaatacatatttggaaatagacatagaaagctgataatttgcccaaggttacattataagtggttgagatgggactggaagatagttctcctggactctttacctcttttataaggatagtagtaacaattatgtttaagttttacaaaaactaatttgtcatcagtggataagatagtctagattattgatgaattaaacaatagattggatttcacatcaaagagagagaagacttcttgaccatatttaagagtaggaattaagtaaaatacttagtctttcttcaattcgtattgcttactccatatgcctgcttaagaaatattcatgtaatatagtgattgtattcctgcttcttccagcaatttagtcccttccaaatttatttgttttggacttgcttgtctatcttaagttttgtcagaaatctgatttgagattgtgcaatgtgaggtctacttgttgaatacatttaaaaatatatggtatatatttgtatcagagaatgaagacttgtcactatttttttctgagttatattggtagaataattcattttgtgattttgctgtagttctgttttgattattacccttttgagatgttgttacctgttaagaatgctgaatgccgttttttaaaattagacttgacctgagttgatagcaaaattagatttaaattatattgtctaataagatttcaggtcagacttttttttgttcttcagaaggttagaataatgcaaaatatggtaggaatttagtggaagtaagagtgaattacagagagaattccatgtgtatctatagatctgctaagaacagttttacttggtaaagatactgcccttcttcattcactgtggactctgctgttctttaactcacagataaagtaaaatctgtaattacagaagcagtaatatgcagtatgtttttatgagtattgggagtcaggtacatctgactttggaaaatcaagtagtttcctgtaacatttacaaatcaaaatggcaaatatccatctatctgtggatatgtgggtagctaccaggaacttactgtctgtaatcattctggagctgaggaaatagacctaatgtttaggtttctaaaactattttttttaaatttccttaatgtcatcttggttgttagcacaaaaatgaggaaatgtagtaaacaggaaatttagatgtatgaagaatttgtatttaatcgagtggcagccttcttaaacctactccccttgggtgacctggattatggattattctagaaagggaagtgggacaggggagaacagggcagccaggaccattgttaagccatctaccagagtgggtgggtcactagaactgacacccttggggaaactctaggaaacagtaaacagtctacagaattatcctacccaggggaacagaagtgctgggcatgtaaatgtcaatttctgtttccttggttgagggctgctcctggggatgcttctttcctggcacctctagcctttttgggtatatcagagaagttcctgggcacagaaatgcagatacctgcagttggaagttgtctagagcacactgaaaaatccaaagggtacagtggggcactgataccatctgcctcagaaagtgacatccttggaagtacagttttaaattacattgaacatgtgttgcttggagatgaagagttgataatgggcttttctcatatttgaagggctgttagtttgtagaagcaagtggatttattgactttattctgtatagcaaataagatggaactaaaatcagcgcatggaagtgacaggatgtcattgaataatttgtaattctcttagagttgccccttttgttgaagcactattaaaagcccgaatggtgttgctaagagggatgttcattggctttggcagggaaagttgaattccagcttttaacactctctgtggtgtgggtttagcttgggccaaaattttgtttttgctttggtatacttttacttagattctgtttgatatttgagtatctactattctgtggttgatttggtaagtacagttactttatgtcttggtttgcttggacaatcctgattcacgtgtctccttttggcctgatttttttctgccccccaccccgagacagagtctcactctgtcgccaggctagagtgcagtggcatgatctcggctcactgcagcctctgcctcttgggttcaagtgactctcctgtctcagcctcccgagtagctgggactacaggcacacgccaccacgcccagctaatttttatatttttagtagagacggggtttcaccatgttggccaggatggtctcaatctcttgaccttgtgatccgcctgcctcggcctcccaaagtgctgggcttacaggtgtgagccaccacgcctggccctggcctgatattaatagtatctacattctctctcaggtgttccattttggatgatggtgaataataagatcaccttattaattttagtgcgatgagaaaaagatgttcttgtaaatcacttctaaaacaaggtcatcagaagtactttgactttgaggatcaaccattttgcggaataatcgtgtccaaaattatatacacaaccttttaatttctgtaaatttttaatgcagtgtacctaaacatagccattttccctgcctgtggacttgaatttcataatcattttcctgtattcttttaaacagaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtta

SEQ ID NO: 126 - DNA, 129336 bp, Homo sapiens
gcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtgggggcccgcccgggggggacccggggtcacgccggcccagccccctggcactgcggggccgacccagtggggctggagatgggaagagggagagagagggagggagtgagactgtgtgggtgcgtgtgtgtgagagtgggagagcgcgggcaggaagggggtggggggaccccaaacaaaaccatctctgatttgcaaagatcagagcccgaggcttccacgcggcactctggcttccacacctcacattccctttccacctccgggaggggagagcgggttgctgcgggactcggccgcccccactccggggagctggggctggaagttgaggcccgctttgttcggctccgcgggccggagcccctcctccgccgccgcctcccgcccccgcggcccgcgctcgtggaggtggtggtgtctttgcgtttcttttcttcagtcgggtctccccactttcctctacaggaatgcggtccgtacagctggggctgtgggtgaggagcgggagcctagtgattgacagattccttcttcgttctttctttgccttcgggattagcatttttatcgagtatttttagactcggttgtgccagtctcccgccccctgagcatgcacgcactttggttgcagtgcaatgctctgacttccaaatgggagagacaagtggcggaaaatagggtcttctcccacctcccacccccccatcccgactcttttgcccttcttttggtccaagagattttgaaaccgtgcagaacgagggagaggggcaggctgcagccgggcagataacaaaacacaccccaaagtgggcctcgcatcggccctcgcattcctgtagagccttccttcccaaagcgcgctgccatctgtctggatctcctttatccttcccgttgcgcgctagctaggtcgggcgggagcccacagatggctgatagaaggggtcagtgacttcactcccccagggccttccttagcttagatgtgcctggctgggaactgggggtgcgggtaccttggcttcctgtctctacctctcagcctcctttgatgctgaaccaagggagagagcgtgtgtgttgggggctggctcttttgggggtcccaggctgccgaggaatgagtagaaagcaccagggactgtcagccgcaaagggattgtcatccctgctcctgggccagggtggactccatccttggccacctgcttggggcagttgtacaggggctgccaggcgagtcaggcaggcacaaagcaacatctgtccacgggaaccgagggcaggcctcccctggaaataaatgccacatatggtgggagtgcggacttaaattttttttaactgggtggatccagtcaataaagggggagggaaggcggtgtgctgtctggggaagtctctgggcgtgtgatcgggagccagaattgacttcagaggaggtggtgtgatgtgatggtcagagagacctgggatttggttccagctctggttgttaattcttctgtattccttccgtgggggtggctagggtagagtgggtgagtatgctacttctctttctggggaggggtctgccaaacctaccttctccttatctgcctgggtgcattgaagacaagtgctttatgtattgaaacagaagaaaaaaagtggtatcaattgtaaaacaggcagctgtgaaaagtgtttcacagtttacaaagcactttcacatggttttctgaggtcctcaaaaaaagacagaaagcaagcaagcaaccagccatggaaagtagataaggttgttaggcttaagattatcacatttttaaagcagaggaaaccttaaaagagagaggtgaaaaggcttgagtcatagacatggggttctgcctgaatgtgctctttctgctgccccatgctgctttatactttgaagatcctgaatacattctttgctgaatgctaaagctgtgttagcttggggagggccctgtggatctttgtatgtgcggttgcttctttaatctttgggctggtgatagcttggcagagaggccttgctttcccttgccttggtaggagtttgtcctctgtggggccatacctttggcctgccttttcctcttccaaagtcctgctgagactttggaagcctaagacgtgtgaacgctttggatgattctgagagttcaagccaacctgccctgtggccttctcgtgactttgttaggactgaggcatcttctgcctgcctggataggactgaatacaaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagtagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaaggtgaaagagattggtgccaaggaagtggtaagagcttcatttagatacaccaacaaaggggctgtcaggatactctgaggtctggcaggattggcagaatttacacaagttttataacagcctctcatgcctcacctgcttgagtacctgagtaaagctgcaggtatcttccttgccagtttataagaatggaatcaaagcatttgccgctgaatgagagttggtgtgtgagcgttatatgaggaataaggagctcggcacacttaaaacttagttttctggtagacactggtagcttgtacttccaccagggaatccatgccttggcctcgttgttgggagctagaccaagcttaaagcattgcttgtttggaagggaatttgggctttcttgtgtcagagcacccagtccagtggaaaattggagaattgaagcaaacactaggtctgacacacagcatctactccctccctgtgaatctgatgttttttttttggagacagagtcttgccttgttgcccaggctggagcgcagtggcatgatcttagctcactgcaacctctgcctcccggttcaagcgattcttgtgcctcagcctcccgagtagctgggattacaggcgcccgccaccacgcccagctaatttttgtatttttagtagagacggggtttcaccatgttggtcaggctggtgttgaactcctgaccttgtgatctgcccgccttggcctgccaaagtgctgggattacaggcgtgagccaccgcgcctcaccgaatctgatcttttactgtagcctcctcttattatctccttgacttttgccagggtactctcactttgagaaaggaaaaagatcctagtctttaacatgccttttccagatttctggggatagacctattactaaggctgtagaggcctcccttttctcttggctgcacttcagagcaccatgcccgtgtggcccattggaagcaagcccccttccagctgctagggaggtggtccattatctctttgctcttgttaagtttgattaggggagttccacgtagggcctgagaagaggaggtgcctgcaggacaataggtagctgatgagggatctgactcagctgcagctgaacctaggcgccacttgacgttccctgggaacatttagaaccttggaacatgctgcttgcacctgggagtggaatgtttgcagacagcccctctgttgttacagggctggattttgttgatttattgatatttattggaccctcccatgtctgagtcaattttttaggtaccagaggaggatgcagagacacgtttgagaagctcccagcctgtgagaagcttacacatcagtaagggaaacatgaatagggcattatttgagtatctaactgctatctctttctcattcccagctaccagtagaaatatgagatctagtatggatgatttttgatgggggcgggcgttgatgtgccttttaaatattgtagaattcactatgttaggaaataaaataatgacaggcatctgtttttttctgaaaaaaacacaaaattcaggtcctgtacctgccattttaccacctgcaaggatttgggaatccatttaagtttcacagcttttatatctgcacctgtcaagtcaggatgagataagttctgtggaagtgttttgtgaaccagagaatttgacaggtatgttacgtttatacttcattctgcatcattcattcattattgaattattcagtccttcgttgagaacatactacaatgaccacagcagggtccctgtactcaaagagctccctgtctagagcgggagacagacttgcccaaaggtatgaggcatgagctgcagctgaggaatgtgctaagtgcccagcaatgtggaaacacagttaattctgtgggaggaggtgtagagaggaggagaacccatgagaggtggaaaactaagaaggggacaagggttatccaaaggaagctttttggactgcagtatgatgttgggaactttttggtacatggggatagttccctataagaatgaggacgtctttatcctcttttactaaactgagtgctgctataaatatgttaccttgtaactggcactgaacagctagtgacttgggtgctatattttactccactgtaaagcattttctctttgaagtaaaaagtaagttagtactgcaaactgaaattcaggtttccttggtgggaacagggactttagatgtatcagctcagaatatgacagggagtgttaataaaaagtggacaacttggctgggcacggtggctcacacctgtaatcccaagcactttgggaggccgaggcaggcggatcacgaggtcaggagatcacaaccattctggctaacacggtgaaaccctgtctctactaaaaatacaaaaaaattagccgagcttggtggcaggcgcctgtagtcccagctactcgggaggctgaggcaagagaatggcgtgaacccaggaggcggagcttgcagtgagccgagatcgcgccactgcactccagcctgggcgacagagcgagactctgtctcaaaataaataaataaataaatgaaaagtggacaacttgcagatggttgttttgaaattcaaagcttcggtgtgacctagcttctcatttctctagttaacacttgctgagaataaatcctagacgcctgagtttctgaatgaacataggtgcttttagtggtatattttttaaaaagtctttgcaagggtgaagttttaaatgacaattttaataacagaaaaatatgaatacagtcgcatttaattctgatgagaaatgcaagaagttgatgaaattgaaagaatttgtttcaagcttatcacatcaggaatccaactaaatgagttaaaaaataaatattggtttaataatgtaaacatgtgattgctgtattattataatggaataaaattaacacgatttaatgaactgagcgaccattaatttttacttgttaatttattaggagattttaatgccatttgatgcacagtacagccattattctgcgtgagctccttaatgaaataaataagaccaagcagggcttgcttcaaattggaatcagctttcattcctgttaaccttattctcccacctttattcacctctccttcagcttcctgtaattgcaattaagttctctaagattggaatgcagttttcttaatcagcaagtctcatcaatagtcctaattgacttttgcccttttctcctttgccatattgactgattaaaacaaaagcaaaacttaaagactccattccctcccccaaatccccatctcatagtgttggttggctggcaagagaactgcccaagaaggctgctcatgatggcagcctgctgaatgtgcagggggtggaagttcaccagccatgtgcagacgtgaatggctggtgcagtgttggatgggactaactcctccctaaggaggggtatgaccttctgttggcctctgacaagtccctgagccatggagccttcagtcttcccatcttcaagcacaatggttcctggaaacagtgggaagttgccatcctaagcccaccctacagaagtttggtttctaattttactgtgttctaagctttagaaccgagacaattccaagagaacttgtccagttcatttttatgccttcctttaatgccgtaccaggtgctaatttctgtgccagataatgcggacaaaatagtgaataaggcagatactgtccctggtgccttctgtagcttctagtccactggctgtgaaacacaggttctttggagttgtaagaatgctgtatgtgttcactctttagctaatttgtaaatactgtttttttggtgccaaaccacatcccccaagctctgcagtttattgacttgacaaggatctctctctctctttctctttctctctgtataacataatcctttgtttcgacttaacagtttgagaaataaacaaatctatagcatactatccactgttggttatctaagacccttcctataaacagcagcctgccacagtggcaactgctgtagaatgttttggcagagactcagtttaaaatgaaaacacagtagaagcctattaattaagaagtttggctaattctggactaggcaaaagtttgtttagcaggcctttttgccccataaatgctgtcaaagaaaaattaataaacaagagtttggggattattttggaggtaggagtcagcagaccttggtaggttctagacgtggctctgtttctgattagctgtgtgacctgggacaagtcaccttctttgggcctcgaatgttctcaactggaaaataggctagataaactctattggagggcctttctaacttggaattggtattcatacaagcattttattttattttattttattttttgagatggagtttcgctcttgttgcccaggctaaagtgcaatggcgcggtcttgcctcactgcaacctccgcttcccaggttcaagtgattgtcctgcctcagccttctgagtagctgggattacaggcatgtgccaccacacccggctaattttgtatttttatcagagaccagtttcgccatgttggccaggctggtctccaactcctggcctcaagtgatctgcccgcctcggcctcccaaagtgctgggattccaggcctgagccaccgcgcccggccacatacaaacattttaaaagctcccagttgcacgcatctagttgatcagtgaatgacagatctttcttaattattgatgttccaagactctatcagcctggtgtcaattaatttacataagtaaaaataataaaattgtaattcagcctttaattttggtgatttccctccctcttccttgcctcttccttactctgtgagtctaaatcagtgaaatttaactacaaaggaatatgaaaataatgctaggatgaagatgtggaggctgtgcctcttgagatgcagtgaacagtttttcttcttttgttgctatttttgactattctaagaacaggaagtttacttaaactaatgaccacagatgcctaaaaatggttaaatgtaagaggtaggcattatagaggatacctgtggaaaatgtttgctcatatgtcaaagtttacccaggaagcttcctttatttatttccaagcatctatataaagaaaggctgcacttgattgcgtaagcatgagccttttgttaggcagcgtggatgttgcaagtttaaaccccaactaggaaatgaaaagtgagtttcctcctaaatagttctttttcagtatcacatggctctcccagcttacatctggcaagtttttctcttgagtgctttgccggtagtttaggactccagtattgtattgtattgtttgtttgtttctttatctctgtctctctctttttttgttttttgagacggagtcttgctgtgtcgcccaggctggagtgcagtggcgtgatctcagctcactgcaacctccgcctcccaggttcaagcagttctcctgcctcagcctcccatgtagctgggactacaggcgcccgccaccatgcccagctaatttttgtatttttagtagagatggggtaggactccagtattaagaaacactgtgtatggctttgcctttgaaacctacagagttatgaatctggtcccttttgctgctaagtgttgcatcacaaactgccaagccaagttgtaactctgaggtgtcaccattttttttttcttttcaactggacatttgaaaatagtaatgctttttgggtgtgtgttttttaaaggtctgtttttacgctgtcactgctcaaaaatgccaaaaggcattttttccttaaaaaatcacctctgggctaagcccaaatgtggagtaatgaatccagaaaggactttttgagtagttacaagtggctgaaagcaggcactggtgatggaaattgggtttttccttttgcttcaaatcttcctggttgtaaactttttcttacccttattgaagtcagactcaaggtgggtctaatttctcccagcccatgggaaggcagagtgaattactgcttgttgtgccaaccctttacattttgtgtgtggctgtttgtctctacccagacaggttcttcacatattacctggggagcaggagagggggaggacaggaagagcacagttgggcagaaagagcaaagcctctcaagtctgatgggtttgggtttgagtctgacagttattagctatgtggtgaccttgggtactttgcttcaacttattgagccccagtttctgcatctgtaaaatgaggatgaaactacctacttcatagaaatcaacccaagtggccgggcacggtggctcatgcctataatcccagcactttgggaggccaaggtggatggatcacctgaggtcaagagtttgagaccagcctgaccaatatggtgaaacctcggctctactaaaaatataaaaattagccgggcatggtagcgggcgcctgtaatttcagctactcaggaggctgagacaggagaattgcttgaacctgggagccagagcttgccgtgagccaagatcgcaccattgtactccagcctgggcaacagagtgagactctgtctcaaaaaaaaaaaaaatcaacgcaagtgagataagatgtatcaagtactttgccagtatcgatcataatacatagtagatgcttagtaaacgctcatttttcctttccaaggggaaatttggcagatgatgtccgtcgactccaataggtgatccccttcccatcccgacacacttgctcacagagcattctcctttggagagtctcagttgatataggaaaaggatctacttcaacacacacagagaacatacagacatgccacttgttgatgtaaggcttggcaggctattgaaagagaaacaattcatattcttaggcggttctgccctcccccatcaccttctctatcattattcttaaaaatttgtttggtcgactaaaaataatagtactaaaaacaaacttcgatgaatcaggtctcctggggcgggggatgggtaagatcctgaagcagaaacgcagtgactcacgcgcctgtcactgatagctgcccgtaagtgcatggaagtgcatgatgtttattgttgctggtgtttttttgaggcccaagttggaatgcacttccggctccccctcaagtactagcttactggttaggtgggctgttgagtgagaatggtcaggtccagaaactcatggctctgaaatgacccagacgtggtggctatacccttgactgccctcagatacgtgcaagagggagctcacgcttcaagagtcatgctttggccctccacctggctgtgctcctcttactggggcaaggagactgtagggccaagggacaggcccatctagagcaagcacttcctttttccagatcatgctcagaggcctgacccttccagttccctgcatcagtgtcttgagcctgtttccaagtcctgcgtgggcctcttccccaggtctgttttacttgagggcagactgtgttggccatggacagcatgtgtacctgtgggaccaatggctgggcaaggggtgcaggggcatgaaggaattggctagagcttggacttgtggcctggggactctacttgggtgtgcacaaggcctctgaaagttatgggtggtgctaggggtgggctgagatcttgggctgggtctctctgagcttccacattccattgtgaaaccaagaggtcagggaatcctaaactcaaacctggacttattaaagtattggtcaaggcaggatgatagaacgcattctgtgtaaccgtttgttaccttgatttgtctttaaatactacatatggtgtgtaggccttcctctgtatttttgctcttagggcaggcatttctgtatgtatgtatgtatgtacgtatgtatgtatgtatgtatttatttttgtagcatccgctcagttgcgtggccacaactgaatcccagtccaggtggcaccattatatgggtagcattttggagatgttcacaggaattgatttccctcaccctcaacccaggccagagtgaatttaatgcagatgagggagaaggtgctacatattatagctgctcattcaaaaagtggagcagagagctggaccactgaatgtgcctttgtttgctggaaatctttattaagtaccagagatatagagatgaagttgtgtctctgaactgctcagaggcaaaaaagggacaccagtaaccacagttatggtgggcctgtggaagagacactatagtgaaggtcaaacaaaatatttgggagcctagaggaagaacaggtctatttctggaggtatcagaaggcttcacagaggaggcaatactcaattggggccttgaaggatggataggagtgtaggagtggagtgggaggcagcacagagcacagaccagactgcggaagggcctgacatctagggaaggcaagacagtttagggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgcccgagttatccaggtcagagtcataatcccttacagtaccatgtggacagctttaggctatgtctggagcaggttgaagatagtgttttgttcactgtcaggagagaagacatgttgttcagccaggagggctcagggaccccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcctgacacagtgccttcatatggaccgtctctggtcagtgttttcaatttctttgttgatgatcatcaatcaaggccaggctttccaattccagaccacactgcaatcagtggaaactacctaaattcagtactgcagacccatagcaggatgtatgtttattgaaaacagattatattccttaatgagagactaaaacagcatgtttaaatcagtattcttcattccttttatcattgagagattggttattatttacctcgcctttagagggtcagcttggtggtggtggtggtggtttaagttgctgggtttttaaaagattgagtttcatgtccaaggactgattctacttcatgggctgtttttgaaaacattgctagaaacctcttaactgaaggcaagaccaggggcagcctattgctgcggagtgccctgggttcaaatccctgctccccaacttactgcggtggtgactgtggacatgttgtttaacttatttgagcttccttttcctcatcagtaaaatgggaaaaacaatgacctccctcaaggagggatgttattgaagttatttacttaaatcagattagatttattttagattaaaagcttcttgcaagctgtgaaatgttttgcaatgtcacatattattattttttttttttgagacggagtttcgctcttgttgcccaggctggagtgcaaaggcgtgatcttggctcacggcaacctctgcttcccggattcaggctattctcctgcctcagcctcccgagtagctgggattacaggcatgcaccaccatgcctggctaattttgtatttttagtaaagacggggtttttctatgttggtcaggctggtctcgaactcccgacctcaggtgatctgcccgcgtcagcctcccaaattgctgggattgcaggtgtaagccaccgcacctcgccccccgcatattatttctttatggtgtagaactcactaatactgctaaaaaccctttctgacagagatgggagttaaggcttctaagttcacacccagatttccacagagaccttagagacaatcataaatattgcacaaaattatattggaatatgagctcggggcacataggctctggtgccttgtactagaagcttaggtgagctgttactcttggccatgtccaagcatttgactcagaagatggtcgagtcagcagtgttgactgttagcaaatcacctaagcccactcacatggggtgatcctggtacgtgttgcatggactgagtgtcaactgcatgctgagtgtatgccagagggggtgatctccttgatcttatttacttacctacagtactctgggtacttatgtatttatgtttacagaggaggaggctgaagcattgaggggtcagtggcagaacaggaatcttaactctggtctctggttcctagttctctgagctctaccccatagcccctcaagaaaggatggccattgttgtcctcatacaaaaagctatgacactgctatcattattctcatttggtaaatgacagaaacaaggttcagattacttaggtaagttgctttaagtctcaggctaagggctggagctggatttgccactgaagctctacaccttctagaatctagggtgactacataatttatcaaacaaaccaggatgtttccaagagtgaaaaggggcagcattattaattatggccactattaattacggtccttggccataaatcaggaccgtccaggcaaacctgggtaatagtcaccctgcctctggtcttgatacctgaccaaggtaatggagaattggatccgccagctcatgtgctgttgcttaagtggaagggaatgtgcaaattatgtcctgctattctaagtgaaaggacttgcccaaggtcatgcaacaagttggcaatgtaatattttaaaactggacgagatgttgaaaacatggtaaagttagcactagagcttaattaactggagtatgagttagggaacatttggctatgctgatgtctactactgaagggaaaggaggtggaggtcaaggtcaggtgtgtatggagcaggtgggggtggcagtggcagggcattcacgtggctctactatgtcggcaccatcatcaggccctgtccctttgaagtccgggagatgccactaggcccagtgcaacttggatgatatttaatggccaagagcagagacttctgggacctgacttttcctgctctccactttactttagctctgggcttcaaagggactattggctgggagtggtgaaagtttagtggataatcctgctgaagaattttggaaggccttgaggaaggaattaaaaataacagtaagcatgccttttctttctctttgattgtggtcagtgcatggaatgtgccagggccgctgcggagcaagcacgtggccccgaataacccctccctgccaacggaattctgcagagaacatgtaagggctgtgctgtttcactcctgctttgggctctcagggtttgtttccgcgatcatccaaacctcatcctccttctcttgccccagataatttattggaagtctggagagggacttgagttctctcaactctccaaccagactgttgctgtgggcgaggccatgtcgggtgagctccaaggagagcagttggaatgacagagaggaacggtttcagcctgagaaatgtgaaatataaattcaaaccaaacttggcacctgtttggagagcttcagctgatactacagtgcccctgtcgttagcctttgtggctcagctgggtcttataaatagaacacgatgcatttccccttttgctaccccacagacacgcggaggcatgtgtgggggtggcatggacagagagtattcattacttatgctccagtgcatcagatagtcatcgtgggaactgagccctggtgtcatggggatgactaggccatcttgtgggtaaggctggaagcggcttttgagtctcctgagttacagctcttcttacccttgccagcctcccttccccagctgaggccctcagtccttcatgcctgtgtgccgcagtaagccagttggccccttccgtcgtgagtccatcccacattctgtatcggagcccagcattgctgtatcaggatgcttttggccaaaagtgacttgaaacccaacaaatagcttcaatcataagagggcttattacttccactaagaaggctagaagcaggaaagtcaggcatcagaaggtctcaggagccttacatctttcctcctggccatattctcttcaagcttgtctcctgttggtccaagggtggccacaactgttgcagatattaccgtctataaacgttgcatccaagggcagaaaagggctcctattccttgggggtctctttaggaagaaaaccttccccgggagcctcctggtatcttgttggtcagtattgtatcacatgcagtcaatgacagaaataatggaccctcagaagcctctcgaggtcaagggcccaggctattcctttgactcatcagggtgattagtatggaggtaggtgcttagtaaattttatttgggttagtgcaaaagtaatggcagtttttgccattgaaaataatggcaaaaactgccattacttaggcaccaacttactgattaatgtttgttggttgctggtttccttcgctaagtgagactcctgaacacttactgatgatgtcttgctgacttctgaggacatgatggtaagtctgccctcatggagcttgcagtcaggtggagagatagtgctataattgtgtttggagtatctcctgagtagattgtggcagtctggtagctttggaagaggtgttaaattgaggcccaaggagacaaaaggacctgagaaacagagcagggggactgtctgggcctctgaatgccatgcccagggccacacattttgtgatgcaagccaggttgtttcaggtttcaagcagttgcgatttctgtctccacccctccaccagtcttattttcctgttgacaaaatgataacaacttgccctagggtttgaagtgggggcagggcacagcgctgagagcctcctccctcaggggaaattttctaaagtttctcactgtgttctagcttcaaaaccatatgcagtttaattgcatgtttagtatctttgtgcatctctcttgttttgaatctgctggaaactttctctgaaagcatatatataggaagacataaaaattctataaatgtttagtggttaaaaacaaagtcctgtccaaattatataaagttttgccgtcgtcggacggaactttctgcagatagggaatacccttgagtcttcagtcgcaaagagctaatcactaacttcaagtgtgcaagtgccctttcattccaattcagagaaaacagagcctgtcccaaggcctcgtgttttgttttcctattgatctaggagctgggataacttggaaccccagggaacatctcagagttaattagttttttgaggtcttcttgtttttcttgcttgattaaaagagttacagtttttgctctgattgtttaaaaaaagaatctatcactgctactgatccaagaggtgagggttggcatggggtgggcactccagtaaatacgtaagttgtcttcctgccgtcttgtcctggtggagcagagagaggtgcctttgagcatgggcctggaaccaacagctactttcctggaaaattcttcagtttccagaagcagtggccaggtgagccggggcatgaaaccagacgaagttgccgcagtgcgaggctggttctgtttgcctcagttctgaagttaatggtccaagttcaccactcatagagcgtcagcctgttggggagacggaggccctgacggccatgccagggtgcccccaaccctttgtttaaccacggctgtggaccagtggtctcagatgtttaccatcgcctgtttataagagggaagtgtggtcatatttctatctctcttgtgggctgcacggttgccttactggggttcatgtgggaagtggttaccgttaggaggaggatgaaataacagtactcacaaaaaggctttgatccagggatctttttaaatgtcatcttttggccactgtgtttttttatttttattttttgctatctgctttaacttcaacgatgagaaaatcaaaccatatgctggacatcattctgcccagctgggctgagtcagaattgcagttcaaactacttctgctctccctgggtttcgtgtgctttcaatgtggggatatcttccagatctgcagttctccagagctagggacccctcagctccagctgctctctggacaatacctgaacatccctacaatatctgaaattgaatgtttgccatttcttcttctttctcctcacacaacctactctgatgttcatgattactggagcccccaggttctaaaaagtgttgaattagcaagtgaacaaataaaatgagacccaaagaaactgtgatcttagcatcctgttttctgggtgaggttgagggtccttggcctctcttgctggtggagatgggctttatgactttggggaagtcaacttgacttcctgggtgttggtcttctcttctacaaaatgacaagcttgaagggagaatctgaaagaatctgtgtatccgttctcagattttctttttttttctttttttttttttttttttttttgagatggagtctcgctctgtcgcccaggctggagtgcagtgatgcgatctcggctcactgcaagctctgcctccggggttcatgctattctcctgcctcagcctcccgagtagctggcactacaggcgtctgccaccacacctggctaattttttttttttgtatttttagtagagacggggtttctttgtgttagccaggatggtctccatctcctgacctcgtgatctgcctgcctcggcctcccaaagtgctgggattacaggcatgagccaccgtgcctggccagtctcagattttcatgatagccctctgaactctccttggcttcttgcctttggctgttttctcaatgcatatattttcctgggggacaaatctaagttttcatctgatgctctgccttcagaggggaaccattccttaatgacctatttaattgtattatcattgttgtttaattcatcacatatttactgagcttcttttgttggtggtggtgccatcagacacagtggtccaggagctgcaatgcgttgctgatgaggatggtcacacatagctctgccctcatggagcgtcccagggtgaaatgagacctcccctgagaaccgactcccagggtaggggaaatcagtctgcaggcaaagaggaattcaaatttagcctgaagcacaggttttctgtgcttctaggcaccggctgcattccaaccgtagtgccataaaaatacaggaaggaagggaaacgtgttcacaggttggttagagatgtggaaaccaacaatcagctctctcttatccgtaagaaactagaatctactgctggcttcagtccctcagacctgctgctcaacagagtgccctttcaaacctgggttagactctgtgctaatggcttttttcatgaacctcagacagccggaaagtatattctttgaggattatgatcgactaggatgctcgggaatctttaaagagaagcactatcttggctatatttgccctcagttgttttaaggccagtgaggagactgagcatttcagaggtgaagcatttagaggatggcctctgaaagcatacggctcagtaaacaactgacccatcctttgtcaccgtttttgtccagcggctgtcaccataggggctcctctggtgtggaggagagagaattagaggcagcaggcctgggttctaggtctgcctcattgtgaaccagcttcaggaccttgggtgagtcacttttctgccctggcccctggcttcctcttctataaactgaaggtgttggcttagcaggattttaaagtttcttccaccttaaaaactctgattcctgcacttgcattcaaagaaatgactctattactcatttgaatagtttcagaatcactgtatagtcaactctggactagaaatgggggcctgcagttgaggacaggatggaaagaggtttggggttcagggtgggctgtgagggctaggattcttgattcctcatgatttgcaattggttgttggtgttaccatggaaggttctcaaccatggctgcttttaaaaattttgatgctcagaccacccctggagaccagtgaatttcaaatttctacaggccggcctggggaaatccatgttttttaactttcctaggtgattccggtatgtggccgggattgagaatcacagccatagatgcttatgtaaagctgtgttcagtgttacaggcatctgttctgggtggaaagtgatagtggttggtcaaaaaaaaagcgtgcacacacacacacacacacacacacacacacatacacagagaacagctctaggttctggaagtgtgttgatttggtcaccacaagtgctggtggtgagtagttgccctgaggtttggagttccagttccctcctatctctgggtcagtggtttctcaacatctttgaagtagtgaaaccatctgtagttggttatttctgctcagaaactcacagtacaaagtggggggtggtgcaggggggtggagctggaatggattaaacaggcccttacaaatgcccacacttttttcatgaaactaagttagaggccttagccaactccagcataccttagtgtcagttctttggcattgccccggtggattctaggggctgtgaaggctgtaggggtgtgtgttactccctgctgctttggtgagagagtgtccctgtctttggctgagagcatcctgtcctgccacttcatcagcagtagcatctaaacagcccttgaagggaatcagtatctacagcctaagaaatctgatgggacacatctctctgcattaaaatattaacagaaaaggtcaaactgggaaggggcagctaagttggaatatctcattcaggtaaagggatgggcttgtggatccttaattggtgtgaaatgcgccctaggaggggagactatatcagtgctgaaagcccttgagggctttcacagatgaagggggatggtatgagaagctttacaaataacaaggtttgagatgcagttgtagacacatgccagatgtaggttgctattttctcagctcaatgaggaatctgtcaaggcactcttagaaatggaaaatatagttcctgccctcaggaactatagtgtcacgtgatagcagtgaagaccttctatgtcctggccacacagtgaggatcagaagacagagcatggagagtggaatgggacacatggatcaaggaacgtggacctgagcaagcaaaagcaagtcactcgggtcccactatcacattgcatatcttctccttttttttttttttttctgagacggagtttcgctcttgttgcccaggctggagtgcagtggtgcgatctcagctcactacaacctccacctcccaggttcaagcgattctcgtgcctcagactcccaagtagctggtattacaggcgcctgccaccacacctggctaatttttagtagagatggggtttcactatgttggccagattggtcttgaactcctgacttcaggtgatctgcccacctcagcctcccagagtgctggggttacaggcatgagccacagcaccagcctcttctcctttctaacgtgatgtcagtgtctctgggaagcagccttagttggcacctcactggcagcaagaatgacttcatgttcttgctcccatgaaaattctctgctttcaggaatacactttcctctaggttttttctttgtctgcaagtgggggggtgttctttgccagatccctgctttgatgattaccatctgcccacctgagtttcctgcatagtttcagttggaaactcttttctctttggaccctaagataccgtgtaataggattgttcttggtttcagtaggcacctggcaccctctcagctgtggctgcatttcaggtatggatgggagtgattatctgtgcatcagaaaactcaagattgtcatgtgagcaagttgtgtgatcatcagtaaatgcagagctggctttgttaggccctggttgtggccaaggctttcctttcccggcgggtgattattccagatttcatggtcactagctgagtgtaatcaggagcagataagaaagccctgtatagagcaaagtatgcatttcttaaggtggtgggggaggtggcagaggcattatatagacgtgtgtgtttgtgcatgtgtttaaaaaaagacttatattttctgggcagcagaacttaagtttccagtaaacatctcctccctttttactttaccttttaattttgtgtttatggtctctgtgctttgaaattgtttttgctgtgatgccagccctgcctgaaatgggtggagcaagccaagccctttggaagccatggtttagatcagagttcttgtactgacatggcccagctgattgacagctcagatgtgatcactccgtctcaactagaagaataaaaataaaaaccttgagctggagcggagaggggtcacacatttgttagtttatcccctactctcacctttatcgcaggaggagtgataaagtgctgctgtgtgtaattctggtctggggttggttttctgtagtcccaaacctgggactaattctccctggagcccgtggcccagaagatgggtgcacagtagggttacttgatgctaaacggctttcccgatagacttgggatctcactgttcttgtcttagctttacttgttgggttggaggaggtgaggtgggtgggcaggggcctagggaagcccactatagaaacactgggacagagaatccagcccaggctaggtgagagcatctgccagtgtgaaaacacgtggaagcgggggaggcaggcgagaaaagctgtgggagaaaacctcacaaatgcagcaaagctgcccagggcccaagcggtggggcggtagcgagggaaacacagtggtgtttggctgctgcttcacaccacttttaattcagcgctgctaggaaggctatttcagaatgctcccgagtgggagggggcagctgctctagggtgggaaggggatgctaaggccgggtgcggtggctcacgcctgtaatcccagcactttgggagccgaggtgggcgaatcacgaggtcaggagttcgagaccagcccgaccaatatggtgaaaccctgcctctactaaaaatacaaaaatgagccaggtgtggtggcgggtgcctgtagtcccagctactcaggaggctgaggcaggagaatcacttgaacccaggaggcagaggttgcagtgagctgagatcacgccactgcacttgagcctgggcaacagagccagactctgtcttaaaaaaaagggggtgctggagagcatgtggggtggatagggctgactagagacctttgtcagggtgacctttctccagagagcccagtaggctcagaaggaaggtccctcagcaccctggcccacacagttccagggagaccccaaataaagcatttgcacaaacagtcctgagtggagcacacctagccgccttctcttgcaaagtgggcctttaaaaaaggggtgtatggctgcttagttctgaagaggccaggctaggagaccccagagggacacccagaaatcccagatatacctcctccatctgctctgcctgccagatgacccttgctactttactgttttttctttgagcctcttggtgatcttgaatagcagaaaaatgagccaaatttccttcaatctatgccagtcttcgtcctcagcctcccggtggggtgatgagtcacaccagtgggaaagtgcactgtatacttggtcatgtgcagagcaccttcccattggtttatctttacaactgccctgggtggagacatggcaaggtggtcctatccctattttgcaggtgatcaggcacaacttacagttagcgcaggaacagggactgaggccagccctcagttctttgacagagttctttgtctacactgtgttgcctcagaaaaaaatgcccatggggagtgtgtgtgcgtgggcatgtgtgctctcctcgtgtccctcagaaaagaatgaattcttttccaactgatgtcactgggaaagggggacaccactactttcctgcgtactgcactttacagtttacaaagcactttcccacacgtcatttcgtttcatctccctgacagtccctggaagtgggtgctagtctggatgagcaggcgcagacttggagaggctgagggacttggcccagggcatatagctaggaagcggccaggcagtaagtgggtagcaccactgcatgttgggggtggggaagcatgagctggatggagcattcggtggtctaaccagtggccagcagtagtgttggggtttgctgccctcacctctgaagccacacaggctcctgcttcctgaggtcaccctctcctggagggctgcccccgcatgggagtgtggacaagtgtgcacgagggggaggcacacccaggccgagtggaacaccaccctaagggggtggtgacaggtggcactgggagtggctggagtcggggttcaccttactcagggtcagggcttcccattttgcaggactgagaggtggactctgaaggaatgcagtgcttagaatcttggtgcctctcctggggtggtgggaagagcagggagtctcgagtccgattttgccaaaaatcccaactttcctgctgagtagctcatgagacaggcatttcacctctctgaacttcaacttgggggtactcagatttccttcagaggctgtgaaagagtcccctgccacaagttactcctctgttcagaagtgacttgactgatcatctagcccaaccccatcattgacagctgggggaaactgagctcctgagcggggcagtgacttgcgcaagtcatttgttgggaagaatggggcaggatgatgatgatgtccacttcttggggacgatggggcagggtggtaaacacttctcaatgcttgcttatgggctctgatgtgaaccactcactataggctgaatcctggttttccaagtgtttagaggctgagctgttgtcccctgggattttggaaggtagactcacatttcactgaaagccctagatgcttctccttactgcagttcccctccccagcactcccatctccctgttttctggggatttaaatcagctttgacttgggtctgaaagtaacccgtgacagcagtaagcctctcgatctgttgtttgcagtgtttcagctaaaatattataaacagaccaccaaactgtgtttggtccaaggccaagcccctccctccctacttgaacacttgattacctgctgcagggttgcgtcttgagctccgaggaggaaactgtttatttcagggctgttagagtgcagtgcaggaatccaggagaatttattgtattgttaccatctggtttcatggagtctgtttcttttgattttaattgtgccctctggagagaaagatcctcgaaatggtggaaaaagaagataccaccttcctccctgccctgcccatgccctggcacacacattgctatggtgcatggtgggcatggctgaaccaagtccccttattctttgaacatctttgcgtattattcctgctcccccagccgtctccaggccccagtctcctctggagggatttcccagatggcttccaggccagagcctgacaggagagataggacctgcctccacggtaacaaatggctgaaggcggtttggggtgttgccagtagcctgcccttccgcagtggctaaggatccggtgttgcggtgatacatgatgtgacctcttcaaccagtgagtcactcacccccagataaccacccggtactttcaggggaaaccgttgtatcattgtggctgtggccatggtttctccaaaataaggtgtttttagaaatgaaagtacagggattggtttccttagattcattgtcatggattcatagttccccaacctttttcacgtaaagactcacctctgtttcctcttaaattgtacatttggtgtctgttttatatattaataataactgacactcttctaaagttttttggggaaagaaaacataagtttaccaagctctcaattctagaaggtaatagccttctagaattgtccatttgcataagcatttttatgcttattgctgtaatcagtgtgtcagtcaaacgggaaggaggaactacatcaggtatttagcacaaagggaatttaatacgggaccttggttacacaggtgataaagcagctgagaagccacaatgggaaggtgaggtgacccagaacttggaggaagccgctgcctttaggctggagggacaaagggaacaggtggtgttcccagagcccagggttggggtcaccagtgggcctgtctagagcagttgcagctgcttctaaaattgccgacccaaggtagaaaaggagagaggggagaaacactgtggcctctccctccctcctacccactacttgctgtgagagcctcctattatttaaaccctgctggaggcctcctgatctggagcctggaaagtcagggctcagccccagggaggacacagcagagcacaggaagatgagggatggatcagagggcaaactggacttggaccagcacagggtgcaagcctgatgctctaattttatattttatcagcattttcttatatgtggctttcataattacacatattttatcaagtagatgaaccgcatttaaccattccccagctgttaggtgaacactttaaattactataaatcagcagttctcaaagtgtggccctgggccagcagcgtcagcatcaccagggaacttactaggaatgcagagtctcaggccccgcccccaggcctcttggatcagaaaccctgagggcggtcccagcagtctgaattttgtacactctccgagggctgctgatgtgcatttgagcttgacaatcatgattataggcaatgatgcaccgtgtggaagctgggggcaggatactgaggagggtgctgggggtaggagtggtggagggagtttgtccaggggaatgtggtgtagcggaaaaggcacaggactggtagggctgtgcccctttaggcccaagcctgcccttgctcttaacctcttaatgggtttcttctttcttctgttaaacagctaaaaatatcaaatcatggggttgctgtgacggttaaatgtaataacaggcacgatgttccatatatgttgggtcttctggagctttggggaaggaggtgtggcaataacagccagcttctgcatcatggaaaatggcccccatgcccatccctgagttgtgtggtctgaaaatcaatgatgaacacttaggaggcttgtagcctgctttgagtcaacaggaagactggacttgagagtttggaatctatagtctaacttcccttcctcaccctgtctttgtaaatggtgctcatctaaccctacagttactatcttttcactcatgtctagccacttgttagaggggaaggaaccctggtgtcaggacaggactcctggctccctgagcttgctgtgtattccggggcatatccttaacctctctgagatgtacttttcttatctgtaaaacctctatgttgatgcaaatcaggtgcgatgatggacgcaaaaactgccttgaacaccttagcgggcctgtgaatataaagccttcaggatccacacctctgccagggcccacaccagcctcgccacctcggtgagcctctcattccactgccagtgcaggggtgcataatcaggatttgccagtggaggtaggaagggtggctggattgtgactgtcacgctcctggcatcagatgatactggtagcaagctagggtcgtctgtgcactttgctctctctcagtcttcccagcagccctgtcaagcggggagtctagcaagaagtggccaaggcgcagatcatttaagaggaaggatgtgagcaaactggatcccaaggggacagacagaggcccactttgcctcagagtccagagagctgctgctgctaagaagggaaagaggaactgggtcggggtgcctgctgacttgcagcgctgtgttggcatgcgaggtagcactggttgggaggcggttacctgaaggaagcaaaggcagctggtggttcctatcttcttgcctctggcagcacctaaaagaagcctcttgggccaatgagaggatggactgtcccccacctgcagagttctgtgaagtggtgcggacgtctttgttgatctcatttggtgcctccccctgttgatggctgaggaagccaaggctctgagaaggcacatggtttacccgaggggacacaggcaaggaatctgaacccggattgcattttctgttttagggctctttgtgtgaccacggtgcttcccaggcccacacttccagtgttccaggcccttgaccaccaatcctgtggaggggtcctcagggcaggcagtgggaccacctgaggcctgcgtggggtggcctgtggtgtgagggacccaggaagtcagcctgcacctcggcgagtcagaagatgtggccatccaccaaccatcagatgttcccctacgcttagggctgtgaccagaagtggcatcaagatgggaggcgaagcttctgggaccagagaaccagctgctcctgttcatcctgcttttgggtgaatagctgatgctctgggcccctcatcccaccatcccaccccgtggctcctcctgagcagggctgagggcatttacctggctgccttctaaagcagacttggcacgagacaatcttattcaaactctgctcaaaattgctaccctgaggagagggctgtgaccaggcaggacggggtgtgataacatggaacgcagggcctgctggagcaggccctgatgagtgtaaataactgtgttagaggcaggacctgagcttttcactccataaatatatattacttctaatgtggccagggccgagctgaagatcataattatgtgagatctgctttacaggcatttagggaaatgcgtggggctgcactgatgtaggcaaagatgtggccacatacatttaacgtgtctcagaggagcctttgctttaaccctttaatcagacccttccagggtgctcctgacttgatgttccagagcgtttggagtcaagagttgcactcttttttcttgcattaaatgcacttgagttttaacccagtctctgggcggatggcagggctgcatgagggggtctccgtggatgtggataagtccagagaagtcagctgagctgactgggcaggtcttgggtaagtcacgccacttccctgagcctcagtttctccagcagtaaaatgttacctgtctgttagggttgtaagattgagtcaacatatgtacaaggcattgcttagtgtttaccaccttgctgtgagctggtaaatggttggttggtcccttcctctccccttggtgttaagcatatcaaaagatggctgcgtgctcacctcccctgctttactgggtggacaaaggagctgtcacacagtgtggcagccttagaaaggttaaagaaggccagtgaagtcttctggctcatctggtcctgaggtgggtgagcattaaacccagatcctttttgtgtttcagtattggatcctttggccgtcatatctgagacccagggcctcagagtgtggggtcctaacctaatttggctttgggtgaactggccagcaaatggaaggatggctgtggaagtgtgtcttgagcctgtccttacacaggtgtggctgtcatcaaggccatcttcatgggcacgtgacgagtacagtcacatagagttcatgctcaggagggccctatgcttggtttaatgctctgctgtcaccagcttgaaatcctttttttttttgttattgttgcccaagctggagtgcaatggctcaatatcggctctctgtaacctctgcctgcgggttcaagtgattctcctgcttcagcctcccgagtagctgggattacaggcacctgccaccacacccagctaatttttgtatttcttttagtagacgtggggtttcaccatgttggcgaggctggtctcgaactcctgacctcaggtgatccagccttgggctcccaaagtgctgggattacaggtgtaaaccactgcatccggcccatcttgaaattcttaataattttctctttgacctagtgttttggagcatgagcatggatagaggagatgtgggcagcatgtgcccattgagccttctgccccattcacatgtagcatttgagcacagacttctgccggacctacaatgtgggggagttgagtgagagtcaaagtgagtgtgagatgtcacatctgcgactgagtagcaggggccctgacagtcctgatgctttccatctaactggaacttgtcttggttgtagaaagaaggcgatgacattctaagaaacatcaacgaccaaagaaccccatcatatcctttattactcacgtcacttccctgacaccaaccacttatattgaaaatgatgacggaagaagggaaaggaaagatagggcacccatattgccttttcctttcagatcttccttactcctcaggcagcataaagagtgaggtagaatggacacatagcgagaagtgaagtaaaaacgattgagttagctttatggatgtttctctggttctggtacatcacaaaatgcacatccaagtcctaaaatacaattcatgtaatgttggtgattccacatactagttaaaggctttttatatttgcagttaaaactggcatcacacaatataaataggagtggtaaaattcatgctaattcatgtaatttaaaattttaatgttgctttacttagaataatattaaatagcaaattaaaaataccatgacacatcaagagagagactgtggaggaaagagaaaaagctttctattttagtaccatgattgatactttttttttttttgccttttgcacaaagggttccatattttcattttgcactgggccccacaaattatgcagccaaccctgactggcatcctggggctggaggtctcaggctggtcttgcacgtgcagcctctagatccctggtctgctcacattgtctcctgggttgcggagctaagaagcatcatataggcaagtgagcatgtgtgcttgctctgaagattccaagcttccaggtggtggtggctctgttgatagagataaaaagttgaggaatttcagaggctacaaacatactcttgttgaaggtgctttgggggtctcctgagcatttacttttgtgaatttttgggcagcctagtatagaggtgatccagcagtaagctgagagagaggccctagtttgactcttaactcaggcatggtctccttgggtgagtcatttcttcatcaggcagtcctcagtcttttggttgcagtgtagttgttaaaaatgtgggtacttggaggctgaattcttgggtcaaatcttatctccatctctctgtcctttttttgtggttttttttgtttgtttgttttttgtttttgtaggggacaggttcttcctccaccactcaggctggaaggcagtggtatgatattggcacactgcagccttgacctcccagctcaagcgatcttcccacctcagcctcctgagtagcttgggactacaggcacacatctctatgctgggctaattttcatgttttttttgttgttgttttttgttgttgttttttgtagaaacagagtttcactatgttgccccaggctagtctcaaacttgtgagctcaggctatctgcctgcctcagcctcccaaagtgccgggattacaggtgtgagccactgcgcccggccttatctccatctcttaactagttgtttgatgttgggcaggttgttcaagcctcctggagccttggtttacccatctataaaatgggtataatggtaattatcttatagcatggtcatgagcgtgaaatgagagcagggggaggagtaatcattgtgtctggtccatgggactgaatcaatgctagcaatggtcatgatggtgaagaatgaggggaggaggaagaaacaattcctgtgggtgctaggaccaaaagtagtatcctctaggaatcctggccttcaaggtctaacttccaagattctgtgagtacgattctagggagcctctgcctcagacttctaagtagttcttcaggctgtgctctagaagttactggaatgaaagaaaaattgtagtgtttgaaggtcttcaaggatcctggtcctctcacactgtcactcttagtcacatgacctttgactgtccattccctactaagccttggtttacgcatctgtcaaatggagcattcgtgggtgtgcctgccttagaggatgagacccagctgagatgacatatggagaaatcgtttataaacttaagtactggtgttaggaagagctaacacggtgagtcttcagtgtttctttaagtgctgctcactactgtcctgagagactccaagaagcagttactttgtttgggcctcagttcatcatctgtgagatgagaggattgggctttgtgcctaaactgcccccccaccccaccacccaagacagattaaaaaagaaggaaggagggagggagggagggagggagggagagagcgagcgagcaagcaagcaagcaagccagcaggatttggaatcgtcccctaattggaaccacaatcgcaggtttcagggactcaggaaagggtgcagcccagcttgtggttgagaaatgaatgtcagatgttaggaagaaaaaggcctatctcaacatagcaggggtttcttactgcccctgcctcctcagccccggtagcctgtcactccctggcgaacagcttggcagcacagaggcaaaccacagagtacatttgaggcccagatctgcttatttcgagggtggggccgcgtttttctcctgccacagtgagctaattaaagaaaacaagcttcgggagttgggagagaactgtccacaggacacttggggaggcttgctttggttgtggaggcctccacagcccccggaaggcaggtggaagtgggcatggagggtcctacgcatccccagcgggggtctgagggcccactgttgctcagctgggggatttggggacggtgggagggcatacatggatgggagggtggactccgttcctgagggggccagtgtggaggagggtcaggcagcccatggagatgggacagtgttctgaaatgcttcacaaatgtggacttttgccccaaactgtggacagagcgtatgtcctgagcgaggatcaactctgtgagtacccatgataattctcctttctgtggttgccgccctgttgattcatgtgtcagccttagagaaagtggctgtgacttctgcattcctgggaatacactgacatgagaagaagtagccgctcttgttcacagtcacagggctggaaagtgggataaggactaaggacttctgtctctggattcagcatgctgattatggggaaaagcagacatcaattcctcatgtcttgtaagcatcactgtcctccaaagttggagcccagctcagacagctgcatagtattttatagagaaggtgtgttgttgaaatgttgattatgcaaattgaattgtgttttaagactactgggaaaaccatttaaaggaatcctgttgtaagtcattttgaaaaatggagaattacaccacctccccaaggattttctgttttggtaaatttcatgtggcaagattacttgaagaagggttccagtgttttgctagcttataatggttactgcataaggaaggtttactcgccagaggtccgcatacattggagaactgggggaatatgtaatacttgtgcagaaatgttttgattcatgtactcagaagatgggatctggatgacacctccagcctattgattcccaagtaaggtgtgatgacaccaccaccagcgaggtgtgctatgaggaatttttgttgatgatgaaaagtgaatgctaactgattgcacaccacgtgccccataccttacatagattatcttatttaattgttgctaataatagtactacagtctgtgaatgatttacttagcaattaattcaaaagcatattccactctacaatggaatattttttgagccaagaaatgaagtacgtggccgggcgcagtggcttgcgcctgtaatcccagcactttgggagaccaaggtgggtgggtcatttgaggtcaggagttcaagaccatcctgaccaacatggtgaaaccccatctctactaaaaatacaaaattagccgggcatggtgccacatgcctgtaatcccagctacttgggaggctgaggcaggagaattgcttgaacccaggaggcagaggttgcagtgagccgagatcgcacccttgcactccagcctgggcaacaagagcgaaactccatctaaaaaaaaaaaaaaaaaaaaggaatgaagtatgtgccacaacatgggtgaatcttgaaaacattgtgctgagttgaagaattcagacatcaaaagccacatatcacatgattccattcccatgcagtatccccataggcaaattcacagagacagaaagcagattagtagttgccagggatggaggagaggggaatggggagtgactgcttcatggatacagggtttccttgagggatgttctggaacaaaatagttgcggtggttgtacaatattgtgaatgaactcaatgccaccaaattatacacattaaaatggctaacatggtagatttttgctgcatgtattaatatattaatgtattaataaatgtattaattacaatattaatatattgtgatatactgtgatatattgtgataaatatatcaatatattgtgataaacatataaattgattttaatatatattaaaatcaaatgtattcctctaatggtgtccatgtcactgacttagtttctgataggtttgtattgggtaggaaagaaaggaatgggacatttacgtgtacactgaggcagaagaaagaatgggactttccaatccaggctctacctttatgaggaaccagagacccagagagtgctagtgacttgctcaagggcacagagcagcgtaccagagttgagctttggcttctagcctcctcactttctattggggaagtcacagtggaaaagggggttttggctcctttatgtctttgggtatgttctgggtcactgaggatcagctctattccacctggcattttgtgctttccatgggtgctcaggaaactgtctgtctcaccctgaggtgaggctcaggaggctctggggctttgtagtagaaatagaaatatcccaagtcctgggttgtgtccttgtggatgtgtctagaacaattcctgttgtgctactcgctttgggcagttagcgaaagggactaattgtgtgcaaatacatacgtttggtgtttgttgggagacttgccatgtgacactgcttcttcttttcttctctttttgactatgaacacctgacactacaggaaataagaaactttccagtacctaatttatgcttactctactttcaaaccctgttggccccagcacagggtaaatgaaactgtagcttatagtaatatttacgtatgggagtcaatgagctgtttaaatacttggatgtcagaaaaaggtttcaaatttagcaagccccctgactctcccaccctctggcatgtactgggtaggcctgcctgctctctgaggtcgagctcttgtatcctgtcctggtcggtgccagtatagcaatgatgatgacagtgatgatgatgccactggaacaggctgagctgtaattgaattaaatatctgtgtaatccctaggagaagctgaataaggtttgaggatcttggaagttcagttatactctcagtaactgaggtgagatccgtaggcaaggaatgacaagatcgagattgattagctacatgaccttaggaaagtgacctaaaggttgttcacattcagagtcctcatctttgaatgtgaatgatatttctggcctctcctatcttatggagttggtgtaagcatctgcatgagatgatggacgttaaagtgctttgttagctgttgagactcttactgaaatgaaacccaaggatgggtgccactgaaagaaacaagaatgaatgcaaactagtttgtgttgggagttgtacttgacacagctgaatttgcctttgtctttaggagagccttagctgtgggaagcagggcttggaatgcgctgatatttatttcttccatcaaatcggattatgaggcacctgatctgtttaaggctgtgtgagtagaaccaggtcctgccttccggaagttcatggttaaattgtgttttcatgggtcacctggaaggcgagcttgttcagaatgaggataattgacccagtgaatccttcctgcctcgaggcccaccatgttattcagatcagtcttgggggaaatgctgtgaaagtgtgtgtgtgtgtgtgtgtgcggtgtgtgtgtgcatgctcgcgtgcatgagtttgtgttgagagaaagaaaaaagccaggagagtaggatgagtcagatttaaccactgttttttcccttttgaaacttgttatgttcatacacatacagcagtcatgcacttgctcagaaatgtgtgaaaaccacttaaaatgtgtgaaatgcagccctttagaaagtgtgccttccaccacattcttttgagcagtggagtggatttgtgagtgttcatatctgtcctcatctgtgggaattgtatgtccaaggtgctaattcagggccatactgggatgacctgtgtgtatagacttgtcctgggtgagatgggagcaagaccatccaatgtatgatggggaattctgttaaacaggtagaattctgaacctcttggtggtcctggctggtcagttgcagggagtgacgttgaatggactgggaagatctggatataccatgtttctgtaggcatgatacgtggtcccttagcttggtatttaaagttctttggaagtgaccgctttctggatttacctctgtgcagcccctctgctcctcccaggtgaggctcatcatagctcctcttcaatgtgctttgtccacaactgctgccatgttttagctccccattacgtttcctgggatgctctcctagactcctctgtacctttcttctttcaaacccaaaacaggtcccatctccttagtcttaactgtctatgaatggtctgttgcctcacttcccagctctggtatgtagtacgtgctcagtacacatttttgaatgcattaatttggctcttttctgtgaaggcagcttgtctgtgtgtcattcatctgcccaaatttgattgtcaacttcctttgtatggagctgtactgttctttttgttgtttttcttaactccttgcccctgcctcccatcaccccagtggaagagttatagtcaaggtagtgtagtcaaggtcgtgcaaaagctacacacttgaacctgttccgtgtggtttcacacaaggcacatggcctccttgggactcacttcacatcactcgacaaggggatagcaggacccaccttgactgtattgaagactgcatgatgatcaggagagagtgagggatgagaaagagtttggaaaacagcagaacacgatgcaaacatgagttattcatggttttgtgtccaggctaactgtgccctgacattaaggctgggtgggtctggcccagggcttctggggtaggcgctgtgctggtgtgtgctactgacctggagtccaggatccctgagtcccactcaccctccctgggctgcagtttcctcagcccagctaccctttccagctgtgactgctggttgtggagctgaatgtgtgtggggtgtgggcctgtgtgtggactccccacccctgtgcggttttcctaagcacatagcacaacaaggagctggaacagagctgcaacaatgaggagggtttcctccaactgtcagtgcttctggatccaccgtttcggctttgacattaccgtgagtgaccaccctggacctctttctttgtgccaaactcgttgctggattgccataaacacttacttggattgattagagaggctatttgccgtattgaaggtggcagaattatttcaccttttccagaggtgttgacgttcaagggtagttggtggtgactgtacagaagggagacaggaagcctggaggaaggaaaggggtgcgtagccgagaaagtgcacaacgggccctatttttaaaagtgcctgcctctgctggttttgttgtggcagcgctcaaaggcaggaagacagataagatcggatttcaggattttcgtctgccccccatctccgcccccaacttttgacaaccaagaacttttccccaccaggagtgggtatatttcaacttctgtaatccctgcgtctcgcacaatgcttggtattacaaggtgctcactgagtgtttgaatgaatgaatgccttcccagttctcatcacagctatagggtgtcactgtatacatcaagtcatggttagccgcaggtttgatcggggaagagacactaatcaatgtatctgattctagaagaagatggagcttctaggaagggcctgccctcaggctgtcctctgtgttccccggcattctgcattttgcagtcacccctcattatccctgagtccaggaacacctgagattggaaaggattccagccccatagggcctttatcgtggcccccagtaagtgataaatattcgtactaatttggggcagtgtcctttttccagctgttttcccatgagtgccctctgttccgtcaggtggccgaagacggataactttggcaaagggcttggcacaaatggccaagtttacactggatcactatactccgtgttatcttgtttccccgatggtcattgccacacaagaaagtacttcctctgtgggctttgcccaccctcttctcttgacagagacctctgggcctagataaatgtataaactgcattgcaggaatgaagccgtttccattaagaactggggtctatgtcctgggatccagttcttctcccccttttagtactgaaagctgcttcccatctgaaagctgtctggggacagacaccgtgcagctgcgtgcagacttctttcagagtttgatcttgcaggcttcccagtggctctgctcttccttgtctgcttcctgggggtctctcagtatcaaagccacctgtggctccatctcacctccctgaacaggaggcactgtttgtcaggaggccttgccacctttggccctttctttccaaagaaagatccctggcctggagtttttgtctcagctctgttgtgtgaccttaggcaagtcagttgacttctctgagcctcagtttactccttagtaaacaaaaaggttggatgaggcgctctccaaagttcttgccctctgtgtccttcctctgcgttctacagggagggagtagctgcctctgtttggtggtggggactcaggcaggatgggtagggaggggtaggggaacaagatcatggcgcacctccacggccacagtggaaaccttgaaccttgagctgtatgcggtgagtccaggatgctgagaagatgccgggctgttgggtaagcagagcccctacgggaagcaaagagtattattcagccctgtggaatgctgaggcagggctgagcttgggcagggtggctgagagaattgtggctctagctgtgggcagaaattcatggccttgaagaatggctactgtatataccagtgataaatattagtcactctggcagcagaatgagtttcctgtgctgcatttttggcacttccagaaaagggaaagcctttctctctgacagggcacaggagggagaaacaggaatgtgtctcttaccctgatgccctggctggagatcccgtggggttttcaacctgcctgaagcaacgcagggcctgctaatgcctcctgttgccctaggtcaggccagggcccattgttgacatctgtgctgtgctgcctctgaaggtcttgcttgagcatgtcctgaatggaaggcttcatctgcattcattccccggccctccctgccgtctgcacagcctcctccaggcctccccttcccagtgaaaagcaccaccatccagacctcaggaagcaatcattttagcctcttctccttctccctcaccatccaggacatcactgagccctgtcagttctgcccccagaatatctaagttcatccaatgccccatttccactgctgcttcctcacccaaatcaggatgtttctggccccgtctccctcctacctggtctccctgcctgtaccctcctctccactgggcccattctccaccggcagccagcatgatctctaagaaatgtacatctgtcatctgtcatatctgctgaaaattgttcagggcttcctgctgccttgagaatgagggtctgaatcccaaacaagggttcaaatctcaacctctcaggcctaccctgaccttacgtatctttcctcagggcctgtgcacatgctgttccttcttcctggaatgcttgtccccatagttttcagctggcgaatgtgagtcaggtctccccttaaatgtcatctaagagagccctttctaattcctccccttcatcttaactctatccccaatacactctctcacagagactgttcttttccttctgagaccctactccagcttgtagttctaaatctgtgattatgcactgtctgtcttcctcttgaggtcaggggccatttcttttgttctctgctatgctcaggacccagatcaaaggagctcagtaactatttacaggcgtacatcatatgtggaggacacttatgctgtgatggccccacacacagcttcctttggggtctgtcccctgctctccgttacccgcgtggtagccactgagcactggctcttcctggcttcactctctggcatcaaaacttatcagtcctacatctcagtcttttgcaaggtgacacttatctgattacctaattcacacgaaggtgttaatggtggtaatggcatagtatttattaccccaggggacccagaacggtggtatcaaaacatatcattccccagtggtttaaaactctggtagctttccagggagtccaagtggagtccagtctccttagctgagttcacagggccccgtctgcacgacttggcttctgtcggcttccctagccctgacttcccaagccttagtcatcaccctctctcccacccagggctcagcacagtacctggaacagtcaagccctcaataaatgtttactgagtgcattaaaaaaaaaaaaaagattttaatgagtcatgctttaactgaagattttagtgtagtcagtcattgggccttggatgccaaaggaatgacaaatggtgggaatttcaggcacagtgactgtgatagccccaaggaaaccaagagagaagtagctttatctgggtggaggggagtgggcctttcagagcctcgaaatcttcccacctgctgcgccactcccaccacataagcaccccacccttcttcccagggtgagatttctcagctctgctttctggggtgccagacaaggggagagccttgttgccatgccctcctgccctcctgccctcctgatgcagtctgtggtcacctgcaggcagagacagatgaagtccgtcattcggctgcgagtaatttctgatgggagaggggcttcccccggcccttcccgcctctctgagccttgccacggtcacttggtttgcccagcctaagtcactgcctgtcgctgtggttattgcatggacagggcctccctctgtccctccacttcccttccctgccccatactgttgccctcacccaccccaaagcctcacccttcccttccatagggatatggcctgatagaggaggagccatttgattttgactattgttgaaattgagtggggaattttgggtttgttttaggttttggaagggaggattatctgaggcttgaggcttctgtgatactgacatctggtgtggaaagtcatcctccctcacctaggtgactgggcctccaggtcatctccccgagcagcctccctggatctgctctcctctcccccccacccccccaccacctcccgcgctgtgcccagggtgatctttctaaaggacagatcttgcttcagcacctccctggttagaacccttccgtccagtggttcctagtgcttcggggataactcgccttgtcccttggggtctgcacagcgtcctccatctcctctcacttggccttgccctcgggggctccggtaagaagctttccaacctggcagctgcagactctgtgcggttgtattattgctgtaaatgggcagggattacgcatttgtggagtgactgatttcaagtacaactgccaccatgggagaggtctgtgaaaatcactggaattgaaaatgaccatgctttgcccaaaaaggttgagaatccccactctgatgatactagaagcctgcttgcctccccaccctgtgccaagccatttcttgcctccttgctttgcccataccagcctggaatgtcccaagcctattcaacttacttcctccaaaacgtagtcccatcttgatctccaggaagcagccttcagatgccccctcctcctggccactgcaaatgtgtccccccagctgctgagcatgcctaggtctgacacacaccacgatatgttgaaatcattggtttctgggttattcttctcacagtcccaggcagtgagccctcaaggacaggggctccatgggactggtctctgggtcggaggccaggacccaggtcactaagggcatgtcactcatctggaccacagctccctgccttgtggtgtggactctgttctctgcactgggctcgttctaaaacggagcatttggtccttgcagcctgccttgtggtttatgacttagtagattgaaaatgacagttgtgctctattttcatttggaaagaaaaaaaaaagtggaaaaccagagattgcactgatctggaggtagagagaaaactgtggagatcaaagaagatattatgtattatgaatgttacacagatcaaggcatgtttgaaataggcttaattttcctcaagttggcttttgtctcacaattgagttcttgttgacgaagaccagttattattcgtcttcgtgtctctggagtctagcacctagcacggtgcctgataaagcatggtcacttcacaaatacttgtcgaagaatgcatgggatgaatatgcatttgggtatttttaatgcttgatgattagaacattctcatggcttgttaacttgtaagacataattttcattgtaagttctttgtgtgtgcaaatgctttttgtgtggaatgcttgccatgcactgaaaaatgctttgtgatagcagttttgaaaaattgagtcattttgccctgattgaagctgggtgaccttgtgcaagtcactttaaccctctgggacttgtggccctcatctgtaaaatgggtagaaggtcagagtggacctcgtggcctgagaggctagtaccccatgctgcatgtaagtcttacatcctcctctttggtgattggatactgaccctctccccaggggttcctgcacagagctggaattctctctggtgtctttgcattctagtgggtggaatgccttgtttctcagtagcaatgagaaatgttaatgtgaggttatgaaagcaagccaagagccatggaataattaaaacacacacgcacacaaagaaggaaaagcgagagggggaaacacacttaatggacaagggatgagtaaaacccaatggactgagaaaaccccagagctgaacttcacatgaccccgcgtgctgcctgcagttgcgacacccgcgtgccccttacgctccgccggcctctcagtgatgtcagtgggccatgggccccacaggaagcaggggctgccatcagcctggtggagcgtgccagcccgctcctcctccacggcccacttcccacccacccgggtctccagataacatgaagccatagctcccaggctcgtcagcgggggaaaccaactcagtgcttctcagaaaatagaaccccagcccattagtgatgtccacgcaggcaagagatgaccaagaagaatgtttgccttttaggagttctctgcctgaaaccagcaggtttcctttagggatagggtgactgtgcttgctgaacacctctaggtcgtcagtgaatgaaataattcattctgtgcttgagtgtctaagacccagggggtttaggaataattaggatactggctgtacccttggagttctgtgctgcttgggggatacgactcaaactcacagacatctgtggctcaaatcaaggcatatagatgcagtgactcttggaacattcgagggagaatcaccacctctgctggtggaggaaaggccaggaactgcccacctagttttcccatgaccccagcctgtagcgggatatgtcagaagatttggatttagaggaacttgggtttgacaaaatagaagtgtatgtatataaacagagttgggagtgatgggggataggatgctgacagcaccttggtagtccctccccctacgtgacagtattgacttcatagtgttgttgtgaggcttgaagaagatacaagagggaagaggagcgttccttgccgtgcagatgcaaatgctcattgttacttgttctgcctctctgtgtctgtgacatccagccctgtgtgggctaccctggttgcaaagtgggcctcctgccgttgagcagctatggtccagtgggcaggtacaccacagtcatggaagcctagttaaatcattacataatagttagctctgtatgaccaatcttttctttaaagaaattcttccttttggaataatcgtagatacacagaaaaactgtacacagataatacagaaagttccagtgtacccctgacccagatgtccgtaatgttaacatcttgtattaccatggtacacatgtcaaaactcagaaacaacattggtacattactagtaacacaagtccagactttattcagtaaaccttttgaaaaataatagctttattggcatataattcatacaccataaatctgctcttttaagggatatgatttagtggtttttagtgtattaatggagttgtacaaccatcatcactatctaattttagaacattttcaacaccacaaaaagaaacctcatacccattaacagtcacttcctgcccatcccccttagccctggcaacttagtctactttctggttctctggatttgcctcttttggacatttcatgtagatgaaatcatacaatttgtggacttttgtgtttgacttctttcacttaacatattttcagggttcatccatttgtagcatgtgtcagtacttcattcctttttatggccaaatagtattccagtgtatggatataccacattttgtttgtcctttcttcagttgatagacatttgggttgttttcacttcttggctattgtaaataatgctgctacgaatatttgtgtacaagctttttttgtggaaatgtgttttcatttatcttgagtagatacctagaagtagaattatggggtcatttggtagctttgtttacctttttgagaaactgccaaattgttttccaaagtggttgtgtggttgtaccattttacagtctcaccaccaatgtatgagggttccagttctccccatccttgtcaacacttgttattgtctgttttattttagccattctagtggatgtgaggtggtatctcattatagttttgatttgcatttccctattggctaatgatattgatcatctctccttgtgctttttggcatttgtgttttttgtttgtttgtttttgagattgagtcttgctgggatgtccaggctggagtgcaatggtgccatctcggctcactgcagcctctgcttcctgggttcaagtgattctcctgcctcagcctcctgagtcactgggattacgggtgtgtgccaccacacctggctaatttttgtatttttagtagagacagggtttcaccatgatggccaggttggtcttgaactcctgacctcagatgatccacctgcctcagcctcccaaagtgttgggattacgggcatagccaccgcacctggccttccatttgtatatcttgtttggaggaacatctacaaatcctttagccatttctttttttttctttccttttttttttttgagacagagttttgctcttgttgcccaggctggagtgcaatggcgccatctcagctcactgcaacctccgccacctaggttcaagcaattctcctgccttagcctcccaagtagctgggattacaggcgcccgccaccactcctggctaattttttgtatttttttttttttttagtagagatgaggtttcaccgtgttggtcaagctggtcttgaactcctgacctcaggtgatccacacgccttggcctcccaaagtgctgggatgataggcgtgagccaccacacccggctagccatttctaattgggttgtctttctactgttgaattataagagttccttatatattctggatataaattcctttatcagatacatggtttgcaaatattttcttccattttatttctttcaattctgtgggttgttttttcactctcttgatggtgttttttgaagcacaaaagtttttaattctgatgaagctaaatttgttttactttcgtcacttttgctttttgtgttgtatctaagaaactgttgcttaatccagggtcacaaaaatttactcccttgcattcttctaagagttttataattttagctcttatatttaggtctttgatccatcttgacctgatttttgtataagatgtgaggtaggggttcaacttcattcttttgcatgtgaatatccagatgtccatgcactgtttgttgagaagaatgtgctttccccagtgaattgtcttggcacccttgtagaaaatcatttgactgtaaatgtaaaggtttctttttggactcttaagattctcttttattgatccatacatctatcctcatgacagtcttgactactatagctttgtagtattaatcaacttttaaaatatatatatatgtgtatatatatatatatatatttttttgagacagagtcttgctctgtcacccaggctggagtgcagtagtgcgatcttggctcactgcaaactctgcctcccgggttcacgtcattctcctgcctcagcagcctcccgagtagctgggactacaggcgcctgccaccacgcccggccaattttttttttgtatttttagtagagacgaggtttcaccgtgttagccaggatggtctcgatctcttgacctcgtgatccacccatgtgggcctcccaaagtgctgggattacaggcataagccactgcgcccggccttaaaatatatttttcaaaatctacattgttcaaaaaaagaatctgtggtaactctcagaaatccaataattacaatagtaaatacaagtaaagatagacaaggaaattaggggagaagacaagaaaataggaaaataagatgacataagagttaatgttagtacaacaactaatatgttgtaaggtttgtgagattgttggaagtagcctgcacatttggccttgagctttctagcagccaagggtaaaatggaaatgtgactaatgacaagattaacacagatgtctgaaagattgtttaaaaaaatgtccccacctccaatattttcagggactgaaatataagcatatttctcccatagatcctaggaacctgagcttctcacgcacaggatcatttcatttgtgttagttctttccctttagacgaatagctctttgaggacagtaactgtgtcttatttccctcacatctccctgtagtgcttaggacaaagcatgggagatgcttacaaaatcttgattgaattctttttcaaattgggaatgtttattacattctttggcagcatttctgccaccaggttgaggttagttgggaccaatttggcggtggagaagtggcaggggctgccctcctggatgcattttagaagtgttttcttgcatcatgcttcctgagtgctggctaagcagtggaaacattgggcaggtggggttgtgtgcccttgccctgagagatggccgtcactttggagtgaaggtaagcagcattgcttcactcatgtggaacccacccgccttcccacctcctcagcgctggagggtcctctctctcgcccactccctctgacatgcctctgagactgcctgcccgatggaaatatccagcatgtatgagggaggtcctggccaaaactgaacagcttctcatggaattgggcccctcatcacctacggttatgtgtggcgcacagatggccactctgcaaagaggcccacccagatagctccctcaccgggggcaaggaacaagccaccttcaactgattacatgtcatattgggtggacctcttcgtcccacacccaataaagggctttaccatttttcagtagcatcctttcttaagagaaacaaaaaatagatttgaataccagtctttaaaggggtagttgtcattacttcgcagttgacagatggggaaatggaggttcagggtgcgttacctgcctgctctaagtcatatggtgagtgggttgcgaagacctgactccaacccagagaatcttgactttgacttcatcctcccctccttccacctgccagtacccagtctttatctaaatttagggggcttgagaggccattctttctattttgggtaccttcaaacaggtaagcacagttttctttgaagttacctctgcctccatgtgggagagtatcaacaaacagttcccccttccccctccaaaagcactctctgcacagtcacccctaggccaggagcagccttgtaatatgccacacatgttgttactgcctgtggcttttcacacctcctgtctcaaatattggagcttttttggctacagccctgtgatgaaggcagtgtgggtgctgttgaccctatcttacccatatggacactacatcatctagggtcaccctgttggttgggatctggagtaagcccagaggccaggattctgacttctggtccagtgctctgccctaggccttgagcaaatgtgtatcaagttgcactgacaatctttgaattcctggaactcatgccatgagcacttccaggagcaccttagtgcttcattacaaagatgatgagacgtaggaaagtctttttttttttcccacggaagcagaatctcacccacacccgcagattttgttgtgtcccttcagcactgagctgtgttctcagaacagaacaggtagaatagagtcaaaatgcaaacagaatggcctccctccacagtctgctttgatggaaatgtgatgccaagcaaacagaaaagttgttttggctccatctctgaggtcatttagttgctatttccatctactttgaatccacatctgctgtgtgctcagagccgtgctggttgccaaagaatccaacaagaaaaaggcatggccccctttggggcgcttgggtcctctcgcagtgccccaagcccaggtgagagacatgccctctgggccgtgattccctcatcagtaaagcaaggaagataatgtctggttaaccaccctcctggagtcatggcaaggctgatacagattcagtggcattaactcatttgttcattcagcacattttactggcaacttatgctgtgctgggctctggatatagtagtgagcaaagaggaagcactcacaagggtaacactgcaaatgctaggagtcatgcatgagaagtccagggagcctgattccatttgagcaaggggtggtggtctgggaaggttcccccaaggaaaagacataggagccaagaccaaagggtgggtaggagtaatcagaagagcatgtctctcatctctggacttctgtagagagacttctgtaaccactgtaccctctggaagtgggtacagaagtccagagatgagagagatgtttaacaacagagagaaatccacccgaaggactttttacatctctctaacatctcctgttcagtttatctcagctggcctttgctgagcaccagttagttgccttgtgcatccttgggtgatggattatggagatggcagtggttgacactgtctgagagcagctcccagataaaccagcgcactgtggttgatgggctgcctccaggtagagagtgaggccctccaagcacatcctggccatccacatcttcacatttgcagtgcctagcacacagtggacaaaagggatatactggacacgttgtcctaggatgcagattcctaccaggccttcaaggcttgtagaaatcttccctaaaactgatcatgtggcctccggtaaggaatctaagcttttgaatcttggatccatctcgggcacagggataacggtggcgcccatctcacggggtgtgtggacgttgtctcaataatgactgacgtgctgagcaagtacctggctggagaagcgtgtggtaaaggggagcagctgtgattattatgggtatcattcctagtggttctgcaattagtcttgacagtaagtgctgcaggacttcagacaaggagaggctacaggtgtggaagtgctcctcaaagcctgtgggacctaaatgggcacagtgaaggagagtcttaggtggaagcaagaaaactgagcatcaggaagggagcaagacccttggtgatgggggtatctgttctgcatggaggatagatgacttctcagccattgggaaaccagctaaccagctttctgcttgatggttgtagtaaaatcccatgattagtgacaatggcatgccaggtttgaagagcaaaggtcaggaggtgagaaagcagataaatgcaatgtttatcttgaaagaagttgtcaactacttggaaatccccaagcttacttcctccaggaagccattctggactacttcacccagttctcatagctcccgggccctccatcttcccagcactgaaacacacactgaaaagggcatttttctaaatatgtctctgcctccccttgtggagggatgtggctccttgagatctggggtcacggctggcgtgtttcgtggagtagctagaaagagtaataatcctttttgaatgcacagcatttacagaggcctcacaggctgaaaatggtaattaggatacacaattgggtcttttgacctcaaatccaggcattttcccaccttgtgggcctcactcaaatgatgaccccaggttctgcctgtgatgaatgagcaggcatggttttgttctgttaggatatgacggtagaagagagctgtttgtcagaaccagcagtggcttcagatcttgaaagtccaactccttcattttacagaggaggaaacctgtgccccaaagcaggtccccccaagttccagcccagtgccaccccactgcacagagcagctgtctccttttgatcatgaggaagccaccaggtccctggtggagttcagcagatgtgccgggtgggcgactctggtgggtgtgaggatgtttcctttcctgctgggaagtcctccaagctcttgtgaaagagatgtggtttgtcgagcatggattttcaaactttctttatagagagctgttgttagcttaaaaatgcctggaaacatgatcaagtgtaatgttttaatgataacatagaagcacatagtactaagcacatgtaatgagaatgtacagaactctctagtaagagtctgaaatttggccgggtgcagtggctcatgcctgtaatcccagcactttgggaggccgaggcgggtggatcacctgaggtcaggagttcaagaccagcctggccaacgtggcaaaaccccgtctctgcccaaaatacaaaaattagccgggcgtggtgacgggtgcctgtaatcccagctactcaggaggctaagacaggagaattgcttgaaccttggaggtggaggttgcagtgggctgagatcgcaccgttgcattccagcctgggcaacagagtgagacaatgtctcaaaaaataaaaaagagagagtctgaaattcattctttcaacatgcttgtgttgggtgctgcctggcacagcaattggtgcccactaactcacagcgtcggggaagataggcacggaacaagtcatctggtgtggtccctgcagtgggggagcccagtgagggcctgtccagcccagctgagaggagactgagagaaggctaggtggcataagtaaagatatggatagcgctttcctcttcagagtgtttattaccagggttagataaagcagatctcatgtattttctgctactaagtagaagttcttgttttgtttgatttctggtgggctttgatattttccaaaaagataataactcattgtagagtaagatcaggactggggccagcagacttgggtccaaaggtgtgtcatttttataccagactagaatcgggtgaggggagatgtaaagagatcactattgtcacggaaggcgctggaaggagctctgcttagaaaaaatgcctttctctaggaggttttcatccagcatgggaacacaaaacaccagtttaaaatagctaggtaaggcttcacagtctctcaatgtgatgtgggtgtcctgagtcgtgaacatcccattgtgcaggataaaatgctggtttctgagctgtctttcaagacacaacccaaatgctgtctttgccatggtgccttccttgggaacccaagccaggtgaggtctgccttttctctgatgttgcctaacttttcctctttgtgtcccttgagctcagggacatgcatcccctgttgtacctagcacagaatcatgcacaagcaggtgcttgttaactgttggtgtgtaccaacaaacatttacggagcacctattagcaggagcacaggccaaggagctggatagatgagcgtggagtttgggggagaggtctgagctgagatatacatttgtgagtcatcattgtatggatgaggccgggctggggaggatatgagcgtagaatgagaaggtccagacctgcacctgaagaacagccccatttagggaatgcagggagagacagaggaaaagcaagatggtgcacagtgacattgaaggtgagtgacgagaccctgcagcaagaggaaaggagcagcagtgctagatgttgcagagaacccagaatggtaaggcctgaaaaccatgtgttttagattctgtaacctggaggccactaggtgaccttagcaagggcagtcatgatggagtgttggggctgaagcccattgcagggaggcccatagtcaatgggaggtgggcagtagacacagagagctgggttattcttgccacacagctgtgctggggccatggcgggggtgggggtgccacagagtgggagccagagagggacctgggtaagggctgaccgtgggtggggagcgcatggagtgctttcagaggccaagtgagtggaactgtctatgaagcagatggatggaaccctggctgaattatctcagacttgccaaagacattcataaaattcagacccgcacacactcgggaatgggaaaaatgaattattttgtaagaagcttatagtccaaaggtagaattgcccaagagagcttctgaaaggaaaaagtcatagcaagttgatatttttaaagtgaaataacataggttggatttttctagtaacttcaaggggtaaagactttgaattttttttttggagacagagtctcgctttgtcacccaagctggagtgcagtggtgcgatcacagctcactgcagccttgacctcccaggctcaagcaatcctcctgcctcagcccctcaggtagctgggattataggcacacgctaccacgcctggctattttttgtatattttgtggaggtggggtttcaccgtgttgcccaggctggtctcaaactcctgagctcaagcgatctgcccaccttggcctcccaaagtgctgggattaaaggcgtgagccactgtccctggccaagactctgggtttagtaagcctcttgcaactcactaggagtggatttctaggacctccccactttcttgcttgttgtttcttttgctagccgtaagtccctggagtacactgggtactttatgggaaaaagaggaacagtgtgggacagactttgccctgggctgcttaacgtgatgtggggaacagaggtgataagagcctgtggcagctcaggcagccctgccatgacctggagttggggaggggtatcaaggataacaagtcttatacacatgccatgctgtttctttggatcaatagatggataatttttaaaaccccctgtatgtatcaaactcactttggagatgtaaggcatggcctctgtcctggtgacagtatctgagtgggaggcctggtaaaatgtctgtgtttaggatgatgaacgccataatctaagactgctaagtgctgtggggtggtctagaagggcagatgggctagctgcgaggagggcagaggcactgtgcaatggtgttgcctgggaacactccgtggagagtgtgggaatctcaccctggccctaccaggtaagaaattgggcctgggaaattgggaagggaatttttcaagcttcatggctgctccaggacttgaactaagactttcctttagagcaagcttgtccaccctctggcccgtgggccgcatgtagcccaggagagctttgaatgcagcccaacacaaattcataaactttctgaaaacattgtaagattttttttttgcgattattttttagctcatcagctatcgttagttagcgtattttatgtgtggcccaagatgacgactcttccatcgtggcccagggaagccaaaacaccggacacccctgcttagagaaagtgcgttttctgttataaaaggaccttgaatccccatctcatatgttgggactttgtcttgcatgttttcaggcagggcatgattgtatctgtaacataataatatgtaagaatgtgtacttcttagcctttgcagagaggcgggaggcctgtttcctgcagcccccgccctgtcctggctgaggggtgggaggcagcttgctggccagccccgctgagtcaccctccggcgtggagcccagtggggatttccacgcggccccagtgttctcttctcctcgtttcctgttgggctgtgacgcaggctggctgccagcgggtgccggtgggcactcctgacacaggccactgccagccggccttgtgggtcctgagggcatcgtgggtggctctccccccacgagtgactgtgcctggcagggtgtgccccacatgtcagttgcactccgttctgggtgggcagctcccagaggccccggggagggctgcagatgggcggggggtggctgcctgggaggacgggaggttttgttgaagagagagcttgctcttggggcagtttgtactgggcgtttagggttataaaaacctagatttgctgaaaacggctctcttttatcttctgacaagaacatttgtgaagaaaacaaaacagaccttcagccatttagtctatacaccgagagaatggtttctacagtatgcctgatttctctgggtctttctaacacatccatgtatgtgcttgtcagcttctagtgcctccatttcttgatatgaggaaattttgcttaaaaaaaaatctctactgataggacctctgcatattcatgcatgtttttcctccagaactttgtgtcccaccactgtgctaggcagtttacaaatgccatctgatttcattcctgccactacagtctaaggctatattgtccgatacctatccaccaccctcatgtggctatttaaatgttgggtcattaaaattaaatacaattacaaatgctgtccctcagtcacaccagccgcatttcaagtgcacgggtaggctagtggccatcagatcagctcatatagagcagcacgttttcatcaccaccaaaaattctattgggtagcactggtctaaggtccggacatatgtccccattttgtagatgaggaagctgagtcctacagaggttaagttgaccacttagaagaatgaacagatgaaaccttttcattttacacatgaggaaactgaaggttatactcccctttccttcttagaaaagagaaattgatctgtaggcttcagggactcttcagttagcctgggggtactgtgcgggtcagctcttttgctgttccccccagaccctgtcagctgtgggtggtggctggtttctcttggtttcctcaccagagtttgggaatgagcaagtcaggactgctttccgtacggtaatcctttggcccatttcctatcgggggatttatggagctggtgatctcttgggttttttggccatttgttagagccaaaagaggtcacaggaaatgatatactagtttcattgcccaaaatactgaggtccagagaggtgaggggatgctgagggtcttgcatctagctaagagctgagctggctcttaaacttgttttcaagccaggacttacctgactttcttaggaaagtaatcactccatagacaaggataggtttttttcacagagcaatgatgttccctgtggtccctatgtagggtggtaaggaatagggctttgggatcctacagaccagggttcaaatcctggccccaccacttgtaagttatgggacttcagacaaggacttaaacattctaagtcctcagtttcttcatctgtaaaacagggataaaatatctcagtgaatttgttttaaatacttgcgtccgggcatggtggctcatgcctgtaatcccagtactttgggaggctgaggtgggaggatcgcttgaggccagaagtttgagaccagactggccagcataacaagaacataacaagatctcatctctacaaaaaattaaaaatattagctgggcatggtggtgtgagcctgtggtctcagctactcgggaggctgcagtgtaaggttgcttgagccaggagttaaagtctgcagtgaactcgccactgtactctagcctgggcaacagagtgagaccctgtctcaaaaaaaaaaaaaaaaaaaaaaatcagccaggcgcagtggctcacacctgtaatcccagcactttgggaggccgaggcgggtggatcacctgaggtcaggagtttgagaccagcctagctaaaacatggtgaaattccgtttctactgaaaatacaaaaaattagtcaggtgtggtggcacacgcccgtaatcccagctactcgggaggctaaggcaggagaatcgcttgaacccaggaggaggagtttgcagtgagccaagattgtgccatcgcactccagcttgggcaacaagagcaaaactccgtctcaaaaaaaaggaaaaaagaattctaacatgtttgagattgactgcaattcctagcatattacaagtgttagtaaatagtagccattaatattatgagcttatcatcaccttcagccagcattctaattttacagtatagaatccagtacataggaggcactcagatagacgggatgccccaaaattgggagacggacaaacttattttgaaatagtctttttttgacatttccaaagaatatactcaatgtttttctgcaaccctttgccttctttttaggtgaaggacctctacatttaaagcagtgggttcaactgctaacctgaaaagctataataaaacatcccagagtatccaaaaagcctggaaacaaagggaaaatagtgtgtcctgctttccaactttcggatatgctgtagaatagactgaaacaaatcactggaaaataggttgttgtcgattttatttagaagcttttgttcctttggattttcgtctcttatttttagacagagtctccctctgtcacccaggctggagtgccgtggtgcaatgatagcttactgcagcctcaaactcctgggctcaaatgatcctctagccttgacctcctgattagctgggactacagaagcaggccaccacgtctggctaatttttgtatttttctgttgagaagaggtcttgctatcatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaacttcacaacctgggtccaagaggctggaggattgtcagtctttagaaaaaaaaaaatctattatctttagagaagatggacttgttgaggaagaagagtagacaaatactttctggaaatattttcaaagggaattagaaaaagaaaaagattttggttgtcctttggtgaatgagaatattcatcagcagaatgcctcattaccacgtcacacagctgaccaaggcctcatctgagactgtgtttgaatagaaattaaacagggctgacagtgaagtttctgcttttaattagctttcaaaggtacacctctacctgtgatgttgaaacatcttgaaaaacctctctgctctgtgcctgaatgaggggcatctagagggcttggaagagaagatgtggcacagggcagccggggagaggctggtggccagaagatggacctgagcttggtgaatttacctggcatctgagcctggcctgaacaattcagaaacctcatttcatcagtcttggagtcagggctcctgtctcttagcaaaaagctaaagcatacatcaagcatatttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcgtttaaggcccatcttcaccccataaatgccagctccccaaggacagagccctttcctgtcttgtccacaccatgttccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggagaagatagtcaccacccacacaggcacactcttgaatattccaggacgaggtgggcactcattagagggcagctcttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtctcctccctctgtttctgcagtgcctccccctgtaaaaaaggaaaccaagaggctgacaggttaagtgacaggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctaggttcagatccctgcttttactcctgaccacttagtaaccttggccgagtccctcaacctttttgcctcagcttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatagctcactgcagcctcaaacctctgggctcaagagatcgtcccacctcagactcctaagtagctgggactgcaggtgcacgccaccacacccagctagtttttaaatatattttttagtagagtgaacctcgccattttgccaagcctggtctggaactcctggcctcaagcgatcctcccacctctgcctccaaaagtgccaggattacaggcctgagccaccacgctcagccttctaaaagtattttggtgtgcaccattagcactgtgtcttaaaggcgatgtgcaccttgagcacagagtgttgagtgcgtggtggatggatgtcatttgcgttttacagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggtttgtttagccttctagagcagtgttgccggatatcactgtagtgtgagctacagtgtatggtagcccccacttgttcttggttttgccttatgaggtttcagtcagctacagtctggaaataggtgaatatagtacagtcagatgtgttgagagaaagagaccacatttatataacttttatgatagtatattgttataattgttaatttcattattagttattgttgttaatctcttactgtgcctaatttataaattaaactttgtcttgggtgtacatgcacaggaaaaaacacagtgtctatagagtttggtactgtctctggtttcaggcatccactggtggtcttggaacgtattcccctcggataattgcaattacttctaaaatctaaaatcttctggccatgttaaaatgtaaagagagggtgaaattaattttaaatactatatcttgtttaatacagtgtatcccaaaccatcatcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagcttggtcttcttcccattaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttccactcacctgacctccttctcttacaccaggggtccccaaccccggggccgtggactgatacccgtgtgcggcctgttaggaaccgggtctcgtagtagtaggtgagtggtgggcaagtgagcattacggccagagctccgcctcctgtcagataagcggctgcattagattctcataggagcgtgaaccctattgtgaactgcatattggagggatctaggttgcacactccatatcagaatctaatgcctgatgatctgaggtggaacagtttcgtcctgaaacatcccccccaaccctcatctctggtgccaaaaagattggggaccactgccctacacagagaaagagaatttgcacgtagcaacttaggcaaagtattcaaggaaagtgccaggggacaggaaggacaccatgggctggtggcctgttcagtaacagcttcagggtatcagttcagaaggcctaggcctgctttggttggggtggtgtatgtgtaaaagcagcattctgtctaatcacaggttctgcctgaaaggcagacacttttaacccttcggtggacagggttggtgatagctagtggggggtatgaggtgggggtgaggaggtggtggtgggcagcaattgcagaggccagagatcttggctgtgttctacctgccacgctgggaatgctaagtacttctcaagccttcaagcaactgagactttctgctcggggaatccccaaggatttggggaggctggaattgagcaagctcttgaatgcatgcatggattcatgcagtcactcactccacaaatattcacgtgctttgggccagaatgatttcggcaggaatatcttgtcctacatgctattgccatgttctctgaggacccgcggcttcgcatgtgtaaatctccctccagagtactcggcagattcccgaagctgactgaggctcagggagtgtcagtcccttgccacaggtcacatagtactgaatggaagatatgggacctcagaaccaagaggctttgactcatttgtccctctttctgtctgttttgccatcagccaggagatagtcgttgagttgtttctatttgccaggcatcgagctgtgttctcgggtttcattgttgttgttttcattttgagtgtgtttgttttgttttacttttaggagcaatcacagtgctcctgttgctgaatggtggctgatgtctgttgcatgccaagcactgcgcagggtgctggtcacagtttgctccagggattcctcccagtcccgctgtaaagaggaggaaactgatgctcagagacttggacctttctgaacatcatgaagctagggatttcagtcccagcctctctctcgagagccctaacttagccactatacctcactgcctctctgtgaccagggttgagtcctggtcctcaaatgaagcccgatttgccagaaccttcttttgaggccttacctggtcttcagttttaccacgtgttaattgggggcagggcagccagtccatcctcttctgcagaaatcaccctgtccaggagatgggtgcttcttcaggacactacctggctaagaacactgcattaacaggagatagagatccagtgtgtgtgaaccttgtgaaaacatctctgtctgttcctccaatctcccccttctgtcttatcatgcagggcaagctcaggttgttgtcctgtctctgttgggaggacccttgagtggtatctcctatgcccaagcagacctgcagagaaccctgtccaaactgatggtcatctgagacatggaacttcatgataggaaggtgtcttggaggataactagcaagtctttcactttatagagggggaaactgagtcctcagcgatcagccacatagattctgtgttgtagagacctgaggatgtgtctcatctccttatctgaacagcaagttcccatgctgcgaacgtctcaccctgaccctcaccgtattttttaggaagtgaatggggctttgagaaggacaacctcactgttttgcccatttctgagatggaaaatcaaggaacattgccccatctccaccccgggaatctatatgcccctcccataggcaagatggaagctagaccagaatgtgcagcttgtgcttcttgcgggaatggtgaggacagatgagggcagggagacagcattcctaaacccagccttttgacccaagaggcagggactccaaggctgtagaatgggaggaattgtgggaggaaaagcactgggcagaaggtctcagtcaaatgcacctgcagttattagctatgtgacttgggcataatgccacctgtgagcccccattttcctcactaggacagtgaactcaccaataggtttgagttgttgccctcccagaactgttgcatgaattgaatgaggtgccttgcttaactgtactgaatactggggaagcctgcttaaatggatgacaggctttttatcattagcaagctgccgcactccccactcatcactccaaggcagaccattgcattttctttcattctgataaactccttgagttgaacagaaatcagactccccgtaacttctgctccacagtttaaaacagcccaccatgaagccttatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagcccaagcagcagagaccatggcctccctgatgtggggtctgtgcctcttctccaggcaagtggctgtgacagtctaactttatggaagggtgaactcaatgacattggctgaactgctggtgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattgggattttaaatgcatttgggggatgggctgcgtttctgtttgcctctaaaaacaatgagaaggcaaacaaagtatgatcctatcgccagaaaaatggagccaaatctgaaattaatttacaaagtcattagtattttccatttgtgacccccaaaatgaatgtaggtgtagttccttgcaattaactgcaaattaggaaagggttgggaggatgtttcagggaccaacacacagaactgtagcagaagcagatgggggaatggaaccaagaattgccttggttttcactcaaggccgtggtttgggagagtagtgccgactcaaatattccccagaagagagcactttttcaacagtctgaaaagtggcagggacctttggaatgatctgttttaaccttttcattttctgaatgaggcaactgagagattcaggaagggtaagcgacttgcctaaagtcacatagccaggaaggtcagaaccaggaccagagctctgcttctgactccctggccagtgctccagctgccactgcccccctctctcctgggtgcttgtctgcttgtgcctttaatgttcagcacttgagatattttcacgtttagcaccttcacgtttagcagtactcctcattagaggaaaatgggatgatgtgggcagagtcacccacagagtcactccaggtttcagatgtgctggtgcttaccgagtgccacagggagaaagtggtggtttctcccttcccttaagaaacctggttatttccaaggctcaacccctgcaacgccccaccaagccagtcacccaccactgcacattgagaatctgctgctctgtgaatgaaattggcctggggttaatgagtggtgaatgtgtgtcagtgtttggtatttgcagcaggagctcttctgcgattccctaagctcagatgaacggggcctttaagatgccatccagccatcggagagatgcaggaaaggccttttgaaatgctgtttcccctgacctatttgaggtgaggccctgtgatgtcatttccccagtggtgtgtgtgagagagcaagcagcactaagaaaagccactgctgagagttcacagtccttgcttcagtgttgtcttacgctcggggtgccttaaagggcttacagcgaccctacctccagcttctccagctccctttccttggcaaacacttgacccatcccagccccttgggctttctttcctcctcctctgctaccacatactgtgggtgttgggaaattactaaaggcgcgactctggctctcaaagactctgaagtccaggatcgagaagaactgtgtttacacggagttgtcaaggatcattctgccaatgataacctattatcgtgcaactctgtgccaggtcctgctctgggagctttatgtgtgctgttgcccctcacactcacggcagaggtgagacagaatgctgagagatttctgcagacaaggaatctgaggtttaaagaggcaatgtttgatgagccactgaggggtggggctgggattggaaccgaagctggctgcccttcagcccccagggtcctgctggggagatgtacccagggggtcctgtgctgggagagtggaagcaggggtgtcactgggggctttgtcctgggagctgggcaggtgctagggacagagctggcctggttttggagccacaggagagaagatggccgggaagagctgtgtttggaaggttcctttctgtgccaggggtcagcaatctgggttctagcactgagaggggcaaaacgtgggtttgtaggggagagagggtgacccccagtgagggtaagaaagataagctccagtgagctcttctcaccctgggtcccagcctgtaccaaaaatccaggggcagcccccgggcccagcctgcccccttcacagtcccctgactgcttgaggctgtgggccagtggctttgccccttggaagcttggtttcctcatctgggacagaaaggggtcaaaacaccctttttcattgttaagattagataatttgagagccaaaacttcttgcagggtgcctggtaccaagtaggccctctctaaataaataaatgatagttttcattttcccttccacttaattgtttttttttaaaaaaaacttttcttccctgtaataacaaatttcagaagacaagttaatacattgctgtgtatactctcaggccaagaatttcctcagtgtttacataccagagcagtactttgaactttgattttctcctctgcctctgtgctggttcagacaccctctctaagatgccagaagcattgccctgccttggcctgttggtggtggggtatgtgtgtgtgttttcatcgtattataaaaacgtgaaacatttgaattacgggcaagtggtattctaccagatttaataaacgttaatattttccatattcacatcaggtatttgtaacatctctttctttactaaaaataaaaaccttctgctgaagacctcctgttactccaaccccttcccccttcttctcgctcccgtttcacaggtgtttactctcttttaaattggtgtgtgtccttcccagctagaattttgtagtgtattatttgtaaagccaaataaccccactgcaatgtgtttgaaccaccaaagcaaatgatcaccttttgggaaaagaaggctgaatatccaaggccagatcagtgattcaagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttcatgtgaggaaacacatcccagagtcagtcattcttttttttttttttttcttttcgagttggagtcttgctctgtcacccaggctggagtgcagtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggcccagagtcagttattcttagagcaggtgttttggcttttgtctttaatgcttccctccccactttaacataactgtaatatataattattgtggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgccagttcatcaggctggggtctgacctctttctggtgtctggtgctgatctaggcaaggtgacaagtgctcaacagaggagtcctggttccttcaaggaagctgggaagtgtaagacggagcaggctgcgtttgtggtttttgccaaggcttgacttttgaccacttttctgaaaaaggacaagggtgtttttttgttttgtcattttttttcccagtagatgttcctatttggttcacagatataaacacttgaaccaggtgatatcagcactgcaagttgatttagtaccacagccattttctgtgtaccaatatgaagctgttccttcataagttcttccttttcgcttttttaaactgaaattattttcattaggatcactaccttcccatgtgcattttaccacaaaatttggttctgattctgttggcttgcttgctgttagtactcatgttagcttctgccattctttccaccattgtcctgggtaaaattttgcatatctgagttgttggattctttcatcagtttttggttagtgactttcatggtctgcagttttagttgctttcagttttattttgtgttgaagttttttctatgaggtttgattttttcagggtcagtttttaaatgtagcaaggagtgtgctttttcagtttgcttattattttcaacaaatgtttttggtgggtaattttacctttgttgatcaccagctttgtttggggtgcatcatttctctcaagccgaattttctctggtaatctggccagaaggcccatagggtcagaatggcaggtcaaaatgtcttggtgctttcttgaagagtttgaaacaagcttgcaaagtactgtcctccctttggatttcttctgtctgggtgttgccagggctcttctgttagcgacagagaaaataggaggtactagaattcggacttctaggaagggctgtattgtccttatcatcagaatccctccctcccgtccctgtgacctcccaacttcacaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctctgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatatgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttgcgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcaggcaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggccaggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaagtaacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtgtaatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcttacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccctagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgggaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagtatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttacccccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 127 - DNA, 54830 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggtaaccgcgccatgtcccctccccttcccccggccgggcccgcgcaccccgcctgtggcttccccgccccggggcgggctcccgacgacggcggcggcggcggcggcggctgggagcgcgcggaatcctctgggagggcgaccgcggcggcctgacgagccgggccgggcgggccggctgaatgccgggcggcggtgcctcgcgtccctcgggcccccagctccgcttgcagctcgtgggagaatcaagttaaactcggacgggactcctgccgcggccgccgctcctctttgttgttctcagtagtttcacggtcgccccggctgagcgcgttgggtcggctggaatgtgttgccttagggtctaagtgaaagttgtaaattgtttgtctaaatttattttctccagccaatttctgttttgtctttgtcccctactttctcttcctagtcttgtcatgccagtttacgcttctggctttgatatgtttactttttgagtactgagagtgacagcggtatgcaggacacattcttagcacctaactgaacccctccttgcccccaataaaacatgcttcctaataaaagacacagctgatcttactgttagcactgcatgtactgacagtgaaattggtgtagggtggagggcggtggctccatcacttgtcccaaactgctgttaggatttctcaaactagattttcaaagacacaagtgtgtttagttaacctgaaaggtttatttgctggtgcagaggctttaaaaagccctgttgaagattgatagctgtttcccttcaaaaacctaagtacgtttgtttttatttaaaaaaacacatttatttcccaattagtttcttaatgcatttagtttttgcaccgtagtttaaggtggaattgccagttatttaggaataataaacacaacaggataatagcggaattaccctgaattgactttctgcaaacatataatcttagctaatttttgttagtaacctttgacttttgccagaattagcatccttctagtcttagtagcagcttggttactcgggtgttttaagaagtaggttcactcctttttgctggcaaaaaccatttagtatcaaaaaaaaaaaaatgcgtaatttcgtaattagatttagaacaaggcatttgaataatttttatggtggatttcataaattacttttgccataccctgcagagactagataatatatatttcagttgaaatctaggaagttctaaaatgtaacttttttttaatgctaaggacttactctctctatattggaaagttctgatatgattagtacataatattccaaactgtaaaatgattaacatttaaaaatacggtttttaaaattagtgtttcttccataatgctgtcatgattttgtttacttaaatgggtttgttacagaacaaatgtaatagagatggaccaagcatttgtaattcggagtagctttaggtctaaagacgatggtgaattatgtaggtttaagttgttggaattaaaactaaaagcttcttttgataaaagtcgttataacattttgtgactctattaatagaagtggctttttctttgctttccaggtttttgggcgagttttaaagaagtattgcatcttcgttttttttatttttgaagtgggagtgtatgtttctgtttaggtcactgccttcattgtaaatcttgagtttagaaaaaaccaaactgcaaatctgtttttcagacttaatgaaaatttgtgccgagaaagtcactttgaaatattttggaataagttttacatgaatgattgatcttttatgatagctttgctgtttgaagcaattctccctctactaggaagcagcaaatcttacttttaaaaacctctgcttcactttcttaagctacattttagtcgagcgattgtgtgtgaattctttttctgtattccccttcagtttttctttctccccgcaaattaaggagcgagaattaacctaatttatgctgcccagtcacactccagctctcccacttggaagcagtttttttctgattgagccagtgttatagtaacatcattagacactattctaattgaggtgtgagttactgaggcctctgctagggaggttaaccctacagaatctgtagggttcattatatttaaactgcatatttcggcttgtctaaatttttgcctattttggtgaaaacatgttgttttgtcgatgtttaaacttagttcattttgtccctctctagttcatgactaaccatttttttcatttttaatccagcgatttttttagagtggttctttaagcatcttgtattagccatttcaatggtcattatatatgtttggatttctcttattttgttgaactagaagactgtgtggttacgccccaaaatttttttttgtcttaaagccatgatgaatggggtgactctgaggtgaccattaatcgcgtataaaagtaacctgactaaaatgttttcattgttttctacagttaaaggacttacaccagcataacacagcatttttttttttttttttttttgagatggaggctcgctctgttgtccaggctggagtgcagaggcgcgatctccactcactgcaaaccccgccttccgggttcaagcgattctcctgcgtcagcctcctgagtagctgggattacaggcatgtgccaccacgcttggctaatttttgtgtttttagtagagacgaggtttcgccatgttggccagactggtcttgaacaactgacctcaggtgatccgcccgccttggcctcccaaagtgctgggattacaggcgtgagccactgcgcctgtcctataacagcatttaatacagttttgtaaaattatcacattttgggctttttgttcaacagttgatgaagtctcaattgttttaaaatgagaaattcaaacagttcacaaatatatctagatatattcatttgagctacttgtagaatgatgctgtttgcatatatcaagcatatgcttgatcataagtcagatttagaatttttggattttgttttctctttctaaaatgtgtaattttggtaatgggaaatttgactgaattccagtttctcaggaacaaggtattttaggttgtgtcaccttaacactattacctggtgtaattggcatccgggaacatttgtttttaactatgagagtgaatgaaaactagggtagtgcttacatatgtaaaactaagatggtaggtagtcggattcttacaatttataaggttctcataatctaagccttgatgagttgctactgcaaattatattatagatcagataagtaccaaagaccagttgtaaagagggtctgttaacattttaatcagtttaaaattggcggtaacagtaaagaccgttcagcccaaagactgtatttcattatttatattccaaatgagaattttttgcagtttggaaaacttgtaaatgtgttgaattcatctttttattgcttttttactcccaatgtttagggcaacggtcttttcttctctcctgtctccctccctccctccctttctccctttttcttctttttcttctttttctttttttttttctgagacggagtttcgctcttgtcacccaggctagagtgcaatggtacgatttcggctcactgcaacctccacttgctgggttcaagcgattcccctgcctcagcctcccgagtagctgagattacaggcgtgcgccaccatgccaagctaatttttttgtattattagtagaggacggggtttcaccattttgggcaaggctagtcttgaactcctgacctcaggtgatccacccgcctcagcctcccaaggtgctgggattataggcatgagccaccgcgcccagcctttttttcctttttctttccatcttgctcagtgccccagcctggagtacagtgctgcaatcatagctcactgcagcctctaccacccaggctcaagcaatcccacttcagctgctgcggtagctgggactacaggcacacaccatcacacctgtctaattttttgaaaaatttttgtagagatgggggtctctctctgttgcccaggctggtcttgaactcttgggttcaagtgatcgtcccacctcgacctcccaaagtgctgggattaaaggcatgagccaccacgcctggcaagtagttttcaatcttggctgtacttttagatcccttgaggagctttacaaaatactgatacctgaattctagccccagaaattatgatttggttggtctagggtgcagccaggttagccctccgcagtgattgagtcattagggtcctctgactttttcttttgaactgtttcacttgtgttagctttacattctttaatacagtgttacacacatgtacagtgtagccatctcacacatctaacttaacgggtcttttgaaagtattgccacatttgctttgcttctgtgtctgtctctttcttttctctcccccttcctgtcacctattcctttctcctctgtttctttcttcactttcagtttatttgaactgtctggtagtaagttttaggaagctgtatttcccatgatgagaagttagtatatcatcactattttaaataggaagttgattttcttttaaagtatattctcaaatgcttacttgtactccttttggagactaattactttaagtccccaagttagcatctgaactccctgtgggcttggtctggtggctcacatctataatctcagcacttcaggaggctaaggcaagaggatcacttgagcccaggatttcaaggccagcctgggcaacaaagtgagacctcatctctaaaataaataaataaataaataaatataactcccaatgcaaattgtcttcttagggcgttaatctacttggtaaaccttacattttcaagcccccaattaactagtcacttaactggtttctgagaggcaggttgcattgggctttttctgtcagggcttaattaatacactgtgagacatttgctcagctaggccagctagctagtacttctgtagagatcatctagggcatgttcagctctccatttacatcacctgaagtagttcccaagtgctgggctatggagtagtttcatctctgtctctggaagagctatttaaaaaaataaaaatattttttcccatctgattgcaacacacatgctgcttcagaatgggaatggagtggaggaggcatgggaatctgtgttatttttaaaaagtgcctcttgattctaaaggttttgtttattttggtatgcttatccttactgctttatttatctattttttagagacaggttgcccaggatggagtgcagtaacatcatcatagccctctataaccttcaacttctgggttcaagagatcttgcctcagcctccagagtagctaggactacaggccggcaccaccacgcctggctgatttttttaaaactgttttgtagaaatgggggggcgggggtcttgctttgttgcccaggctagccaaatcttatttatgatttaaaactaggaatgctaccgaatatatatttttatagtaaggtattatttctgtatgttaatatggatgaatgtatgctactcaggtcttttcaagtcaaaatgtatttctaaatataagatgaattaaggatatttgtcagtgatattcactagtgaattctagagcatatgttatcagtagatgggcagtccttgtaaaaattgaataatctagtgaaaggatgaccggaaataatatttaatggggtaagctaagccaggaatcattgtacataaacacattaggtgtgtcttacatcataaatatgcctactaaaactagttgaaggaagaatgtgtatagatgctgaaataatgaaggggctggctaattgtaaggaaaaatgatacaacttctatataattagtctttttaatcagttgcatatactcatgatacttaatttgtaaagtaaagattgtagactagatcaatgctttgtaaaactaacagtacctcagacttccagagtgttttttaaaggtacagccccacccttgattctagttagtggagctggcctaacctgcgggggattttgatacatccccctttgaaggaataagctagatgacttgaaactctgcttcagttaaaagttttatgaaatgaggccgggtgcggtgactcacgcctgtaatctcagcactttgggaggccaaggggggtgcggattacctgaggtcaggagtttgagaccagcctgaccaacatggtgaaaccccgtctctactaaaaatacaaaaattcattgggcatggtggcacatgcctgtaatcccagctactcacatgcctgtaatcccagcttcttgggaggctgaggcaagagaattgcttgagcctgggagacagaggttgcagtgagctgagattgtgccactgcactccagcctagctgacagagcgagactgtctcaaaaaaacaaaaaaagttttataaaatgtatttttcagttatcagttattaaaattcagtttggtttccaccatcttttaaaacagtggttcccaaagtatggtccacagactcctggagatccctaggatccttatatttaaggggttcacaaaatcaaaattattttcataatgaaactgagacgttatttgccctttcactgtgaggacatttgtatgggtggtgaaggagcagtggtgggtaaactgctggcactttaaaatgactctaggcagttataccaaacatatgagtcctcattgtgttctttatagtcaaacacacataagcatttgaaaaaatgccggtttcacttaataatccccttgctgcagcagtaaaaaggtttaattttaaaaaaatctctaccttggagtatgtctttttaatagtgtgattaaatgggaagtatgcataaagcatttctgcacattgaagtacagtgttcttttctaggaaaagcacttgtgttattgagctgcaagctgaactagctgctttttagtgggacaccatttttatttttatttaacaggatgacagataagctcagatagctatttagatttgagtatttggcaggtaattccttggaaatgaataaagtgagctggccacttcgaggagaacatttatagccagtgctaaaatctgatgtttcaagtgaaaatcagatttttgggaaactcctgtcactatgacttgccagtttcttaatacttaaagacttttctgatgagatgggtggtgatattaaggaatgtgattaaaaaaaatatgttgggctgggcacgatgatgcacacccatatttctagcactgtgggaggcggaggtgggagaattgcttttggccaagagttcgagaccctgtttctacaataacatataaaaattaggtgtagtggcatgtagttctagctgctcaggagggtgaggtgagaagattgcttcagccagggagttcaaggctggattaagctaggatcgcaccactgcactcgggcctaggctacagagcgagactgtgggggggggggcagtatgaggaagtgtgtcaacactgggaagatctgtgtaactcattgaaccaatattttcccaaatgaccaattcatgttacaaaatcgtgcatgggtaggcgatccgttcaaagtacaacatagacaaatggatttttatatacaccagagccaaaaagttcactgatacagtgaattccacattgcaactaacctttcagaattgccacttgagttttggtgttgaataaaagatgaatatccattgttttctgagaaggctgttaaaatactcctctcttccaattagctgtccatgtgagacacgttttcttcatgtactttaaacaaaacaacatatcatagcagattgaatgcagaagcagatatgggaatccagctgtctcctattaagctaggcattaagagaaatttgtgaagatgtaaaacagtgttactctgattcctgactttgttttagaaaattctgtttttcataagatgtttatattaacgtaatgggtttattattttaaatgaattaataaagcaaataccaaaaattttagtagttttatttatttataatatgataaatatcaatgtatatagcccgcataaaagctatttggtgtctttaataatgaagagtataaataaaggtccaacttggccaacatgacgaaaccctttctctactaaacatacaaaaattagctgggcatggtggtacatgtctgtaatcccagctacttgggaggctgaggcacgagaatcacttgaacctgggaggcggaggttgcagagagctgagaacatgcctctgcagtccagcctgggcaacagactgagactatgtctcagaaaaagaatatgaataaagggatcctgagatcagagagtttgacagctgctgttttaaagtaactatttctatgcattatcgactaaattactgattgattgaattgtttttatggtttgtactatattgctgttatttctaaggacgttagtcattcagtttctgttcagttatcagggaacatgtaagagtcagacttaagtaaaaaggggaattcattggcttggtctggagatagagctgacctcagattgctatatccagggtttcaagcagcatcaccaggactcttgactttgctttctttctgtttctcaggtagtttgcaggctaactatccccagcttcaaggaagcatgaagagggccttcccccccccacccccccacccccccaccccccgtagttccatcggaagtgctagagctatgtcacttgcctgccttgcgttctttttcatcagaaacaacactgtggccagggggtggctctggttagtctgggaattgtcccacctggccagatggggagattctccttggaaaatcagactgctgttttacaaatggagaaatacatgctggtacacaaaaactgatgtccacctatagtactttgttatttcttcttttaacagcctttaatttattaatccaaaaagggtaatttttaaataagatcatttaaactgaaggtggcataccaaaatgacatttaagacacataggtaaacaagaagcatacatctcgatttgtcctttgtcattcatcttaaaagttaaaaaaaaactttttgttgcttttattgctgtataaatgtgctcttggaagttcgccaactgccctcagtttgaagaacctcaacttgctgtctaggatttagtctttagcttgtgctgcagacagttgcactaaccgtgaacacctttttttcctgttggtaaacctaagtttagagtttattcctagtaataacattgatatattaccaggcccagcttttttctcctcccctagttaaatttaagcacttttgcgccgggcatggtggctcatacctgtaatccagcactttgggaggccaaggcgggcagatcatgaggtcaggagatcgagaccatcctggccaacgtggtgaaacttgtctctgctaataatacaaaaattagctgggcatggtgatgcgcccctgtagtcccagctactggggaggctgaggcaggagaatcgcttgaacccaggaggcagaagtggcagtgagccaagatggcaccactgcactccagcctgggccacagtgaaactctgtctcaaaaaaaaaaaaaaattttaagcacttttctcaaatattcccatagtaagtagtttattgatcactgatcaaaacacttacaacttctagaaaatacatgtttgacacatataatacagttaattcaaaagtaaactaacatctgagaaaaaatgtcaacactccttacctaaaatacatgaatttacatgagaacctctctctggccagtattcagcctgtttaattttagagagtatcttaattagtttggttatttggctttctcgtccatttattagtatacctatggtcaacgtcaggtgacagcttacaattaatagcaaggctagaggaaaaacaacaggcagataacaagaatcagctgtctcttcttgctaactctttacctctcataactcttgactgcatctaatacctgtatatgttagtgcctttcagataggcctaacttctcatctcttcaaactcaagatatctaaagctgaatttgttacatacctgcttttaaattttttaatcattgagttatctagaaatgggtcgtcttttatttgtcccccctttttcacccttcatatttcagttggttaaagactccagtcttttctacctagaaatagctcactgatttccccctcccctccttggcccattgcccatgccccagtctaggatcttaccgcttttctggtaattgtttcctaactggttttctatttccttttccaaagctgttctccaggctctcactgaagttttctaatacaaatctaatgctgttttttctcctctttctaccatgaacctactctagacaaagctcttatccgtctctgcttttcctcatcattttccttcagcctggcaaattcttattcgtatgtggtaatccattaatactattctaccaatattctgatggctgtcccctggcacatggtagtattgtgcttctttgtctccctcatccctaccttgaaattaggcatggcccagagtttcttgcattggcactgttgacattttaggctggataatttattttgcgtgttgtccagtgcattgcagggtatttagcagcaaccatggcctttagccaccagatgcccagtagtatccagttgtgaccatatattgcctccagatgttgccaagtgtcccctgagggacaaagttgcccctggttgagaactcctggcatggccttatgactttggccagtcaaacatgagcagaagtggtagcctttaaaagaagatatatgagctgtcctatcccttctcctgccatttaaggacatatgtagaaatggagcctttgtcagtctaatttctgagcgatgacagcagtgcccccagttgatctgtgatgaatgtgtattatatcctaagcagaaaataagcttttgttttaagctactgatcttttgggggttggttgtcactgcagcatagactagccaatcctgactgatacgttgtgccaagacctaggttacctatgaactttccatgctccctcatttatagtcccaaatcactttatacctacttcttttagcatttattacttatgtaataatatgtttgggtcttccagattagtagttctcagtggagtaagtactgctctttaagggatgttgtagaaatttgtggatgggtttggtggattggtggccagggatgccatcctgcaatgtgagagacagcgaataattatcttgcatcccacaagactttcagatgccccagaaattcatgtaggaggaaaatataattagcccagaacctaactctataatatatattcactttgccaggagttaaatttcttttaattcatttttttcttgcctgcctgcctccctccctccttccctccctccctccctccctccctccctctctccctctctctttctctctgttttctttctttttccttcctccctccctgcctccctcccttacttcaggctctgttacccaggctggagtgcagtggcgtgatcttggctcactgcaacctctgcctcccaggctcaagccgtcctcccacctcagccttctgagtagctgggactataggcatgtgccaccatgccccactaattttttgtattttttgtagagaggaggtctcactttgttgccaggctggtcctggcaaccgtgcctttgttgccaggctggtcctgagcttaagtgatccaaccatgtcggcctcttaaagtgctgggattacaggcatgagccactgtacccggacttggttgttttgttttttatttttgagaccaaatcttactctgtcacttgggctggagtgcagtggctcagtcatagctcaccgtagccttggtctcctgggctcaagcagtcctcctgccccagcctcttgttaattcattttcttagttcaagttgtttaagagttcaccatttgggaaaatccatgttactgactgcagtgccattgtgctatttgagttgccagtataacacgtttgtcttggaaggtctgaatttgtagctgtcacatttgtaatgattctgtatataagtgctagcatctaacttctttattatacattctaacttagttggcatgcctgagtatttataggtggaagtacacattatatattaagcttttcctcctttttgttatagttagggcattgttaaattttcaaaatatgtttaagtagtttagaattttgtttcagtaaagctaaggtggtgatataaattatttgttggaaaaaaaatgggatgttggtctgagagagtccagacccactttcttactatgggcttcctgtttttgtatctgtagtgctttgtatatacagtgtttgttgaattggtcaatttatgtttcccacatttcttttatgtacgttgttgcatctaattaccacaataaatttgtgaagttgtcagggcaggtgtttccattttatagatgagagaattgagagagatgttaacattcagtcatgcggctagacctttaattagaatatataattttatttatatcgatattatgctcttgcctaccatacttccataatctagaaccatttaatgtaggaatacatctctttattcctgctagtattattttttatatgcataacttttaattatgtttcaggcacttgtggtcataggaatacaataaagagagagatgagaaagctgtttgtttaagaaagcgaggtcattatcatttgtattcaaagcaacttggtattaaaacaaactttgagataccgttaaggccccagcatagcataaattttagaaatgatgacatttgatggtgagattgtggtgaaatagttaacacttaaacattttaattgcattgtagattcatacacatcttttggaatataatatcagaaaatgacttcaaaagtgtctgcactcttctaatttgttgtaagacaattccacagaataaaaagctatggtcagtccagaaacacttgcctggtatatgtcaggaactgtgcatggtgctgggaatttctaaaatgagagtgttgttgctgttttcttggatttctaatttgtggcaacaatgtgagacagatatgtaatcaaataactaatgtgttacattgtaatttacacatgtaatttacaattaaattgtaatcgtaattgttaaattgtaatttaacgtatctttccttttccctctttcccgattcctttcctttctactgagtctcactctgttgcccaggctggggtgcagtggcacaatcataactcacagcagccttcaactcctgagctcaagcagtcctcctgcctcagcctcctgaggagctgggactacaagcccacactaccatgcctggcgaacctcctacatttttttagacagattttaatagaaaatgcagaaaaatgcgtaatgcattttaggaaaaatcttcttgtaaaactattattatttttttgagatagggtctcactgtgtcacccaggctgtagtgcagtggcacaatcacagctcaccaaggccttgacctcccaaggctcaggtgatcttccagtctcagctccccgcgtagctaggacaacaggcgtgtgccaccacacccagttaatttttttattttgagtaaagatcaggttttgccgtgttgcccaggctggtctcaaactcctgggctcaagcgatccacctgcgtcggcctcccaaagtgctgggattacaggtgtgagccaccgtgcctggccacaattaagcatgttaatatttcaacagtagcttttttactgaacactatgtatcagacacgttatgcagaatttttcctttgagcttctgtataccctccttttaatccagattcagagtaacttcattttctgactactatgaaaactggaattctaattcaaatctcttgactccaaaatctcccatgcaggttatctttggttatttggaaagtgtaccttcagcatgtgtattaatgtgggcaagtgctctaagacatatgaaaaactgcttctctgcatggggtttatgagttgagacagacatttatgtgaaagagataacaacagagggaggagcaagtcttcaatatcaggtgattgatgtacattctgaagaggctcaaaactacaacagtggcagggagaatgggaggagagatagaaaagactgaggtaaagaatcttgtaactgtaacggaatgtagggatagtgaaggaaagaggcacgtcagagatcttttgcaaagcttcccaaggctaggtaattgagtggaattgatactttaacaaaggtcttcagaagaggaagagattttggtagaatgatgagttttattaatcttgtgggaggatactttaaggattcaagtatgcagtaaaagaaaatgaaagcaagataagtctggaatgcaacttcagtgaacaaataaaatacaaacaagcacacaaagtacaggctccagtcctgctttatcttctttattcttaagctaatggccttttcctattctctgtggggtcttgggatcagataagttagttttctacctgttgaatggattctttattaatcttcagtttttgttattttaatttttttgaaaataatttaccctgctgcttttacaggtaaaatcttttgaggaatttagtgatctctttaaagaacagctgtattgagatataatttccataccataaaattcactatttgaaagtgtacaattcagtggtttttactatagtcagagttgtgcaaccatcaccattatcaatttttaggactttttcattataacaaagaaacaccatacccattagcagtcattcctcattccccttcctcccaggccctggcaaccactgatttactttctgtctctgtggatttgcctattctgtatatttcatataaatgggattatataatgtgtgaccttttgtcactgacttctttcacttagcatgtgttttcgaggcttatccatgttataatttgttagtactttattcttttttatggttgaataatatttcgttgtatggaattttatctatgcattcatcagttgatggacatttgagttgtatccattatgaacaacgctgctatgaacattcatgtacaggtttgtgtggacatgggttttcatttccctcaagtagaagtgtgaagagtagaattgctgggtcatatttactctgtttaacattttgtattaataccagactgttttccaaagtacctgtgccattttgtaatcccagcaccaaggagtgagggtccaatttctcggcttcttcaatacttactattgtctttttgatatatccatctcagtaggtatgaagtagcagctcattgtggttttgattttcatttccataatgtctaatgtcgagcatctttcatgtgcttattggccatcgtctttggagaagtgtcctttagaatccttttgttcatttctaaattggggtttttttttttttttaattggtctcttttaacaaaggtgagtgttaactgctaggtagaatttcataccaggcgatggtaaatttttcataaatattagtaatagacttttaggtttaactagtgctgatcctcataagtaatcctttaaaaaagtgctggtaagattttcctttagggtgactagtaaagtcagtaagacttgattgagcatgccactatcataatgagaagacctaactttaatatttttggaatgtcaaaaacagtgacattttaattaagtaattttatttttaaaaattatttttaatggctaatattttgtaagaattttaagtaattttcaactctgagcatcaaattttaattatgtgcattgaatctctgacttaaccagagcaatttcatcttttcccaagtagtcagatctacttcgtaaaatgtgttctgatgtgtgtcttttttttttttcttttttaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttctataccctctatggtggcagatttaaaaacttgctacgtttcctttcaagctactacagggtaatttaatttgtgctccatctcttcagatactgtgcatcctgtacaaatatgcattatgggaatttctggaagaatatgcaaaagataaaatcttaaagttttttaatgttctactcagaaaaatgttcaatggagaaaatttggaaaataaaaataaaaagcagaaaacccacacttcgcaagaactacctttagcactttggtattcatttttgtagcctgttgttttcttttttttttttttcctagacggagtcttgctctgtcacccaggctggagtacagtggcgtgatcttggcccactgcaacctccacctcttgggttcaagcaatcctcctgcctcagcctcctaagtagctgggactacaggcaagtgcaaccatgcctggctaatttttgtatttttagtagagatggggtttcaccatgttggtcaggctggtcttgaaccgctgacctcaggtgatccacccgcctcagccttccagaattctggcattacaggcgtgagccactgtgcccagtcgtgttgttttcttttttgatattgtatgtacatttaaacaaccggattacacttagtccttttataatttagaaatctgatatgtttcactgttagcaaatgtttcattggtcacatttttcaggtagaacttcataatacagctcccttgcttaaataaatcttacagaaattttgtcgtagattttaaagttttatttcaagactttacacatagtttctgcaacacagtctttttgcatatttatttattttattttatttttttgagacatggtcttacttttgcccaagctggagtgcagtggtgcaaaacatggctcactgcagccttgacctactgggcttatgcagttctcctgccttagcctcctgagtagctaggactacaggcacataccaccatgcctgggtaattttttattatttgtggagacaagggtcttgccatgttgtccaggctggtcttgaactcctgggctcaagcgatcctcctgccttggcctcccaaagtgataggattacaggtgtgagccaccatgcccagtcactttttacatttttaaaacctgagcacaggccttgaaattataccaaggtttaaattctaggtctgatgtatgacatggccaagttagttattgtgaattttagttttcttatttatgaaatggggattgtaatactgagttggtaggattgtgaggattaaatcagaatatataaaagtgtcttgcataatgtgacacatgaataaatggtcgtttatttttctaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatggaaaatactttcattgtaatgattaatgtttcatttgttttcccctttaaacaattaagatctctcaggattaacactgcagagtaatggtaggtaatctgtttcttactactttctctttgttttgtcctatcctctctgtttttttgttgacctagaattagtttgtgtgagcggcaggcagtaacattaacaagaaaataacttactgctttggaaatgtagattttgaggttaggggcatttaaaactggatttaaaactggatttaaattggctattgctctttgtatttgaactgcaatttatgaactaaagtactgtaaaaaaatatgatagaggaatgcaccaaaaacaaatataaagaatattttttgagttaagacctatttttgaagaaaatctcacagagccagtttaaatggatgttaaatacccagaatatttggtaatttggaatcacatataacatatcctttaaaaataccagtattctaattttccttcatttcagcctaacatttttatgaatgataatgttgagaatggtttaaaattgcactcttttgtattttttcagtcttgttacattttgagtaaataaatcaaggctactttaaagcatatgcccatcacagcttacctaattgtatttttaaaaagaaaaagtgttttaaggtgagaaaatgaaatgtgaatgggggtgtttttgttttttattgtaatatttgagaatggagttttattaaatctttagctctgttacttagaacttaataaactaaaatttctgtaagaactaattaatttgcagagaaactcttataaagaaccactgtcagccaggcacggtggttcacacctgtaatcccagtactttgggaggcttaagcgggtggatcacctgaggtcaggagtttgacaccagcctggccaacatggtgaaaccctgtctttactaaaaatataaaaaattagccaggcatggtggcgggtgcctgtaatcccagctactcaggaggctgaggcaggagaatcgcttgaacccgggaggtggaggttgcagtgagctgagatcacgccattgcactccagcctgggcaacgagcgaaactgtctcaaaaaaaaaaaaagtggggggaggctgggcacggtggctcactcctgtaatcgcagcactttgggaggccgaggagggcggatcacgaggtcaggagatcgagaccatcctggctaacacagtgaaaccccgtctctactaaaaacatacaaaattagccggacgtggtggtgggtgcctgtagtcccagctacttgggaagctgaggcaggagaatggtgtgaacccgggaggcagaggttgcagtgagccgagatagtggcactgcactccagcctggttgacaaagcgagactctgtctcaaaaaaaaaaaaaaaaggaaccactgtcatcttagaaaggtgtgctcttgttctggagggcagttagtagtagtttagcaccttttttgtttgtagaattttagaggtgggtcagaaatactaggtgaccttaaccaaaatttaggaagagtatgcaattctacttgtttttttttttccacctttctcccatatcactggtaatggaggaagactcactgccttgtggtgcttgttagtgattagtaggtttctgacaagtgtgggtttattattaggagctgttgtggtggtctgggaagggttgctttaagattggtgaaaactctgcttctttgctacgcagacattgatattgtatcacttctttttttttttgaaagtaaacacgtttcatatcttcaccattttccatccatgtttttggagaaaacgtttgtctcagtgggtattaaaggttgggagactgcaatgataagtgtgtctgaatctctctatggggctgtttgtgagggggttcaaattctgagtgctcatcacacacctcccctattctaaaattattgatgcactgttattgatgggattgtacgggttgatagcctttctatagtgactgtagggctgtattcagccttgtagatccccctagtggtggttttgtaaaggctgtcttcagtgtcttatttcctcagaaaacaactggtatttctcacagctccttctagatttggacaaaggaatgatacaagagcaggtaactaaaagttaagaaaatgggacagttccttcatttttgagttaaagtcttgtggtaatcatttccagcctatcttttacctttcatgaaactttctatgaccacgttgacctgtgtattcattttaacaagtatttaataagcatgtattgcctggtactgtgttaggttccagggatgcttagataataaggtatgttttgtctactcaagtgagcttatactctagtggaggagagaaaaagtaaataagagagtgataataccatgagataggtgctgtgtcctggttgctggtgatgataaagaacacagacctaaggtgggcccagtggtttcagcttttttgtcacctatagagaatatattctttgaccctcttagaacattttttttttcttttttgagacggagtttcgctcttgttgcccaggctggagtacaatggtgcgatttcggctcactgcaacctccgcctcccgagttcaagcgattctcctgcctcagcctcctgagtagctgggattacaggtgcccgccaccatgcccagcatttttttttgtttgtatttttagtagagatggggtttcaccatgttggccggctggtctcgaactcctgacctcaggcgatccacccgtctcagcctcccaaagtgctgggattacaggcatgagccactgcacccagccctcttagaacattttataatcactatatatatgtataactactctaaaaatatggttaaataataatagctaacactgggtactcgtgtgtcaggtcagactgagctaaatgatttctgagtattgtgtcatcattctcatgatacttctacatgggaggtgggattatttatactttaacagatgaagggactgctacctggagaggtgaaggaacttgcccaagaataggcaactaggaggagccggagtaatgtgtgcttgctattagatatttaaacaatggaaaaatattacaaaagactgcaaactccatgacagcagggatatttgttttgtttatggatatatcccaagtactagaacagtacctggaacagaagtgctcaagaaatattttttcagtgaatgaatttgttgaatgctagcccataaagagaaatatttaacagtttggtatctgtttttctggactttaaaaaatatatactatatgtttttttaattttatttttttgaataggcaatacatggtccataaatcaaaatactataaaaaggtatacagtgaaaagaagtgctcccacccctgcccccattcccccctacctcaggtaatcactttttttagtttctggtgtttccttccagggtttctatatgcaaaaaatacatacctcctttcttacacaaaacgtatactatgcatactgttctggaccttggttttttacttacagtatatgattttttaaacatgcatatgatcatagtgtacaatagtgctttgtaacttgctttgattctcttggcaaaaatatattgcagacttctatccttgttgatacctttagttttacctgagaaacatttattatggattatctggggttaaagagatctgtagaccagtagaagtttcaaacttacatttgggaagtttagccagcatatttagggcaagaaagatttatgggtcataactgtttaaaagcagaatacagttggtacataaagatgttatgattgctgattaaactgaagagtcatctgaaaagcaaaagcagtgagtaccaagttgaccagttgtatcctcaaatcagctagcaaaaccagtaagttggtaaaaagatcccagtcattataacaacaaaaaaaacctaagatgtccaggaattaattagagatgtcaggatttatatgaagaaaatcattgaactttgttgaagggtgtaatataaggctgaataagtgtagacataccaattttgtgccccaaacaatttttttctttttattatttttataacttggccaatgttgatgagtggttgtgttcagttttttttattgatacataatttgttacgcatccttttgattatctttttgtttccataaaatttctaaagaggaactttggaatgggatttataggtcttcagaatatcatcttcatgacttttgatgcatgaacatacttcttaagaggtttttaagaggttgtacatagaaacttgcacaatggatgattattactgccttaaactagtctcaatttaataaaaagtacccatgtaacttaactgatatttacatgtagtagattttttttcaaaggttgacatagggaaagataagggaaatgatatgctggttcttaatgaaaaagggaatgtctttttgtggtctactaattgactgctttaagaagagaacctactgttagttcagtggattgttaagttctggagtagtgttagtttagaagcaataaaggattggttgctaaaggtaaaaagcaaaccttaaaacaataacctaaaaacaaatgggaaggttctgggcagagaattaacattgttaatgcagttcagtttcagttttctttttgtcatacagcagagctaactatttcctggttggttaatggaaagatgttatgctgtatcagctggaatctagctttgcttatgaaggtgtaatcacataggtgaaagatgttgattactgagttttctcacaccatatattaatcaaatactcttatttgggttgggtttctagagggaaatttcagtttgacttttcatttataatttttccgtttggttctaaacctataggggacattacattcagtacacttcatttttaaagaatatgttgcttaacaataattctagatcctgggattggatatctatcagatcccactcatatctccacagtgtgaaattaacaaaaagatatagttaaatactcagtctctatttagaccgaataattgtttttctcagctggacacattttccagccattcggtttttgcctgccttatgtatttaggtgattattcttctaggtttatcaagaaactgaggagtacctttttaggattgttgctggaggctgttgaaacatagactagcttcaaatttgagagtcagattgattgataaaatatatctcatgctgttaccgctgaataaatgacttttgctggtaaagtagtatgcttttaaaataatatgaaaaaattctgaattaaggttagtaatttacactgtaattgattttaggtgttattatattacttgctaataagatttttttttctgggaatagaagcttataaaaatttaaaatatgtttaattttctatatagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtgagttctagaatcagatgtagtcagcaagttgagttttcctaatcattgcttatttatgtgtagtcacttggggggaaactccaagtaagtaaacattaaaagtaactgtagtatctttcataggtaaacaggtattaaacaggtatgcacaatcacttggaatttaagtaatggctttgattataatattgatttaaattaatgatctgatttatactttactattacatgtagcagtaagtagcctcttaagctcccagatatattttggagaaatatttaaataattaacaagtagttttgatccaagatgtttatgaaggtctgtgttaatggaattgcaacctttcttttaatgcggtgttcttattttggtttttctgggacaatattaccttatagtagttgtctgattttctcactgtgcaaagggatcttgacaaatttgttatatattgctcaagatagacattaattaagtcaattttgatataagctaacttctatatctctttttaaaatatatgtgtaattaaaaaaaaaaagtgtttcagaaagatccttcttttctgccatgtcataggagggagaggggctgctaggttcaggtttttgggggcatgatcatatgacctggttctgttacttattttcacagtaaccaaaggtttgatagtttgctgcttggcaaatgaagtagcttttttttcattttttttttttcaattaatcatagagcattgtcttggcatgtgtatggtgttagttgcatgcagttgctaaaggaatttatgtaaacccacatcagaatagatttttgacagctctgggctaatactgtgttagttgctaccgaaagtaccattattgtatttgctttactatcagattagattcaacatagaaattttgatctttggaataaatgggggactgatttctgtaattgtgagttttcaagtgaagtataccagaatttcccctttaattcattacaccacttcaaagcaacatgtttttggtttgctatctaagagatgacagtctcactataggcagcatattctaaatgggtcatataggttaagcacttgagaacccagttccttaatcacttggtgcttctattatctgtctactttttatttaccaaattaggaatatggttgacaaacagtgggtagtgatagaaaataaaagaaggtacattatagccacttgaacgtagattagtgctagagcacagctacctacttctgtttatattatctggagattgaatttctgtgcctttgtcaatgcttactaaagtgacttcattttgactgtgttgtttcctgaggttgaatcctattcaaagattagaaaaagtgatagaaatgaaatgcagctaattttatcctggtatttattgggtagattttaataatcgaataccgtaaatactgtaagttttagaacttgtgtcaaaatgttcccttatgtggtggcatgcgcctgtagtcccagctgctccgggggctgaggcaggagaaatggcgtgaacccgggaggcggagcttgcagtgagcagagagcgagtcactgcactccagcctgggcgacacagcgagactccatctccaaaaaaaaaaaaaaaaaaaaaaaagagggttcccttaggtctcaaaaagtatattgatgaaaagaagttgaactaaaatagaagatttgaaaggctattttacgtgagctgatttagtcgtattgtttaactttattttacatacttagaattgtataagggaagtattcagtatggataactacagtgagtcactttacaatttatgttcttttgacacctgaatattttaagaatttccttttaaatacctgtaaattaaaataatttatcctgtgtagttaatgacaatttttgtaagttagctaagagtattgcctgtagaattgttaaaaatatgaacaaaaccataattaacctttaaagataacttgcagaatctgggggatgagtaggaagggaggttgctaaaatgtcatttttacagataaataatttggggagtattgaaatattctctttagcttttggttttgtaattcttagctttaaggaaatgtgatatgtaaagaaaagaaaaatattccttttctttgatactttgagcaatggtgacatgttactctcttccatctgattatactcccatttagaaaagaatgaggtgatgccagttataaataattataactttagtgctttccaaataggattaacagtcgagttaattaatgctctttaagaaaccaaatttccactttaaaaaaaaagccttaaaaatgtaggacagtaagcaatatcataggatggtttttgaatagaatacaagccaagagaagcttgattctcttggtatattacatacagagagggcaattaatttcttgtacatctgggaatatgatggtgttcttgaaaagaaatgattcttggtttataaaagctcttgaaaaaatttgaaagtagactgatagtttttttgtttgtttttaaccagtaaatggtatattgattggacagcagagctagatctttttaacttcctcatcttcactatcacatcctatttaaaataattttctgctctgcttttctctgtcaaaccctagcattctgccattactagtatcagtgctgatagtgattaatttttcagttttcaacattttcttgagcctggatttttggggtcctaatcagaaaggtccagagagagaggtggatggagtggccaggatgaactgacatacctctgaagaagttaatatgataggccagacgtacagtggtgttttgctggcatttgaaatatgtttgtgaagaaataagccactacaattagttagacattacctaaaatggaataattttgagcttcctcaagttaaagtttgcctttatagatgactgtaggttttttacctgataggccatgggtgagttacactttttgcccatctttatagttgtgcattatcagataaaattggtccttcatttagtatatgaaatcataagatgacatctatgaatgtaccatgttaatgtcttcttgttcctctaggtcagcctgccagtatactggggggcagccatagtgaaggactgttgcagatagcatcagggcctcagccaggacagcagcagaatggatttactggtcagccagctacttaccatcatagtatgtacatactttaaaaaatcttttaaatagttgagaaaaaagtaggcagcctttataaaagcaaattaacccatgtgggccttaatttttagacagcactaccacctggactggaagtaggactgcaccatacacacctaatttgcctcaccaccaaaacggccatcttcagcaccacccgcctatgccgccccatcccggacattactgtaagctcttgtttttgttgtaagggctattttttttttttttttggtagggctttgttttctgttttttaaaaatgtttttacatcttttattcatcctgtgattttgtttcattaaatagtgcttttcagtattttttgtaaacagtattatttttcatagttatcctacctttttattttagaggagtgatgtttgctaaatacatttatttctctgttgctaatgtttcattaacatcacattgatttccattcatttgtttgtttgctttgtatatgttcttagatctcatctgtgtcttgtatatccacgcataatggattgaaaccctttgagtgctaagttctcaaggtttccctcagcgtagtattcagtgtactttggataatgttgaatctatagataactctgtgctggcatgattgggaggaataccctacagataacatgtagtttcaggtagaataggagcattgttcatatggcttagtaaaatcgagagtataactcttatatacattaaatccctttcttctcattataatattaatagtaccaaagaaaacttagaaaatatagaaaagtataaataagaaaagcaaaattaccctgaatcctgctactcaaaaacagccacttctaatattttgttattttccttccagtcatataaacaggtatatgtaaattgacaggggctcctactctatgtgtattgtatatatcttgcttcttttcagttatgttactattttttccatttcttaagagaatgtaatttttaatggctgcctaggccgtcatagtgttgaagggtgctgggtttggacctttaacaggctgtgtgaccattgacaagttatttcacctcattaagcctcaagagtaataatagtagtatctacctcaaggggtgttcgtaagaagtaaacgtaataatttatgtgaggtgtttagcacagtgttttaacacattaccagttttcaattatgttagctatgattccattaaataaacatccttaattaacataagcacttgtttttagaatagacctaacagtttattattatacattgcattataaattgtactgtattggacgttacatgaataattcatttatgatctgtattaaatgttggatataaaattatgtgtaaattgtgtaataatagcacttggcagatagcactgaaatgttagttattaaatatccacaaaagtattaatagtttaagactatttgcttattgtaaacttttaagttcttagacattgcataagcttgttttaaacaattcctaacctataatagttatatttaagtaagatttactgaaagttttagcattagacaacttttagtaaataaaaatggaatttttgttgtcttttctttagggcctgttcacaatgagcttgcattccagcctcccatttccaatcatcctggtaagtgtatttcaaaattgatttcctgtatttagattgatttagtggtgattgaaacgcacaaacacaggctttaatggaattatggggtcacttctcagatgagtacaatactcatcatgacatgagttaatcaacagtttgagtagtcaatatagtcacacatagactgtctatattttattcagtttaactgtccccaaaagaaaagaactatcttttcagctaaaatgagaattacagaaatgctgacttcagcattgaatacataaatatgcagcagaataaaactaggtttcaaaatagaacagctgtaaaactatagcttaaaaagccaggaaagaatcttaagtacatgccgaaaagaaaaataattcactctattcaggatctctggttaactggaatttagaaactatttgattaaattgtatgcaaaagagtaaatcgctaagtagctttcttcagttcaaagtttgtgtataatttttgaaactgtagaggtaataaaacagaaaacacttgaaaataaaatactgaaagtcccttgtaacacaaacatagattttgaatttttttctcatcctttcgtatctgtttttcttagcataaaaagatgcaaatatattacttcagctaatcaccttaattttttggaaactataaactcaattttcctcctaattaaaagaaaattatgaagaattatatttttatttttacttgtttatttttgagagagggcctggctctgttgcccaaactggagtgcagtggcatgatctcagattactacagccttgacctcctagtctcaagcgatcctctcacctcagcttctagagtagctgggactataggcaagggccaccatgcctggctaatgtttgtattttagtagataacagggtctcaccatgttgcccaggctggtctcgaactcctgggctaaagcagtcctcctgctaataattttatttatttatttatttatttatttttttccgagatgggatctcgctatgttgtccaggctggtttcgaactcctagcctcaagtgatcctcctgtcttagcctcccaaagtgctgggattatagacgtgagccaccacaccaagcttgaaaaattaaaaaaatatatttttaaatgattttatttttgatctttgtgggtacataggagatgtatatatttatggggcacatgagatgttttgatacaggcatataatgcatgataatcacatcatggaagatggggtatacatcccttcaagcatttatcttttgtgttacaatctatactctgttagttattttaaagtgtacaattaaattattggctacagtcaccctgttgtgctgtaaaatattagaccttattcattctaactactttttgtactattaaccatcctcaccttcccccaatcccccactacctttcccagcctctggtaaccatccttctactctctgtctctatgggttcaattgttttgatttttagatcccacagataagaacatgtgatgtttgtctttctttgcctgggttctttcacttaacataatacctccagttctatccatgttgtctcaagtgactgaatcgcattttttttatggctgaatagtactccactgtgtataagtcaagcataaagaattttaagcataccggaataatacaggaagttcccccattgtactcattcctcagtttcagccattatcaagtaatgaccaatcttgtttcattcatactcactctctttcttcattctatattattttgaagcaaatcctatattagttttatatgtaaatatcttagtatatatttccagtaaaggtttttaaaacataaacacagcgcccataatgattaattcaaagggtcttaaattcttaaataggtctacataattttctttgtgtaaatgttctgttattgattatgttggtttaatttttcttctagctgtttaaaaaaatagaagggaacatctttgtgtttataacttttctcatattttagtttaagaaatttgtagaatttctagatcaaaaggccatattacagtgacaccagagtgtgagaaccagggttactgtgctggctagcagtagatgtcatagtttaataaactttttgctgatttaagaggcaaatacttgttctggttagggaaaaggtgatattagtggggcagaagcattcttttaacgatatatatttattatcttctgtaacggattttctgtgttacattgtgtgttgtgattttaaacatttttgtaggtcaaggggtctagccttttcataaactttctttttttgagaaatgtaatatacagaaaagtatgtaacacaagtaagtatatagtctaacatcactaaaaccaatactcatgtaaccactacacagattgagaactaaaacattatggcatcccagaaaccctcctaccccatgaattttgtctctgtcaaaacctctttccttctccccagaggtagctactgtcctgctttttatggatatcactttttttttgctcttttatttattttttaaatttttatttatttattttgagatgaactcttgttctgtcacccaggctagagtgcagtcatgcaattcggctcactgcaacctccacctccaggttcaagccattctcctgcctcagcctcccgagtagctgggattataggcacccgccaccatgcctggctaatttttgtattgttagtagagatagggtttcaccatgttatccaggctggtcttgaactcttggcctcaagtgatctctgccccatcggctcccaaaatgctgggattacaggcatgagccaccatgcctggcccttttaaagtgatgaatacatccctaaacagtctagtaatctggctttacttgttttttttttttttttttttttttgagacggagtctcgctctgtcacccaggctggagtgcagtggcgcgacttggctcactgcaacctctgcctcccgggttcacaccattctgcctcagcctcccaagtagctgggactataggcgcccgccaccacgcccggctaatttttgtatttttagtagagacggggtttcactatgttggtcaggctggtctcgaactcctgacctcttgatctgcccgcctcggcctcccaaagtgctgggattacaggcgtgatctaccgtgcctggccctcattttctttttacctagctttataaatacttgtttaaaacaatttaacatttggactgattgtgtaaagaccacttttaagtgttgttactgttttttgttgtgttttttttggccaccaaaacattgggtaattgttgtcttagacaatctctgtagttttggtttaaccagtgtacctatcagttgtttgctgaagcttcttgtccatagcataatgtgataccttcacattacattttctatagacaatatatatatatttttttaaatttttgagacggggtctcactctgtggcctgggctggagtgcagtggcactctcatggcccactgcagccctgacctcccagacttaggtgattctcccatctcagcctcccgtgtagctgggactacaggtggacacaaccacgcccagccaatttttctatttttcgtagagacgcggtttcaccatgttgcccaggctggccttgacctcctgggctcaagtgatctgcccatcttggcctcccaaagtgctgggattataggcatgagccaccatgcccggctgaaaataatttcataaatacttcaaaactggctttttaagaagacactcagtgaagacacttagtgtatcactggtttttatgttctaagcataatgaaatatatgtaaacaaatatttatctttgtgacaagttcattagagtgacatggcaaaacatttgagtttttaagtttttgaattatccaatcttcatgtgatctgttttgataactcctcattgcattggaaagtattttattgcttggcagcattttgaaaagtaattagggtacatagcttttacaagttgttttcttttaaaaaaattttaagcatcaatcatacttcattttaggttattttttttttttccgtaagatctgggtttcttttttgtcattctaagtaactttgttgaaagtaagattgttgaaagttttattgcttcaaattctagtttaaagttcataaacagcttattgagatacagataaatctttcttttaaatatgtcgaacctatttccaccctggggtctttgctttcgcttcctctttgaaatctgttcagtcttcacatagataaaaggttattcaggtcccatcttttcagatgggatgtcccctaccatccagtctgaagtgttcttcccaatcatctgctgttccataccctgttttattttcttcacagtgttcattgttatctgagttatttcatttgtttgcttatttgtctgcccctgcacctctgtgagaacagggactgtagctgttttgttttctactgtgtatgcagtgcctagaaagatccctagatactctgtagatatctgttaaatgagttaaaacaggaaagccaaataatttttatgtatttgggcttgatgtaataattgttgtttacaaataaaaattagaaatacttgatcagttgtctttgtaaaccagagtagcacctcttttttcccagtgatttaaaattatatattattgttcaaatgagtacactaaatacatctccaaagttaaaattgtggtagttaacatgacctgacttcactaaaaataccttttgctatggcataggtgggacaaatgaccttctacccaagagacagttgagaatctgtgtgtacaacaactgtgtgattagagtataattaaccttaactcagggatgggatagctgacttgcttatgcactttctctcaattagggaatctataaaaatatgtcatgagtcgatgttattcaaggacagttccctggaatacatcttagggtcagtgtgtttttaaaaaataaaagttgagactacatagagaatatgtgtagtcaaatgaaataccatggtaaaataatttattttagattctgattatttctgttctttaaattctcagttgacctggtcctttgaggtaagaaccaaattccagattttaaaaaatgacttttagaacttgaggataagtggtaattggaaattaaaaaaaaaaattagtgttttaagaacagtgctaagtactgagctagaaaatagaagacatggaaattcctaccttttaatgcattatgttattttaatccagttgttttgggtgcattacatttccatctcccctccctttaccctttcttttaggaaaaactgtgttgtggagtgcaagtgaaagccttatatctttctcatgggaggatgttctttcccatttatttcctatagctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggtattgattgtatagtcagatagttactttaaaaaattgagcatagtacattgtcttttattcaaggttatgttttcccatgtacattatatgtgttcttaaatataaataaaggaataaaggtcatgttgaaaactcagaatttgtaagcactccatcttaattgtcggtgtttttgttgtttaacatataatgataaaagatagccttttttatgttagtaggtttctatgtttcgaatagtaagtataccttttgaaattcagtttgaaaattttattttctgtgatcatacatttctacaaattactgaaaggaagtaatattaaatgagaacatgtttctgaaagttttacttataatgttaaaaaaattggtaataaaagggaaatggttaagtaaattatgataaatttttccttttttatacagtcattaaaatgtttaaaagtttatataatgaggctgggtgcggtggctcacacctataatcccagcactttgggaggcggagtcaggcagatcacttgaggtcaggagttcgagaccagcctggccaacatggtgaaaccctgtctctaccaaaaattagccatatgtggtggtgtccacctgtaatcccagctactcaggaggctgagacaggagaattgcttgaacccaggaggtggaggttgcagtgagctgagatcgtgccactgcaccccagcctgggtgacagagtgagactccatttcaaaaaaaaaaaaaaaaaaagtttatataatgaaatggaaatgcttacagtgaaatattacaggaacattccattttagctactgtatgatctcggcttttaaggatgtgtgtgctaaagaacataatcttggctctatcacttgctgtcatgtgactttggcaaattacctaacctctaagccattctgcctaatagaattttctgtgatgaagaaaatgatttatatttgcactgtccagttcggtagccactagccacatgtaactattgagcacttaaattatagctcacttgattgactaatcggatttctaattagttttaatttaatttaaatagtcacatgtggctagtggctatcaatttggacagtatgccttagtttctttatctaaaaaaattagaataatagtacttgttgagttgtaagggtttaatgagaattcatactacatgctcctgacacatagtaagtgttgtaaatatgtgcatcattattagatatgaacaggaaaagaaaaaaggaaatatacaaaaatgttaatagctatcttttggttttatgtgatctttatttttaatttttcaatattaagcatgctatacaatctgaactaaaatttaatttaaaatacttatcaagataaaatgtaatttcttttttcttcctaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggttagttacaattttatttgaatattttagacttaaagctctatttgttgtcaaaagaattgaaatctgggtggaaggaatggaaaaatgttttatatattaaataataagaaattgtgtttaagtataaaaaacacattttctgagggcatttattgacattatcagtaatctagttttatcgttgccaatttgttacattttgttttttattttatttatttatttatttatttatttttgagacagagtcttgctctcgtcgcccaggctggaatgcagtggcgtgatctcggctcactgcaacctgcgcctcctgggttcaagcaattctcgtgcctcagcatcccaagtagctgggattacaggcacatgttactgtgcctggcaattttttgtatttttagtagagacggggtttcaccatgttggccaggctggtctcgaactcctgacctaaagtgatccgcccaacttggcctcccaaagtgctgggattacaggtgtgaaccactgtgccaggcctgttacatgttttagagtaatacaaaggctcttgaaaatactgagtgaagcctccaaagttgtattcctgtaacttgaaatttgtaagaatcagactctggactttcatcttagccaatcttcaggattttatggaagagaattctaaaattaatagcttttcaaattaagaacctgataagcctgaaatatttttcactagttatatattcaacctgtttgaattttactttataatataacctgtttttgaaagagaaaggcagttgtaattagatagcctaaatatatttttaattgtgtgtcatcctcaacattttcattgtcagtgattgtaaattggtagaattaactgtgtctcataacttattaccaggaagttgcttaggataaaaataatgtagccccatagcatccataaaaatggaattgcctgattacctcacaacagcaaacccagtttctcatttccagttatagttcagttaaagaatgttggaatttttttatatgacacttttaaacatgccaagtatagcgaaaataataaaccacatgtacctatcatccagctgcaacaattatcagcactttaccaatctttaatgtgtttctcccccaacttttttttcctggagtcgttgaaagccaattccaaacagcatagtcactcataaaatatttctgtgtgagtaactcataaaatactcctgtgtaactcacaaatctatacagacttctgaaaaacataatcgcggtgctatttattacacttaataaattagcatcaattccctgttaaaattttcaacaatagagcatcagttatagtctgttagaacaatagaataaagcaataaagtattatatttattgataggatatccatgtgtatagaaaagttagttattaaacaatacataaggcctgatttagtggctcatgcgtgtaatcttagcactttcggaggccaaggttggaggattgcttgagaccaggagttcaagaccaacgtaagccacaaagtgatacccccatctctacaaaaaaattaaaaaattagctgggtgtggtggtgcatgcctgtagttttagctacttgggaggctgagatgggagcattgcttgagcccaggagttcaaggctgcggagagccatgatcatgccactgtgctccagactaggtgatagagtgagaccctttctcaaaaataaataaataaatagacaatacatagactatgatctcatttttgttaaatgatatcatgatatttgttatttgtttatatgtacccataagtctagactggtatgtataatggaattgtctctatgaggtggaaattatttgtattttgcagtttttttccacaagtaatttctgtattggttatttatgctgtattattattatttttgagacagagtcttgctctgtcacccaggctagagtacagtggtgccatcttggctcactgcaacctctgcttccagggtttaagtgattctcatgccttagcctctccggtagctgggattacaggtgtgtgccaccacgcctggctaatttttgtatttagtagagacggggtttcaccgtgttggccaggctggtctggaactcctgacctcaagtgatcagcccaactcagctcccaaagtgcaaggattgcaggtgtgagccactacgcctggccttttgttgttattttttaatggctttggatttccttatatgttttgtagtccattttgtattcgtgggccaagtttgttttgagagaattcactcattttattatttattttttcttcctgtcattgcttcaccctatgtggcaattttgccttaccctggcatctgggattcacatctcagaaccaaatcttataaatttaggaagtagggggactttgtctcctgaggaaattgagttccattctgcaggtatgcttggggcctaattcctgattgcctagatttctctgaaacttttccctgccgtgggcaaatattttattcctaggtgtacttctgaattggctgtattttaccagcacttgatttatgggcaggtgcccacttgtagcccccagagagtttggctgttgtctctctccatattattccaagaagtcaaattcctgttccctgccctttgtttatggtcttggtatacccctagtacctcctatctttagtctctgctctccactgtgggttttatttatcatcagtttggatgtatggattgtttccatatgaatttcatgatcagtttggagaggatgactattttaaatagtttttctgttatttgtatgtggttgaagcagagagagaaggtgattatgtatacccacttaacccatcttgactcagaagtctcttgttttatttatgtaatttaaagtgactggatagagaactatggtgttgaatatatactgtgtgccagatagtatttataaacttaatcagatatggagtagtatttaaaacaattgagcttaaataatgtggaatcgtgcaagtgtaatttcttggatgtcaaatagatacattgtgacttatttatattttggtacagatggcctttgaaaagcccccaaggtgtgagacaagtcatcacttgataaaccactgtcttggacagatcttaatagtgatctcatacttttaccatgaaaagtagataaataccttgttggacaagatatttggaatttaaaaaaatctcatttgtgtatattaactaagattttaaaataattatgtctgtttaccaagtatattactgttctttagaagagtcttactagtcagaaagagacagttacaagtacaaccccatccacaatttcactttccatggcttcaggtatccatggtcaaccacagtccaaaaatattaaatgaaaaattccagaaacaattcataggttttaaaatgtgcgctgttctgagtagatgatgaaatctcactccattctgcttgggatgtaaaaccttttgccagcatatccatgctgtctacattacccacccattagtcactgagtagcgagctcagttttcagattgactgtcatggtctcacagtgcttgtcatccagtaacctttatttagttcataatggccccaaagtgcaagggtaatgatgctgggatattgttaacattgttctgttttattattacctgttgttgttaatctcttactatgcctaatttgtaagttaaacttcattatgaggtatgtatgtataggaaaaaacatagtatatgcacagtactatctaaagtttcatgcatccactggaagtcttggaacatatcccccatagataagggaggaatactgtataccttaaaatttaaccattggcattttcttcattcgtttttttgggtagcagtaactaagggatttgtaagttatcagattttcacaggagatgatattattggggtaaattgtatgtagatagcatgcacccctggaaggagtgcccacactttgagtacacaaatgtgtgcatgcacatacacacacacacacatacacacacacacacacattcccctttttaattaaaatgaggaaaacacacttggagagccataatttcattttataagccaagaagctaggactaaattgtggtttttttcacccttctaagttgactttttttcctgcttctctcatgacatagtagtcattttttacttaacgaaaatctgatgtaatgaaatgacattttacaagctttaaatgaagcaaatgtttgaattctctttaagtggccttgttcttttgctttcaaaagtaaaatatgttttgttttgtgttatttagcactgggcgtttcaagtttttaatagctttattgagattttgagagagaattcacatgacatacaagtcacccatttaaattggacaattcaatgattgttagtatattcacaacattgtgcagtcattactactcaattttggagcattttcatgactgtggaaaaaaactccatatacccttttaactatcacccccaaatctccatttccattagctctagacaaccactattctacgctctttgtagatttgcctattcagggcattttatatagaagagaattatgtaatatagtcttttatgacttacttcttttcactaagcataatgtttcaagcttcatccatgtagcacataccaattcttcactcctttttatggctgaatagtgctccacacacattttgttcatcagtttatccattgatggacttgatttccactttttggctatgttatgaaggatactgctatgaacatttgtgtataagtatttgtgtgttttcatttctcttgggtacatacctaaaagtggaattgctggattgtaagataactctatgtaaactttttgagaaactgatagactgttttacaaaatggctgcaccactttacattctcactagcagggtgtgagggttccaatttctctacattctcatcagtacttgttatctgtcttttttattttagccattgtagtaggtgtgaagtataatcttattgtggtagttttgatttgcaaacttcctgtgttaatattgagttgggtttgtttttgaacacatttattttagaggaaggggcagcagatgcttctaaaccactggtggactaggtcagagggtattatgaacctcatttaaatttattcccaattaacactcattgtgattccctaagtcaagtagaacttagaatgtccttagcacaatcttgtttatgttcaggtgcatttttcattctggattactgtttcctaatgttaatttaagattatatagtattgcatttaagccttgtcaaaggaaaatggcaaaatttgactcctggttgtaaaagacaatatcctaaagatgttgtcagtgatctttatgagacacacatctttgttaagtaacggttttgtaataaattcagaaaacatggttaaataaattaaagcagaaattagctcaggagtggtggtcagaaatattttttggatctgagccaaaaagaatatttaaagcctttgattactttgaattgcctttgtcaacaatttagtcaaattatgaaaggaagacagtagcatttcaataatagctttaatttttatcatccagtgtaacaaatggaatctgttatggtatccgttatcaatggattagttacagtgtgaagtcaggaggcaatgcaggttttagttattagtgaacctaactgaataattttaggtcttctggtttgagtgctataattacgtaaataatctgtggaagggaggtttgctgaggtgcccaatgaatcatttttactgcatctacagatgcaagtcataaagtttaatccgtgtgggtaacctgtaatatgtgctgctgatgttagcatagattcaggctgaaacaatcctaattgcgattatttacaacacattggagagagcctatgtgtgacatattacttggttatttttttaaatgactcgtgggggtgggggagtgttaatgttaaaggcatacttgaatcttggagattataattaagttttattccctactcccagataacattatatatatatatatatatatatatatacacacacacacacacacacacacacacacacacacacacacacaccatacttggttagtgatgattaaaaaaaagtagttgtggagacctaaatgtaaaacacaaaactataaaacttctagaagataatataagagaaaaagtgagaactttttttttgagacggagtcttgctctgttgcccaggctggagtgcagtggtgccatcttggctcactgcaacctccgcctcctgggtttaagggattctcctgtctcagcctcccaagtatctgggatcacaagcttgcaccatcatgcctggctaatttttgcatttttagtagagatggggtctcaccatgttggccaggctggtcaggaactcctgacctcaagtgatcctcctgcctcggcctcccaaagtgctgggattacaggagagagccactgtgcctggccaagagaaaaagcgagaacttttaagatacaacatcaaaggcatgatccataaaggaaagaattgataggcctgacttcattgaaatgaaacacttctgctctgtgaaagacagggtcagagaatgagaagacaagccacagactgggtgaaaatatttgcaaaagacacatctagtaaaggactgttatccaaaattacaaagaactcttaaaactcaacaataaaataatgcaacaataaaataaacaatgggcagaatagactgggcatagtgattgactcctataatcccagcacttcgggaggtcaaggtaggaggattgcttgagcgcaggagtagttcaagatcagcctgggcaacagcaagacctcatctctaccaaaaaaaaaaaaaaaaaaattagccaggcatggtggcatgtgcctgtagtcctggctagttgggaggctgatgtgggaggacccttgagcccaggtgttcaagactagcttgggcaacatagcaagaccccatcttaacaacaacaacaaaaaaggcaaaagacatgaacaaacacctcaccaaagaagatacacatatggcaaacaagcatatgaaaaggtgttcagcatcataaatgtgtacaaacccatagaatgtacaacaccaagagtgaacccttacgtaaactgggttttgggtgataatgatgtgtcagtgtaaattcattgattgtaacaattgtgccactgtagtggggatgttgatagtggcggaaggttgggtgtggggacagggactctgtactttctgcttaattgtgctgtgaacctaaaactgctctaaaaaagtaaagtttattaatttacttctttaaaaaagtggttgtagagctatttaccttttcaaatgtttgagtccctgctttgttctgtactgggtaatgccttccaaatgtcatagcctagaagttctgaaacgaatggactgtgagaaatttgaggaagtagtggtttcacttctgggtgttgtgggctttctgatttctagaacctgactttgtcatgctttcttttaaatttaaatttttttgtggagttggggtcttggctggtcttgaactcctgggctcaagtgatcctcccacctgggcctcccaaagtgctgggattacaggcatctgccaccatgcccctgtcattgctttctttactaaagtattttaggacctaatagtccaggaaatacatatatgtatattggacaaattcatgtctgtttaaagaatagggtagtctgagtgttgtccttcattggtgctaattgggaaaagttttttgaggaaatggacactgagtagagaaataggagtaagtaggagtgcaatttgttatttggagagtgtatgttattgtatgtttttgtggttcatgtaaataccatggttgaagatgatcagaattttttcaagcatctgaaaattatggtttaagttctaaaactattgtttatcatcaactaaaaaattatgcattctcagatttctcttattttcaagattatttatgcttgcttgtattgggccccttatgtacgtaatgggactttaaaaaatattcatgtccttttagatagggagtatagccacatggttcagaaattaaagtgatttaaaaacagtggacattgagcagccttgcttcagaacctgtccttgttctcctttcctgcaaattctttttgtgtaatcttccaatgctttttaaaaatgcaaataaacaaatattttaggaagatttttttttccccagaaaaaaaggtgatgtgatttattatctgtaatttgttgcatattaaaagaacattccagtactttcataaatataagggtagatatggcaaccccttccttactatgccagttcttcacttggttgataaaagtaaaattatttattaacgccttaactcatcctgaaagataaatgactacgggggaggctaaaaacaaaataagtaactgtatactatgccaagtttgcaacaacctcatgaaagtatgtacacttagcattcccattttatagataaaagaaactcagcccatataattagcaggtatcggtgatgggatttaaaactgggccttttttttccttaaaaattatgaacatttacaaacaaagaaatgtagagagaaactaatgaagtcccatatacccatcgcacggattaagtagttacaattttatatttgtttgatctagtctttttgttgttgttgtttcttaagtattttaaaacaagtcctggatattattttgcttctatttgcttaaagtacgcatctctgaaaaatgttgatctctcttatatagcgacagtgccattttgttaaactcctccaaataagcaaaaatgataagacaaaaagttggccaggcgaccaaagctatcaactccagcctaaggaaaattcagcaatttgattatgaaagggggagggggacttcttaattgtacattttacacagatttccacaaggacagtaatagctgacccacttcgaactagataaaagatacagaggcgtgtggcagccaaagccatcatgatgttgacatgatcttcttggtgagctccaagccacctttcctaactagttttagaccaatcacaatgtacataaaagtttacatgttttaattaattcttttcatgtgagaggtataatgaaactgagttttaaataagtcaggcattggtttttaatgtatggaatttttctttatgaactcatagtatgaaatgttttttcttaaaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtaagtatgcttttcattcttttttaaaggtataatagttgatatttttatcttgatttactcagttgattagtttctttgagcagtaatagaaattaaagtttttttttactgggatgatgacatttttgaattggtaaaatctgttcttctgtaatagttgctttttgcctatgaccctgtttgcattctttttgtatcaaaaatggagtatgggatgaaggagaaaggggatgattattatattatactgttctatctcctccttttttgttgatgcttattataattctgcctcaccagccagggtgggttgtaatcactgaagtgcttggctttattctagtaaggaaagcatatttcaatttcagaattggacacttttccaattttttttttaaagtatgctaaacatggagagaaaactaagtgagggtggtattttgataacttgtagacttttttttaattttagggtaaaattgaactgtgtgccaggtttcacactgatggggaattttttactgcagagttaaactcctgactatagacttttatgatggaaacacgtggcacccatcttccacgtctgaaggcataactagtgattcattcaacccctgttcttaacctcttcagtgtggtaagcaaatcacactggctaagaaaactgcagtggccctgcaggtttctctacagtacatgcaaattcctcccattagtttcattgtaatattgatgaatgcagatggactatatgactgtatgttctgactggaaaattagatgcagtctccattgtgacttatgttcaggagtttacaatttagaggtagattaggcatattcattgagagaatttgattttttaaaatttggggtgataccattaatttgctggtttcagtgttataaacatgcttttactgaagaatccagaactattattaagtttcatattctcatcagttgccaccactgagtaatagtgtattactctgttacactttgaaattgagagagagacttcatctcggtcatctaagaggtcttagtggaactaagaatattaactgcttcattattagttatgtcttattctgaactaggctgtttagacagtaaggtttttagaagcaacctgtggacacgcactacctcttaaaaacaagttgtttcttatcccttcacctccacttctaaagaaaaaaataggtgaggtgttggtggattgtggtaatttactttataattggttgtagctagaagacacatgtgaaatgtaaagttccttaaccaaaagtgtgcagcttgttgataaagtttagatctactgttacttcttggcactttagcagagaagttatatgctgaggagaatgaaatacagaaagctggtcacttgattaatttagaatgtagggaggatgggaagagatcaccctgtccctctgatgtcttccaaatcttttctgttaggtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaa

SEQ ID NO: 128 - DNA, 81519 bp, Homo sapiens
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtgagtggccccaggcctgggagctggggaggatgcgcttggggtgggggccccttctggactacaggctctggtctccgaaggctgggacctgtgcttctgccgtgccccatgtctccagtcttcgctttgttttagggaaattcagagtgttccgactggcagggccagagagtttggtaggaaggccctcctgcccgttccccaggacgagcctggagtgcgggctgtggcggtggggtggggggccaggcctggtgtgtggggaaggcccgcaggcccacaggcattgcccagataggaaggcacaggcctcatgctcccgagaaagcggcctgccccaggtcagggaagttaggtccagctgggccacggcccggatgcctcaggcccaggtctttcttggggttggggtgaaggtggctgtcctcgccccgaaggcacccagcctcgaagacggagggctgcctgcctttgggccccaggagacagagcttgggtgaggcgaggcctggttttgttactggctcccgctccctgtttggtgccttgaagttttgggacacagacacaaaatgaagccaggtgtccaggcttcagtggcaggggcccgagacttggcggctccagcactgtgctggttggtctccctgggcctgccagggaccaaatcccagagtccgccgtgtggggtgagggccatttggcacccggctgaggggcctggtcagcaggctcctgggcccgcgtgctggagttactggcggcctgcgatttgctttggactcacccatttccttctctccctctgaaacgcagaggggtgcgccggagagggaggctgctggcctggctttgttgtttgccagttggaggatctatgggatccggcatgggcagctcccaggccacgaggtgccgaaattactcagtggggtcctcaggaactttccgttgcgtacctccccaagtatttgtaacttttcttttaaatatccaggcttattaaattgcacacacagaatgctgcattggctcagctattcttgggaggcctaattaattcagctattgcatcaaactttttttttctaaatctgtgaatagatgctccagcccggttttctctgggcgcccctccagcagagtgtcagatcgtggggaggaggggctgtggatggaagcgagggactgtcgcctctgctcggagggggctgcggagggtgcatgtgtgtgtgcatgtgtgtgtttgtgtgtgcgcgcttctgaccctgccaggccagggctcaggtggcagccgcctgcagacctgtgggctggggaaggatgctcgtggcagagctgcagacagacgtagcaggctggggcccttcgtgtcacacggggagttggttggggtgggcccgatggcgctccctgtgggctggggcctttctttttggggtggccgcaccctcgtcagtgcctgtggctggaggaagccacatgtcgggggggattgtgggctcgtgcaggctgcgtagtgggtcacctgtggccaaggcctgagctgctgggacacgctcacgtcactgtcttcagagctgatggcagaggatctcggttgagcagggtgtgtctgcgtttgtttttgtccgactgtgggtcatgtgtgtgcttgtggtctttctgtcttcctgggctttgctgggggcccattggagtggccagtggggcctcgttgtcacagctgacacagagcagggcccaggccacccggcttctctctccctgtggttgtgagcgccggggtccttgggccgccatagagacaggccagacaggctctggtcatctcagcggatgcctccgagccgcctttcccttttgaagtccccagcactgctctgaaatttcatttaccgattaaaaagcaattcccaggccatactgacgacgtgcacggtgtgagtgactgcgtcctctaggcctgagtggcagccacacagcctggccctggcagtggtgtcctccgcctggctccctgaatgttcaccagctcctgcgggttttcctctcctcatgctcctgggggtggggcacccatcctgcccgtgttgcctcctgctctatgttcttgacgtgggatggcggccagggactctgccctcgctcagtgcctgccctttaggctctgtgactgtgcacttgggagttctgggcttcagggtccccttaagtctcctcaggacagccgtgtgcgtgtctctgtgtgcacaggagcgacacatgagaagggagtgtggtctcagggtgggcgtggacccacagtgcccagaccctacttgtcctagaaggagtggcctgggaggccccgcctccgccctcactggccgccgttggctcctcccactcgtgtcttgacagcttattctcgggatatgttttgatttcttcacttcctttgtagcttattttaatatttttgatctgccgaagatgagggcagaacaaagaatgtactggaactctctttgcagggctgctgctcccagcaggccttcgggctctgcggagccggagggggctgaattgccttccgggtgtttgtggccaggccagggtcgggtctcctgcctgagtgggctgggtcagcgccactctcctacccatggtgggaggtgggagagggcggagatgttcccgggtcccaaaccaagtgggaggcagggctgcagctttctccttggaagcctcctgtgacagcggctgtgcctgagcctctggcctgtcggcagtgcagtggcagcatgaggggcagacagtcttcctccagatgccccctcatgtcacggggttacagaggaagcctccgcttctgtccagtggctgtcgggcccggccagcttcctgctgctgtatcttggaagaccatgtgggctgcatgggtgcttggcgagtctcctcttagggaccctggggctgctatccttgacaggggaccttgtctcacctccccactcggtcccacactggctttgtgaccttggacgagttgcttaacctctctgcctcagtgtaaactggggactactgtttattgatcttggactttatgttttgagtggtacaggtggggcacagatgggtcattgtgctgctgggagcacttagccaagactggagcctctgagccttccccactcccacccctctttcttctttccggtcggctcgcctccttcctcgggttctctgatagctgtaggactccattggactacatttttttgtcagtatagacagctgtcagagacggagacaaaatgtggcagttggagctgccgcttggcctgctgcctgggacgcggccccttgtcccgcagaacgtcagccaagcgctttccgtgcaggctgataacagggtggtgccgtgcttcccttgggccgtggcaggatcctgctccaagggggggtcctgctccgagggggccggggtttctgttccaacagggctggtggggggggtcctgttcccagaggtccgggatcctgttctgagggggccagggtcctgttctgggccgggggtcctgctccgagggggccgggcgtcctgttcctaggggcggtgggctgcctgtgtgagagctgttcttcacctgccacgtgcagtctgggcattctggtgactggagaatttgggttgtgttacagtgttgttgctctgtcctgcagatgcctgaattcccaggggtcttgcaggtccccttgcccttgcgctgtgtgggctggcgtgggtctcagtgggctgtgggttgagggtcgcttggttgggaagctctgcgcgcttcccagtggagggtccgcgacgggggttttctgatccctcatgctggcttttgacccgtgtcactgcaaggctgcccctggccccaggcagcgtttcttcaggcaggtgcccagccaggtggtcgggcttgagacctttgagtctcgaggtctgttctggggaatgactgagcttgtggaggccaggaaggggttgctgggcttggagagcctctggggaggagttgtgttttgctctttgctgttttaagctgaaatgatcacaggaagggacagcatcaagagtttctttctgggacacccctcactcagctcagcggccgtgtgtgggtttggggctgtgctctcccagacaccctcaggtccggggagcacttcgggggctatctgtccctttgtccaccagcttcctttggaaaaagtgtttgctgcaagtgtttttctccagcttttcgtggggttccctgtagtcttgggccatgctctggggtcaggctcccggcaggccctggtccccgtgcagaaggccagggtctgcgggtttgggctggtctgccccccaggtgagggttccggaaagacggccggctgctgagtcttctcaagcaggggaaacagcagctcgagagtggttcttgacctctgcccaccccagctggctgtgcacggactggggagggcatgggcagctgcccccaggtggcttctgcagggagcagagcttagtggtcattttcccggcatggtctgtcatccgtctgtctgggacccctctgggagctgggctgggtccctcgccttctggggcagcagggtcacggtgggggggctagtcctctctttcagcatcttgtttctcagccgtccctgcggctatttgtgcaatgtctgtctgtctgagtctccgggtgagggcagacaggatatggtgcgaggaagtctggggtaagtgtgagccgaaccccgccctggagtctctcggggttgtggggccacagccccagcttaggttaggccttcactgctgctggcagggcctccagagagaaggcggtggttccggggcctgggccctgactgtctggcaggaggtgtccacgccggcggcccggctctctgtggcaataatgtgtctctttctaaggattgcgaaagttgagggaggatttctccactggaagaattatgcaagcttcaactgaaatgtttttaaaaagtttctttgttttgagtcaaaatacagaaggtgaattatttccctaatatctgggagagctggaaaagaaggcccctgtccttattcttcagggctcttcccctcctgagcagtggtcaccaggccagggtgtcatggagggggggctgcctggggaccagctctttacacctggcctccagagcgggtggtagggcggctccttcctgccctgccctggctgtcaccctcgtggtctggagcagggtttttttttgttgttatttttttttttttttgagacagggtctgtttctgttgcccaggctggagtgcagtggtgcgatcttggctcactgcagcctccgtctcctgggttcaagcgattctcctgccccagcctcctggtagctgggattacagatgtgtgccaccacacccaagtaatttttttgtatttttagtagagatggggtttcaccatgttggccagcctggtctcgaactcctgacctcaagttatctgcccaccttggcctcccagagtgctgggattacaggcataagccactgtgcctggcccctggagtgggttctgccacggaaggcatccccggggtctgcgggctggaggggtcgcccccactgtgccacctgttctctcgaggcctggttgccctctgcagaccaggtgccatgccaggtgaccctcaggaagctctggctcaccccgggggctggggggcatgataagcgatagctcttaggtgctgctgctttgtgaatatgagagagttccagaagggccccgcttcccagagcctgcatgttggtttcactgtgtggtacttgatatttttccaggctgccttgctggggtggcctcgatggggggcccagggagcctccagctctggggacatgctgccacatgagcctgcttatttacgaaaatgaagaaccaggacttgagtgtgaattttaaatgagattgtggggacaatagtaaaatccagactaggaccagatggactgagcacctgcgttggccatggcccggaggtggcgtggtggtgcctggcgcctgtggccctcagcatgtgtcctgccggccgcctagtaggccttcgcttgaagtgcttattcctttgagtaatgctcctgtcttttgtttggggggaaacagataaagggggctttgagaggcgtctcggcgtgatcctgggaaacggccgagattctgttcggtgcttggtgttcgtgtcttctctgattttacctttttgactcataaagatggaaggagtgctctgcctcggtgcctctgcagctgcagatgctgaatcggggcgtttaggcctgcctcttgggctggcacacctggcggccttggtcaggccttcttgggctgcctctgctggggtgcttgtctcactggccgtgggggttgttgcctgtgtggttgtgttgctggcttcaggggctagggttagggacgcctggtcacgtctgggtccccagtttgggggccagattcaataactcactgaatgactcagtggaactctgcaggcactggcagtcaaggtttattggcaggtccattctttggctagaaggagaatgctgtttcttttctcactgtttcaccatttttttttttgagatggagtcttgctctgttgcccaggctggagtgcagtggcgtgatctcggctcactgcaacctcagcctcccgggttcaagcaattcccctgcctcagcctcctgagcagctgggactacaggtgcgtgccaccacgcctggctaattttttgtattttagtagagacggggttttaccatgttggccaggatggtctccatctcctgacctcttgatctgcccacctcggcctcccaaagtgttgggattacaggcatgagccattgcgcctggccattgttccacctttggaagaaattggttcaccgtcttctgacctggggggcgcttctaccctggttccatattgagggctgggaagttgctggaatattattacccttggctggtgaggctgagtgctgatgctcctcccagctctcagccctgcctggaccaactgcggcttctgctggaacgtcggcggctgacttagaaagaaacagctcctgttctaggcttcctgcaggtcccacggtgctgcttgtttcagagaaacgcagctcaggctggcggcctcaggtgggcatgggtggcaggggatgccatcacccaaatcagggatctttctctgtcctgagggttccaccccaggacccagggcactaactgggttcttgtgtggcccttcccgaccagacctgacccctgagctgcgtgtgtgaggtgatggtgactccacgacagcttgtgtgccgttatgggggcacctgaggactggctgacctcaccgggaagtgcgtcaggagtgggtgaggggtggtgggagggcagggagcgcccagcaggtgtccagcggtgctggcgctgcctctgtctctctgtccacgccctgtgtgtatctggagtggcttaggtgctccctgcggtgctcctggctgctgtggttcctgaaggctgcggctgtgccggtggtttcctttgatgtcagtcttcttctacaggggaaaccatgttgccaggagagccaggtgtccgctaattacgttgtgttgttctgcccaggagtgaacctgtaagtgatgagaataagaagcggctgtcagcctgcagacccgccctcaccctgtcctggttggggtgctgcctgctgggaacccctggtccagctgttgagaggaggctgactgggggcacagttgttgcagagtctgatgcaggctttctctgccgggaaagtaacatggaaacattgttgcttttactatggagcagatgtatctttgcccagaaacagaaatgctcttggtttctttttttggaaataaggcccataggctgggtccttcttgccctgttgagggaacgtgtctgtccttagcgtggaggccagtctggccgggtgctgagctcgtcctgcagaacacgcgtgaacgcctcatccctgagggccccgggaggctggcgccctctgtgggaggtctgaggttggcccatttgaccctatccaggacgggttacttaaggagtccaacgggccttgagaggctgatcaccctcgtgtggcgggcgtctctccccggtgccctcccgcctggtgctgtcaagggcttctctgtgccaggcgctgggctgtggcagccccaggtccccgcctggtgtggctgcccacggtccaggcagctccagggtgggcatccttggctccctccctcaccagctggccctgggaggtctgtctgagaggagttaggcctcattgtccgtgctcagagaacccgagccttccttaggaagcagtttgtccccgtgcctcccttcaggatcctgtggcctgagaagcctctgcgtggcagtggatggcagctccagctgcccgtggccctctttttttatggtttcccagatgactgggccaagctgggcctctgcatcctaggcatgctgttccctgcgcttccctggaaggtcggcggccctgcgtggacctacacggtacccaggacaggcctgccatggcaccggttgggcctctgggcacagggtgctctgcctccatggccctgacaggctctgatgcctgaggatgggggccgggcactcccagccttgagacttccctctgcagaggtggcacaagcccggggccccagagtgaggggactcttgcctgcctggtgagggtgagcgtggggtctggactctgacccctggtccaggcgggagaggagcacactggacagggcagccgagccaccctctgcggagctgtggacactgcgtgtgtggtgctgaaggtgtacacgtccactgaggccacctgcgccgctgcctgtgtcctgtgggctggcactcaccgagtgagagctgtgtgcagaacctccgctgtcagcgggccaggccacactggggagggaggtattccgtgtgcttgcactgaagcctgccccaggctgccttctgggttagggatacccaggacctccatagctggtgtggcgtctgtgagatctcagctgctgcttccctggacgcccgtgtggacctggaggggggtggggacccggcctggcatggtccctggccacctgcctggtgctccgggttgtgccgttggcagtgccttcgctctgcctcacctgctgcctccgcctttcctggctacaaccctgttgcccaaaccattaaaaaaattatactaccaagttgaatgatatgcaaatgtagtcaattaagcgaggggattttaattagcagtttaagttcatgtgtgaagtgccttgccttaattacttgacagttttgttgtaaatttgctaagtttttttttgcagaactatcaaaactgtgatttttgttaacattcttggatgcggtgagtggcgcccagcttgcctgaccctagtgggttttgtcttaatttataaagctctttaaactgtgaaaacaaggtaaaccccctgggttgcctctgtgtggctcttcgagtcaagccgggctcgatgtcttccttgtcactggctggggtggggacctgcctcgtgcgtggtcttgagctcccgttgggggaacgggagaaccttcatcccatgtgggtgtagccgttggcggcacctttgtacggggacacaccctggacctgaatggagtcaggaagggtttcaacctggatggcccgcgtgccggggacccgcaaggtgtgcagtggcaagggccggtcctggtggcgggctccctggtgatgctggtggatggttgtgcgtgggccttggggttcacagttcagtttgggagaggcgagaacccctcactttgaagtctttcctggccaacgggaggcttctcagagcagctttcacggctccggggctgagtgaggcctgtgtctaggctcatcctgccctccggggcgtcccagtgtgcctgggcagtggcgcagctggctccttccactgggtttaggtgtgcttctgctccccactgctgcttcagctgcgtcctttgcgggtccccgtaacttcagtgcccccacccctgttcggttccctgactgagctcggcgcctctagtgtagatgggtttttaattttcccagctgaacgtcgttatttggattgtgatttctttggtgtttcaatggactgtagatgaaggaggacctgttttctctcaggagtgtctgtggggtctcttgtcctggtttgctcagtgaagtgtggccccaagggctgagggaggtggccaggaccccgcagggtggcccccaccacagaggctgctgtcctccgggttcttctccactttctgggaccttggccgaggaggcctctgggagggtgaaatggccacaggcctggagaagcgacaccggtgggaagccaccggcagagaagtcagggaggagggagtcctgggcctggaggaacgtgggaggggcaggcgcctcctagcagcctcaagaaatgtgggccaggcaggtctggctacgggcaggagtgtgtctgggactctgaactgccagaagcacttggcggcaagccacatgctgtcacaatgttgcctggcccccatgaggaggtcccgtgggtggtggcgggtggtggctggttgtggggcaaggctgcgggactgggaccgctggcttcctggggccatcgaggctcccagaagaagaaatcaagaggattttaagaagcagagttctctttagcccgaagtaaccatacagcattaacaagaaaacttggaattcttcgaagtgaagctctctctacttgttcggaggatggaggacagttctagatccaggagagcggtggcgcagacacggacttcacccttggtgggaggggagaagcacagcatcctgttgttcgtgagtcaggtgagaggcgcgagaaaccacagctcttaggaaaatccgtgctgcccagtgtgggggccgtccacagcccttcggcactgctggggaagtggccctgcgtcgaccccaatcctcctcagctgtgttcagcccctgagatgccctgggctccctggttgagctttggtgggtaactgcaggatgcacacaggagctgcaggcgagggctttgtaggagctctgtggccgccccacatccctggcctctgccattttctgcctaaacgttgacacatggaagagggagcccaggatgctgtgggcccagaaggtggggccctgcgggctccatcacttcactccagggcacagagggcccagggtcccctcacacttgcctgtggggaccagtgggaacaattctcattttactgtcattatgaacttgcggcttaaatatgtctgtggacttcaaagtgccatcctgtgtggaaaatttccagctttcactgaagtagagagattagctcaatgcaccccatgtatcccgttcaccagttatccacagctcactcattttgtttcatccaactccctctcctattttgagggggagggattgtaattttttttttctttgagactgagtcctgctctgtcgcccaggctatagtgcagtgctgcgatctccgctcactgcaagctctgtctcccgggttcacgccattctcctgcctcagcctcccgagtagctgggactacaggtgcccgccaccgtgcccggctaatttttttgtgtttttagtagagacggggttttaccgttttagccaggatggtctcgatctcctgacctcgcgatccgcccgcctcggcctcccaaagtgctaggattacaggtgtgagccactgcgcccggccaggactgtaattttttgaagcaaatcccaggcatcatcttatttcatatttaagtgtttcaatatccacatctaaggaatatggaatcataaaaaacgctcaccatgacccattaccttgcctaacaaagctgagggcaatttccggacaccagcccatgttcaggtccttcctgtctcagaagtgttttcctgctgcttttcgggacccagggacagcactgcgtgcgatggatgggtcttccgtgcatgcctgtctgtgtgtgtgtgtgtgtgtgtgcctgtgtgtgcctgtgtgtacgtgtgtggtgctgtgatgggctgtggggacagtcccgcgtgctgacctgagcctggcagagtcaatatcttgttgggaggcagcaggccaggagagagcggagctggttggaggagggccagcctccccacctagagaccgtcggtgaccttcctcatgtgatgcgtcccttggtgtggcccccagccgctagtggtgaacctctgtaaatgtatgtgaacacttcccgtgcatgtctagtcaggagagtaatcagagaagcaattggtatgtgctcatcaaagaaccccagaacagccgagaagagtgcagagggtaaccccttctctgtctttgttcttggtgggttgggggagaagtacagtgtcctgtttgttcacgtcaggggagaggcaggaatgtaccacatctctgtcgctggaaacgtgggaagccgggatgtggcctaccgtggccccttctggccccgcaggggagtgggtgtccctgccctcactgtaatctctaccacattgatggaaagatttttctttttcttatttttggagacaaggtctcgctctgtcatctgtgttggagtgcagtggtgtgatcccagctcactgcagctttgacatcttgggctcaagagattctcccgcctcagcttcctgagtagccgggactgtaggtgggcatcaccacgcctggcggatattttttttaattttagagatgtgatctccgtttgttacccagactggtctgaaactcctgggctcaagtgatcctcctgcctcagcctcccaaagtgctgtgagccaccactcctggcctgaaagtatttttcgtaattggatttttccatatgtgcactaaggtctgcctttttccctgaatgaggcataacaagtatttctgtggctgtgttctctgtgggaatattattgtgacatgcttgtaagaagtaagtgaaaagcacaccagcacggtattcacatagcacagaaggttataaaaggcaaacgcagacatgggtgagggcagagttgttcttggtttgtcacaagggcgtgtgaacgcggttccccacctgccctgctctgctcagcagctttgggatatgagtgccttgggtgcctggtgcctttttgggccagccctgtggtattttggagtatccgttggtattgagagtctggaacttacttagtgtctggggcatgggccgtgttttggtatcgcaagagatgcttcagggcgcgtgtcagcacaaacacatcacacgggcttcgtgaccatgtgctggctgcacgagatgtcagtgtgctccgcgtaccacctgcttcatccccgccctgccctctcgtgctcctcggcagggggccgccatccttatgccccgcctgccctttctgcagctgtgggtgcaggctggccgttgtgctctgttgcaggagctcctgtcaggctgctggtctgcgcgtgtgctctccgagtgcctgtcactctggctgactcactgtgtcagtgtcaccgtgcagctttgctcgtcctgttcttgtgccttgggacgagtgggcagagtgcttgctgttgggtaggctgtggtgcaccatgtgggcctgggagtgaaacagcttggtcagagggcatgtcggtcacgccaggctgtcttccaaagcgtcccaacactccctgtcatcggtcttgttggctgtaaacgagttctctgctgcatgggatgctaggggtgtggtgagtttcttgtagacgtggcaggtcagaggggaggcacactgtctgccaggcaccctgttatttactgatacacgcacacgcaatacacatctctatagattgcttttgtatgttcactcagctgggatgattctgtgtgtgcttagatctttgttcacgtttctgatcatttccttagtggactctgagattcccctaaaaggtgggattgttttacccaaacttttctttctttctttctttctttttttgacacagagtctcgctctgtcacccaggctggagtgcaatggcatgatctcggctcattgcaagctccgcctcccgggttcatcccattctcctgcctcagtctcctgagtagctgggtctacaggtgcccgccaccacacccggataattttttgtatttttagtagagatggggtttcaccgtgttagccaggatggtctcatctcctgacctcgtgatccgcctgcctcggcctcccaaagtgctgggattacaggcgtgagccactgcacctggcccctcctgacaacttttaagattctgtcatttaggctgggcatggtggctcacacctgtaatcccagcactttgggaggccaaggtgggtggatcacttgaggtcaggttttcaagaccagcctggccaacatggtgacaccatgtttctactagaaaaatacaaaaattacctgggcgtggtggtgtgcacctgtagtcccagctacttgggaggctgaggctggagaatagcttgaacctgggaggtgaaggttgcagtgagctgagatggcgccattgtactacagcctgggtgacagagcgagactctgtctcaaaaaacgaaaagcaaaaacaagattctgtcatttagagtgtctttgttaatttgaaaggtgaaaaatctcatcatttagtttgtatttctttgctttttggtgggttgattgttttgttatttcagtatttttttctgtaacttgtgcatattacattttcttattgtggcaaaataaacataatgttgaccattacatgtagcattcagcagtgttgaacacataggctgacagtgaaggaatggaaaaagacatcccatgccattggtgaccaaaagaaaacaggagtggctccatttgtatcaaacaaaatatacttttcttcagaaactattactagaaacagaaaagtagttacagaacaataaaagggtcgaatcaactggaagatctaacaataatatatacgcacctaacctcagaacagctaaaactgtaaagcaaattcacgctgctgttcacccaccttcccaggctcagcctttgtccccatgagacactcactccccattctgcctcccccagcccccaacacccacccgccgctttctgtttctgtgactttggtgactctaggggcctcctgtgagtggaatcgcacaggatctgtccttttgtgacagcttatttcactcagcaccatgtcctcaaggcgcagccatgcgtagcctgtgtcacagtctccttccttctcaagactgaaccgcaggctgctgtatggatgtattttgtttacccatttctgtcagtggacacacgggtgacttccacagtttagctgtcgtgaatgatgctgctgtgagcacgggtgcacagtgacctctggagaccctgccttcagttctgggtgtagacccagaagtgggattgctggatcattgatcattctatttttattcatttatttttgagacagcatcttgctctgttgcccaggctggagtgcagtggcacgatctcggctcactgcagcctccacctcctcctgggctcaagcgattctcctgtctcagcctcccaagtagctgggactaaaggcatgtgccaccatgcccagctgatttttgtatttttagtggagatggggtttcaccatgttggccaggctaatcttgaattcttgaccttatgtgacctgcccgccttggcctcctaaagtgctgggattacaagcgtcagccactgcacctggccctatttttccttcttttttttttttttttttttttttttgaggcagggtctcactctgttgcccaggccagagtgcggtggcacagtctcggctcactgcaacctccgcctcccaggttcaagtgattctcctgcctcagcctcctgagtagctggggctataggtgtgtgccaccacacctggctaatttttgtttttttagtagagacgggtttcgccacgttggccaggctggtctctgactcctggcctcaagccgtcatcccgcctcggcctcccaaagtgctgggattacaggcgtgagccaccgcattcagcccgtttttctttttaaagaaccgactgtttttcatagtggctgcagcattttccactcccagcaacagcgttcgagcagcactgtctttgcatcctctccagcacttgttctgttttttgacagcggccatcctaatgggtgtgaggtggcatctcattgtggttttggttctcatttccctgatgattagtatgttgggcattttttcgtgtgcttattggccactcctatatcctctttgaggaatgtctgagtccctctttgagtcgagttgtgtgtgggggcctttgctcagttgtacgtctttatctactctggttagtgatcctgttctacttgtaaatttctgtctcctgtttgtctactgcgtgcaccgtggtcggatcctgcctctgttgctggaggctgcctctgtcctctgctgtggtggtcaggaagctggagcgtctcggcgccagattcatgtttgtaagaggagacgctctgtgagcctcggtgtgcagcgctgtctgcaagtcagactccccacccctcctttgtgcgagctgggcgggggctctgccgggactggtggtgttcatggagagggcttctgtgtgatgaagagatgacagtgacctgctggggccgaaggctgtgagtgccattgggggagggagtctcagagagtgcggcagtcgggcctgatggggctgctcttctgtgaaggggcacctaccgtgtgcctggcctgtagcagcagcaaagaggaacctgatggggggggcctcaggaacctccacctcgcccactgtggccaggctgcttctgctttctgggaggcctgtgcaagagccatgggcacaggccgggcacggtggctcacgcctgtaatcccagcactttgggaggctgaggccagcggatcacaaggtcaggagttcaagaccagcctggccaatatggtgaaatctcgtctctactaaaaatacaaaagttagccaggtgtggtggcatgcacctggtcccagctacttgggaggctgaggcaggagaatcacttgaacctgggagtcggagtttgcagtgagccgagattgtgccactgcacttcagcctgggcaacagagcaagactccatcttaaaaaaacaaaaaacaaaaaagggagccgtgggcatgtgtgtgcacaggtgtgcatgggtgtgtgcagctggagagggaagggcctgggtcaggggcgccctcagcctggagccagggaagggcagcgagaggaccccagactcccaaatgaccaagggcctgtttgcagcgtgcttctccctcctttcttctggctctgaagttatatcctgccagatcctggagaaagttcttttagcaaaatgatggcttcgctgaagatgatacttgccacctcacagaagcctgtcacgttcctccctttggaacccattgccaaatgtgggtggtgtggtggacccggggcaaggggccattctctggcagcccctagaaatgcctccctggggttggggtgcagccaccaggcaagaagtatgtacccccttgccctggccacttggggtttctgggacaatctgctggcttggccttgactttttcctgaacctaggagcccagggcctgctcctggcatcaggacttgctcttcctctttcctgggccccacaggtgcccttggggagcacacagctgccccagcccgagtccagtctggctctcgggaaggggccttactgctggctgcacaccttggcctccttcccctggatgcgccattgccaacgcagctgggacagcccttggacgcagcgtgcccgccccttttaccagggcatgtgggctgggaccagtttcagccccatgttgacttgtttggctctgctggtggtgacgggggggcgcggtggcggggggccttggtcgcgtcgtgtctgctcttgtgcaccggtgcctcacggagaggctgtggtgagtgcgcggaaggaccctggtgcttttggggactttctggagcagcccacattccttccccagagccctaggggcctggccagctgcctttccaggccctgaggccaccaggttcttggggggagctcctaggttctgctttggcctggctgggtggtgcccacactgccgcgtcccctctccggggctgcccggactcagcctggctggcagccatttccgttacttggtttccaaaggccccatcttggaatcaggagcaggctgtgggactcagggtgggttctgagcttggtgacccgctctgctcttttgtccggctttgtcctaactgttgaatattaatgaggggcgccgcagggtggctctccagtggagggtcctcactttttgttttgcaaataacgctggggcccctgcgccactggggcaatgcaactgtgacggtgctggttggattcaaaaggaagcctggcagtggcggggcctggacaggcagcctttgacctgaggcggggcggcgctctgcgctggttcagaaaagccgtggggcagcctctctggcaggcactggctgtacctgttggttttcctttgcccacagtgaagtgaaagtcactgcagctgggtttgctgtttaactcactgtctttccttctcacgtcttctctgtgcaaatagtggtcagtgtactttttgattatttcagtcaagtggaagtttctaggagcgtagagaggcagcgtggcttagggtttaggagcatggctgggctaccttcctactctgagtgtgggccacgttacttttctaggcctcagtttcccattggcccctctcctgtttggaagaggcagctgggtcccacaagccatctcaggagccgcgtctgggcgctggcacggggactgtgcccacagccagccagcctggtggtcagctgatggattcccgtaggtacttagcaaaatgcctggagtgtgcgaggctgtcaggccagtggcagatgcggtcgagtgctgttgtttcttggtgctgcctggcactgccaccctgatggtcggctctgagttggaggccagctttcatggcagcgttgttggtgggcgtgcagggtgtgtctgacctgggcctgggcatcaggtcccattgtggttgggtccacagggccccttgcctcattcgtggaggtgctgggggaattctacaggctgaggacgtgtgaggctccagggtccagcgtgcaggccggatgttcctagcgttgccggccacgcagacagccgtgccaccaggaggttccctggcaatgggagacaattgtctgctcagttcagccttcagtgccccagggctgttttgagatcaaggctgagggggaccctttcaagtgtctctgcctttggtggtcccgggtggccggctcctcacccatggtgtggtctgagtgggctgaaaccgaccccaggtgattcttattcggaagagatgtttctggaaatgagagcaaggcagtgagtggagagccagctgagagatgcttgactccccacctgctgctgttggggccaaaagcgtggaggagggaagagccagcacagagggctcacggtgtcccctgctccaaccgactcactggccgcggcctcatggggcctccctgtcctgcctcctgctcaacaggccacaggttttgttggattcgtcaattatgacccaggttgttgaactggaattggagatgtttttacagttggagagtttgttacagtcagaacatttcgggttgttggagttcggtgtcttgctgctgttgcagcttgcatcttttggccacagtttttttttttgatacagtgtcactctgtctcccaggctggagtgcagtggtgtgatcttggctcacagcaacctccgcctcctggattcaagtgattctcctgcctcagcctcccgaatagctgggattacaggcgcccgcccaccacgcccggctaatatttgtatttttagtagagacggggtttcaccatgttggccaagctagtctcgaactcctgacctcaagtgatgcagccgccttggcctcccaaagtgctgggattacaggcatgagccatcgcacctggccatggccacctgttttaaggaaaccactcagtgtcttaaaagttaagggtgctcattgccctgctcaacagagagtcccgtgtggtgctgggtagccctcgtgccgctctctggccgtcccagaacccgctgtccgttcccagcgtgtcctcgagtgtggggtggccactgctgcccaggtatgccactgtccatggctgatggaggagcaggaagtggcccatttgcaagcctgctgcctgtccttggtttgggtctttttattttgagaaatctccaaacctacatacagcgaagttgcaggaagaacgtggtgagtccccattccctgagctcagctgctgctggcactggcctcctctcgccacgactgtttttgcaactttttgccggtcatttgagagaatgtttcagtcagtggggtcctccctgctaagcccttcattctgaatttctaaaagtaaggggatgtggtgtgtgaccgtgacacggtgaccaagtctgggaagctggctcccctggccacgctctgccgtgtctgccacgccctcttcagtagtttacttctgcctgggacctgcctggcggctcagctgactcttctcttgggcctgcctcgttgccctaggcagctggctgcgcgttggcagggcccggacgggcaggtgggtagcggcagccccggggggccggtgccctatcagaggcgtgggaggcatcaggagcaagcggcccccatgcttttctcaggggagcctctcccttggtaattaatgagtaatccgccgaggggaactttggaccccaaaagtcccctgtccccatggactttatccgggtgggccaggatccctggtgagtctgcttgtcttagggatggggacgtggggcactgaccgcactcttggccactgctgctgctggagtctcgcctttctcctcccgcctgccttcttgccgtgtagtagcgctgcggaccgtgttcggaaagagtcacttactgtccgttctagtcacagttttgatgcccaagttgaccttctgttggctgcccacaggtctgggtatctgctgatgttcttttatttatttattttttgtagagatggggtctcactctgtggcccaggctggtcgtgaattcctgggcttgagccatcctcccgcctggtgtcccacagtactgggattacaggtgtgaacccccgctccctccccctgccccagcccctgctgaggtcttatttcagagccggcagggttttcccagctctcaagcgccctcacgtcccaccacagtgacgtatggtgtgttcactcctgtcctggtccccaggtcgtgtggggccatcgaggctcatccccagctgcagccgccctcctttccctgtagagccctcgcctgtgtaacggttactgcctctgtgtgggcagcatctgggggggctggcgccgggcagtgggagacctgctccatgtcactggtggaacccaatgtatgtgataggttcacaggtctcagctgtgaaattgtgtttgtacacggtggctttttctagaaaaatgaaccgcaaagtatttctttcctcgtgaatgtcgaccattttctcgagtctggttgttgttggccagtgacacaaacctgcagcttctccccttcttgcttccctccccgccccttggctccgggcacagcgtggctgaaccggcttatctggcctcgtctctggaggcctccccagctgtcatgtccgttgacatttcactgttcctggcagtggctgtgcccagacgcgccgtggcacgtgggagtgatgctggtctttgccagtgctctgcacacctgtggggaggcctctcggggtttcctgccaggtctctgtgcaccccccggtgagagatctgaggaggaggaggaggaaccgagggcaggtagggcgctcttcagatgtggagggttggaatctccagtttaataacaaactttatcctaccttaagttttcaaaagtcttgtaaagaacgggtccattcatttttagctgctccgtgaaaggtgagaaagctgagtagggggctgtgtcccaagaccagggtttgctgtggcctggctcgattgagaatcccctgggccccaggagggtgctgtggctgctgaggaggctgccccacgttctgatcctggtgcagggctgcactcagcctccccagaagcagcttggtcccgggtcccacctggcactaacctctgcagggcccctttatgtcatggtgttttggcctgtggaaggctttcgtccgtctgagctgctgactgagggtctttatttccacactcgagagaaacctggcggcccagcagtcagtgcccgcggagcaggtacagctcagggaagggagcagccccttgctcacggtcctttctggcacagtctgtggccctctggagtacccggccagcgtcctcacagctgtccccaaacgcgtggtatgggttcctccctcagggccagcaccaggctggtgctcagctcttctggaagagccgtcccatggtcccagcgcatccgtggaagagtgaaatattgaacgttacaagaaggaagtgaggccaggcgcggtatctcgtgcctgtaatcccagcacttttggagttggcgatgggcagatcacttgaggtcaggagtttgagaccagcctggatcaaaatggcaaaactccatctctactgaaaatacaaaaattagccgggcgtggttgcaggtgcctgtaatcccagctacttgggaggctgaggcatgagaagagcttgaatccgggaggcagaggttgcagtgagcccaggtcatgccactgtactgcagcctgggtgatggagtgagaccctgtctgaaaaaaaaaaaaaaaatagagttgctaaattggagtaaatatttcataacgcgattcagttcagttgctttagctgctctgtgagtccagcacccgcctgcagcgcagcctcccctgtggagtctggagcacccaggcctacatcacaggctccagagcacccgggccggtatcacgggctccagagcacccaggttggtatcatgggctccagagcacccaggccggtatcacgggctccagcacagcgggcaaaaggtgggaggctccccagactttaggtgtctggagttatccataaagggggcttcctgagttttggtgtatcccttggtttacaacccagggagaagcctggccacttgtgagtgcaggtcgtccttggacacacacttggaggaatcggaaggaacaggacacgcagccttatgttcctgtcagcccttcctgcacatatgccctgtctcagggggctgctggcctctgccagggcctcctcacttttgttcctgaggacatcttcccagcgcgtgtgcacttactaaatgagccacatgcccccagttctgacagctaggaacggtgcgagcagatggaggatggagctggtgctgctgcccacaggggccctgggagtgaggctgcgggtccctcgtgccctggtgcggccctggcttgaggccttggtttgggggtgttgtgccccccctaccagggctgagagcccacagtgacagcagaggggaggtgtgtgcgggggccgggcatcgatgctggacttgctgagggttgctttctggtggtgtgcacacatcttgggccagagtggtgtccccagagtgcctgctgctggaagagaaggctctgggtccttctggatgcccatcctggctgtgtggaccacggcggcaagggccacgtgcctggtcgtcaggccacggatgcttgtccggagctgcctcatgtggctcttgcacagaaggcaccattctagacattccaggtgggctccagtgaccatgaggggctggggttggcactggcgctgctcctctgaggtgttggacccacgtgggagctgcttgttcccctccagacactgattgtgaagaatctggaaggtccacgctagaggaggccacgacctgctggtgcgcctgcaagagtgctggcccaactggtctccatgcgtggtgcccgttggagggggtgggagggctcggctctgctctccccccgtgggtcttcgtgtcacagggtgcttgggggactctgctgcactgagatctccagcgtgacatgtccccgtcccaaacagccctgaaatggcaatgcctcatcctaggattaccgtcccttcccgaaggcttgaggtcctacttagatgtctactggactgctttttattttaatttacttgatactcagtctgggtgcgttgaagacgcggcctctggctgtcagcctgtccttgtgtgcagtgaccggtctacctgtctggccttgtgcctagacttgtggccgtcaccactatctctggggaggggtgaagtggactgggaggtaggagccgaattggagtcttctctttgttcctgaagttatcacagtcttggccagactgtggtcactgcgtgcgtgtgtgtgtgtgtgtgatgcgcagggcatttgctggtggaatagcacgggccattggcatttgcacctgaggcgtgcagcccccctgctgcacacctatggggtccctgcggtcaggtgagctctggggggtttctgagggtggagacagccacaacaacacttctttcctccaaatgcctgtgctgtgcacttgggtgcaggtggcttttaggggacatggctgggcactgccccacagtgtcacctctgtgtcctgtggtgcgtgctgtggactggcaccacaccccacgtgcttgttaggccagtttctctcaggtgtcggtcaccctaccatgcggcctttcttttgtcttttatctttagctaaggagtccatggcataccaaaagctgaatgatgacagccagtgtccccatcctgtcctccccaactttccacaggcagggacgctccccattcttgctgcatagtcttctgttgaccccatgtacctgagtgacccccacgtacctgagtgtgacaagcactatggtgcttgacctcagtccagctgcttagacctgtacctgccacagccccacgtgctgacaccttgcgtcttgagttttgataaatctatcctttggctgattaatatgactgagtggtgtcttctgaccccatttcttatctggaacactgtgtcctgacttcatttcctgtctggagcacactgtcctgacctcatttcctgtctggaacacactgtgtcctgacctcatttcctgcctggagctctctgtgtcctgacctcatttcctgtctgtgccgctctgtcctgacctcattttctgtctgtgccaccctttgtcctgacctcatttcctgtctggaacatgctgtgtcctaactgcatttcctgtctggagctctctctgtcctgacctcatttcctgtctggatctctctatgtcctgacctcatttcctgtctggaacatgctgtatcctgatatcatttcctgtctgtgccactttgtccggacctcattttctgtctggagcactctgtatcctgacctcatttcctgtttgtgccaccctttgtcctgacctcatttcctgtctggaacatgctgtgtccggattgcatttcctctctggagctctctctgtcctgacctcatttcctgtctggagccagtgacctcatttcctgtctgtgtcactctgtcctgacctcatttcctgtctgtgccactctttgtcctgacctcatttcctgtatgcaacacactgtgcccggactgcatttcctgtctggagctctctctgtcctgatctcatttcctgtcaggagcactctgtgtactgacctcatttcctgtctgtgccactcttgtgtcctgacctcttttccagtctgtgccactctgtgtcctgacctcatttcttatctgtgccactctgtgtcctgacctcatttcctgtctggagcactctgtcctgacctcatttcctgtcttgtgtcctgacctcatttcctgtctggagctctctgtgtccttacctcatttcctgtctgtgctgctttctgtcttggagttgcgtgcctgacctcatttcctctccactgtgtgttcctggagttaggcatcatcttggtttttactcccttgcttggttttctcaggatctctggctgctccgtccttgctccagcgttcttctctgccccctccctctgtggtccagaggccgatggccagctggccctcacctgcccgccctgggtatttctgtgctcttcctggtgagggattctaggggttcccctcctgggttcatccttacctgagtagccacagcacactgtgcagttgggtgcctgggaggcacgtgctttgggtgttgcatggctgacctggtaactgggcacccgtgtatggagggctggaacagaacacttgtcggcgctcctcagcgtcttgcctctggtgtccccatggcgaagtcccctgccatctgctttgggctctgacatgtgacctgactgtgcccttcaggagctttcagaacctcctcttagatctggcattcaaaatgtcttgtcagacacctcgaggcggcttgtgtttggccctgtgttgggcgcctattgggcccttgtcaggtttttgttgccaggaggctcgcgccccgatcttcgggatggtgcccgtggcatcttctgctcggtgctccctagggctggacgttggtcctcctggcactggtgctccggttgctgtggtctccctgctgttcccttgtggctcaggattactctctggaggtctccgccttatcatgagcactttctttgttggctacttttagtttcatgatttcattttcgtttctaagatatctatctctttgtaaaagctcccaccttttgtgacttgtggatgctgtatctttctcctgttgctgcagacattaatgatgtttttcttgacagtttgtcctgctggtttcctctgcattcctttggttggtttcagacctcggctttaaaggggcatttccccacattgccaattcttgaccatctggtcacgtcaaggctgacgtgccaatggctgcaagggggagggcacctgggagcccgcggatggctcttatgcagacgtgcgggccagccccgatcctgcttctgcaaggcctcccctcccatggtggcgctttggtgccagagcgcgtcggcgtggctccctagcgtctgcctctgcagctgcttggcccccagccgcctcctcccagctgcctcctgccctatgtgtgcttgagctcgagacaatgcttccttcatccaagagccgggctctcggcgatttttgagaggagaatggggttgaagcgatgttgctcttccgtcttaaaactggatttctttcctcatgcttttgaattattatatcttcttgacatgtttctctggatttgcaaaagatttttatattttatatatttatttatttacttatttatttatttttgaggtggaactttgctcttgttgcccaggctggagtgcaatggtgtgatctgggctcactgcagcctccgcctcctgagttcaagcaattctcctaccttagcctgctgagtagctgggattacaggcatgtgccaccatgcctggctaattttgtagttttagtagagatggggtttctccatgttggttaggttggtctcgaactcccgacctcaggtgatctgcccgcctcagcctcccaaagtgctgggattacaggcttgatccactgtgcccagcctgcacaacattttaagtaaatgttgacattttaagcattgagcaaggaagagtgtgaagaggtactttataaagggaaatatggcaatactgattatttgcgactttaaccagaagtaatctttggacagccagatgttattgtcttggaatgtggtgttttatctagtgacaatgtgtgtgcatgcacacgtggacacacaggattcctggtccttaaacccgtatgttcggtgtctgcagcatagaatggtctcggctggtatgtgtgggaccagctcagatgcccctattctagatgccgaggccgaatcgccccctagggaggatgggacagtggctgtgctgagcgtgctacggcgtcatggaagaacagcagaggcgtttgagaattgtgttttttaaaaagagttgaaacttgtcagtcaggaaatggagtaacaggtttatcaggagtgtcattttccttttttttttttttttctcccatgagtggcttggtcggggaactcatgtttttttttgtttttgtttttgagtcagagtctaggtctgtcacccaggctggagtgctgtgatgtggtcttggctcactgcaacctctgcctcccaggttcaagggattctcctgcctcagcctcctgagtagctgggattataggcgcctgccaccatgcccggctaattttttaatttttagtagagacggggtttgttggtcaggctgatcttgaactcctgaccttgtgagctacccaccttggcctcccaaagtgctgggattacaggcgtgagccaccgtgcctggcgggagctcatgttttatctgaggtggcccagggccccacctgggagcagggtcagcagtgcctggcccttgagtgtttgcctcggggtgtgttccttttaaatcagatcagctcatcacttggccggttttctagaccagcatattcaaacccaaggtttggaatcttgggctggcttctgaaatgacatgctgtgggctccatccccagaattctgggttcccaggtccgaggtagggactgagaatgtgcatctctagcaagttcccagatgacatggtggctcctccggaacccctgcctccttttgtgggtaaagttttacaggtgcatggccacgccccaccgccctcgccggtgctgtctgtggctgttttgtgccacagcagaaaggctgagtaggtgcgagagagaccatgtggcctacaaacccaaaatatgtgtgatttggtcccttacggaaaacacttgcaggttcctgatctagagaaagaataattgtaacgcagggctacattgtttttgtgaaactctttaggatggaaaagggcatctctgaggtcagcgacagaagccgtggtggtttcatgccaccagtttacctttgtcctgagctgtggaggttgtttaaagctatagatcaaatgaagcctggaatataagggtgcagttaggatgattgctgtgtagttattttttaaaacggctttttgaggcataattaacataagctgcgtatatttaaagatacagttagataacttttgatgtatgcaaacacatataaaacatgtataaaaccctcgctgccgtccagatgatgaacctgtccgtcacccagaagctctctcctacccacacccctttctccccaggctgcagcagtctgcttttgggcctgtagattcgttgccttccttagagctttgtctaaatgaaatcctacaatatgttcttcttttggtctggcttccttccctcagcgtcattattttgggctccttggatgcgtggcgtgtgctgggcagtgttcccctgcgtggatgtcgcgtttgttcctccatttgcccgttggagcgtgtggagtgtttccagttcttgactgtcacaaagaaagcggctgtgaacattcgggtacaagttgttgtcgggatacacggttttatttccctggatagatacctaggtgtggaatggctggatcatatatttgtgcttatgtttaacttttagaaactgccagactatcttccaaggtggctgcaccattcctcgtcctaccagcagtgagtgagagttcctgctgctccacgtcctggccagcgtgtgtggtgggcgggcttaggcgttcagccgtcctgatgggtgtgcggcggcatctccttgaggtttaagttgcgcttccccaatcgttgagaacgtagagtggcttctcttgtgcgtatttgccaccatatgtcttctttggtgaaatgtcccttctgatttttgccagttattttagactgggtttgttgttttactgttgactcgtgagatctttacgtattctggatgcaagtcccttttcacatttgcgccttacgtagactttgtccctgtccatggctttccttttctgaacggtgttttttgaagagtagaactgcaaaatttttatgggatccaatttttcagtttgttctttttctttttttttttttttttttttttgagacagggtgtggttctgttgcccaggctagagcacaatcttgtgatctgggctcactgcagcctttacctcccaggctgaggtgatcctcctgcctcagcctcctggctagctgagactacaggcacatgccaccacacctggctaatttttgtattttttgtagagacggggtttcgctatgttgcccaggctggttgcgaactctagctcaaatgatccgcctgccttggcctcccaaagtgctgagattacaggtgtgagccactacgtccggcctcagtttgttcttttggtttggacttcggtttcctagctgggaactttgtccctaactcaaggtcacagagattatctcctgtattctagaaattttgtagctttaagttgtatatttaggtctgtgatccattttgagttaatttttgtgtgcaatgcaaggtgtggacctgagttcatttctttgcctaaggtgttcagatgtttcagtggagtttgttgtaaagattagttctctactggattgtctttgtgcctttgtcagaaatcagctgtgcagatgtgtattcagttgatccacttgtttatctttttacatcaacgccatgctgttttggattattgtagctttgaaataattgttgaggtcaggtgatattcgcgctctaaccctgcactttttcagagctgttacagctattcgggatcttccacttttccatatgaattttagaatcagtttgtcaatttctgtgaacatttctgggaaattttgattgggattgtattgagtccatagataaattgggaatatcttaacaatcgggagttttccgaccaacggaaagctctctgtttatgggttgttattaatttagtattttgtaatttttagtgcacaggtttttaccatcttttgtcagatttattgatttatctattgaggttttttcttggtcttgtaaataatatattttaaaaattcgattactggatataaacggccactacagttcttatatgttgatcctgcagcctgtaaccttcctaacttgctcatgagtcctagtggcttttattgtagttgccattgggttttctgtgtagatgatcatgtcgtctgcagtaaaagcagtttcacttcttcctttccagtctggatgcttttttatttgtcctgcttaatggcaccggctagggcctccagggcagtttgaataggagtggtgggagtggacgccctcgctcctgatctcctgatctggaaggcgtggaatcagagtttggatgggagtggtgggagtggacgccctcactcctgatctcctggtctggaaggcgtggaatcagagtttgggtgggagtggtgggagtggacgccctcgctcctgatctcctgatctcctggtctggaaggcgtggaatcagagtttgggtgggagtggtgggagtggacgccctcgctcctgatctcctgatctcctgatctggaaggcgtggaatcagagtttgggtgggagtggtgggagtggacaccctcgctcctgatctcctggtctggaaggcgtggaatcagagtttgggtgggagtggtgggagtggacacccttgctcctgatctcttgatctcctagtctggaaggcgtggaatcagagtttggatgggagtggtgggagtggacgccctcgctcctgatctcctggtctggaaggcgtggaatcagagtttggatgggagtggtcggagtggacaccctcgctcctgatctcctgatctggaaggcgtggaatcagagtttgggtgggagtggtgggagtggacaccctcgctcctgatctcctgatctggaaggcgtggagtcagagtttgggtgggagtggtgggagtggacgtcctcgctcctgatctcctgatctggaaggcgtggagtcagagtttgggtgggagtggacgccctcgctcctgatctcctggtctggaaggcgtggaatcagagtttgggtgggagtggtgggcgtggacgcccttgctcctgatctggatttggcaccgtcgagtgtgatggtgcatgttgggttttcgccagtgccctttatgagtccgaggaagtccccagaatacggttcctagtttgatcaggaaggatattgggttttgtcaggtgtttttttttcttaatttattgagattattaatatggtgagtgtctttctatttcaggttactaatgtgatgaattatattgactgattcttgaatgctaaaccaattgttcattcctgggatagccccccttcagtcgtgatgtattattattttagaatattgttgaatttgtttttttttgtttttgtttttgagaccgagtcttgctctgcacccaggctggagtgcaatggcgctatctcggctcactgtaacccccgccttccaggttcaaatgattctcctgcctcagcctcctaagttgctgggataacaggtgtccaccgccacacccagctaattttttgtattttcagtagagacagggtttcaccatgttggtcaggctggtcccgaactcctgacctcaagtgatctgtctgcctcggcctcccaaagtgctgggattacaggcatgtgccactgtgtttggcctcttgagttttatttgctaaaattttgcttagaattttttttttttttttttttggagacggagtcttgctctgtcgcccaggctggagtgcagtgacacgatcttggcttgctggaacctccgcctcctgggttcaagcgattctcctgtctcagccttccaagtagtagggattacaggcgcatgccactgtgcctggctaatttttgtatttttaatagagacggggtttcagcatgttggccaggcagtcttgaacttctgatattaggtgatcctcctgcctcagcctcccaaagtgctgggattacaggcgtgagccactgcgcctgccaagaatttttgcatttatattcatgagggatgttggtgtgtgtttttttttcttcttcttcccgtgtatctttgtctggttttggtgttaacagagtaatgttcttgtagaatgatttgagaggtatttcctcctaagttttctgaagaattttttcttttaaaaatgtttggtggggggactgggcgcggtggctcatgcctgtaatcccagcactttgggaggccaagtcaggagttcgagaccagattggccaatatggtggtgagatggttcacccatctctgtgccactgcacttcagcctgggcgacaaagcaagactccatctcaaaaaaaaaaaaaaaaaagtttcgtggggctaggcatggtggctcacgcctataatcctagcactttgggaggccaaggcaggaggatcccttaagcccaggagttcgagaacagcctgggcaacatagggagacactgtttctattaaaaaaaaaaaagtttcgtggaacttaccattaaaacctactcggacccagagtgttttttgtgggaagatttttagctatatagactattcagtttatctgttcttggttgagagttactggtttgtgttacacaagtaattttctcaattcaactaaaaatgccatttctccctttgtttctgaaaggtatttgcgtaggtatagaattataggttgacttcaaaaagtttcaattttttttgtggtttaatttaatttaatttatttatttgagatggagtcttgctctgtcacccaggctgaagtgcagtggcacgatctcggctcactgcaacctctgcctctgggttcaagtgattctcatgcctcagcctcccgagtagttgggattacaggcacccgccaccacacctggctaattttttgtatttttagtagagacagggtttctccatgttggacaggatggtcttgatctcctgacctcatggatccgcctgcttcaggtttccaaagtgctgggattacaggggtgagccactgcgtccggcctgttttatttttttgtagagatgggatttcaccatgttggtcagcctggtcttgaacttggactcaagcagtctgccctccccagcttcccatagtgctgagattacacaggcatgagccaccgtgcctggccccaattttcagtactttaaagatgttgctgtactgtgttcctgcatgcgtgcttccagagagagatctgctcatcctcttcttgacggacatgcctcttctttttttctttctttcctttgtttttttgagacagaatctcactctgtcacccaggctgaagtgcagtgggacgatctcagctcactgcaacctctgcctccgggttcaagtgattctcatgcctcagcctcccgcgtacctgggattacaggcacccgccaccacgcctggctaattttttgtatttttagtagagacggggtttctccgtgttggccaggctggtctcgaactcctgatctcaggtgatccacctgccttggcctgccaaagtgctgggattacaggagtgagccacggcgcccggctggacatgcctttctttaagattgtctctttgtcactgctttgagccactttgctgtggtttccccgtgccgcatgtgtttggagtacgttgtgtagtttttgtcaggtttggaaggtgtgtctcctgcgtccctcctctgggcacttggtggcccgtgtgtcagtcatgtgaatgttgtcagctcagggtgctcttctcatcttctggattcttttttttcctctatttccctgtgagtagtttctgttactctgtgtccatatcacaaaccttttcttccacaatgtctcctccacggttaatcccatatagcggatgtttcatctctagaagtttgatttgggactatattatatctttcgtgtctttattttactcttttaaatatgtggaatacactgtaataacagttccagtgttctctgtgaatttctatgtctgtgtcaattctggttgtttgcgatggatggatgattttcttcattgtggtccacattttcttgctttctggattctagacgttttgaaatgtgcctgtttgggtgctgaatgtttttgtattcctataaattggctgggcatggtgactcacaccagtaatcctagcactttgggaggctgaggtgggcagattgcttgagtccaggagtttgagaccagcctgggcaacatggagaaaccctgtctctacttaaaaatacaaaaattagccaggcgtggtggtgcacacctgtagtcccagctactcaggaggctgaggtgggaggatcatttgaacccgggaggtggaggttgcagtgagcttcaatcgcgccactgcactccagcctgggtgacagagccagaccctatctcaaggaaaaaaataaaattaaaaaaaaatcttgagctttgtctagactgcgttcagttatttggaggcagcttgatccttttgagtcttgcttttgtgatttttttttaggtgggtctagagctgggctcagggctcattctaggcctgataattcaccactcctgtggcagaatcttctgagagacataggaccccatgaatttgggcaatttcctgtctgtcgggtggagacaggctctctgcctagcctggtgcaagcctcaggcctgttgtctctaaatctttgtgggtgactcttccccagcctcgtggagtttctgcacatacatactgtgatctggggtctgcggaattgccaggggcctctgcagaccccaggccctctgtgtggtgctcccttctctgctgctccgtcctgtgaattccagccgccatgctctccctgaattgtcagctccatctcaacccagtttctgctgggccctgcctgggtcctgcttcctgtaccatggctgggaactctcgggaggcagtgagctggggctgccagagggcttggctccactttgaattttggggaccaccgtcctttgctgcctgacctccagggtccctggggccattgtctcccatctcctgtcttgtctgcgtttttggcctttccagggaggagggtgatgggtctctgtgacttcaccttggctgcaggcgggccctggcatcgcagtccatgagtgacctccagcttctctcatcagccaccccgttcatccactccatttgtaaaatgagatagaaaatgaagatggtgctgtcgtcacagcggccggatatctgtagctcgtgggctcccctctaggctgaggctcttgttgtgggagaaagttgctcagggccaagtttcagatagaaagagcgaaagtaactggaaatgttgagatggccctggaggccctcagggtggcctctgcttcagggaggaaggtgggcaaatcacgctccgtggcagcaggtttaaaaacatcgctgaattgtgctgactggcacatccattgtgagcggatgtgttttccttctgcaataattttggctacattaaattcgttttgttaacatcttcatcaccgccttttcagtttcagcgggaattgattatgaacaaagtgccatgattttgactattcaggcgagcaactgcatcgagccagcactgaactggttttgtaacaagcttggtgtccatatcgctcttaataacatctgcaggcacaggcgacgatagcagttgtgggccagccgtcaggaaaggggggactagcacgtaccactcagaattcagcttgcgcgggctgcggtggagttctggggtttgtttgtgggcatttccaggtagtctgatcctgtgaggagcaaggaaggggtgtgttgacagggccgttcgggccggagcaggtgcgacaggaatgtcccacgtcctctcgtgtgctgtcgggagacaaacctcttcctgcttcaatatcccattcgttccagagcctcctttcagggtggaaggggtggtggatggctttgggattgggccaggcctgagggcactgagggagtggggcattaggggccacgtggtcagcactgcactctgctctcatcggaagctgggcagtggccagaggcctgggaaaggcttgttgtgggggcggggggcgcaccacacttcagggatgcagccggcctttgggcttcaggaaacgcagctgggacatcctgaggtgtgtgaggctgatgcatgggcctttctacttccagactgtcccaggacacgggtccacggtcacacggtctccaaatgagcaggaacaccttgcatgccctgcgagatgtgtttgaaagtcacactttggttccaggtcacagcttgaacctcaggccacctccagtgggaggctggaggtcctgtgtgccacccggggcctgtgtgctgtggtggtcgtggctctgtgggtgccgggcagaggcctcccaggctgggcagccgccacccctctgtggacgctactcacccttagaagcaggttcccacaggccagggcactcccaacagcactgcgtggagctggtgcccacccctgtggtcagatgcatggcgcccgcagccctggcccaggtgccccctgggttgtgcggcggggccctggctctgtgggtgggtggctgtgctgccgctgctgtcgcccatccttgggggccggcgtcgcctccctgctgctcctactgtgtgctttcttgcccctccagtgcctcccagggggctgtgtagccaggtgtctcagagggctcagggctcctggtagggtttgggtgggctgaaccctgcaccctggcccgggtgtggggtcctggtgctctgtggcctgggacacccgtgcttcctgcaggctctgcgtggcgctgatggagggcctcttgttaagggggcacggtagtgagtcaggtgcccgggggctcataagccaccttggggtatgtctgggtgcatggggactcctctggcctccccagcggtgctgagccgtcactgcagggcagccatggcccatttggctggtgctgagacaaggtgaattttcttggctggcttgacaggtccccctttccctcaccatggagtttcacccaattttcagctttgacggagaaatgaggcttggagtctttttctggcctgtgagggctgcagagcagcgtgcccaggggctgtaggtgcagtccagggagaggccatgacaggagtgggtgtggggactggtggggacagcgactgtgccttctggccccacccagagagccccagctgctgtgctgccgtattctgattccttcttccctccctccctcccttctgcctttcccctttatcctttccccccttccatgtccatttcccttttccctccctccctctctttccttctctccttctctccctcttcttttttcgacagggtctggctctggctctgtcacccaggctggagtgcagcagcacagtcttgcggcctcaaccttgttggttcaagtgatcctcccacctcagcctcatgagtagccgagactacaggcacacaccactacatctggctaacgttttatattttttgggtagagatggggtctcgccatgttgtccaggctggtctagaactcctgggctcaagcgatcctcctgcttcagcctcccaaagtgttgggatgacaggtgtgagccaccgtgcctggcccatgtttgattctcgatgcagatccagccctgggaagaaagcaccgctggccatgactgggcagagccagagagtgactaaggggctgttaggacagagacagtgggttttgcagtgatgtgagctttgacggaagtggccacactgcaggcccccacagcgtcactagtaggccaagcggacactgcgggacacgttccccaacgtgggatgtccgtcctcagcagtctgtggccttctgtgaagcaaagccgttttgcaggctgggttcatccccgttccaggcccgcactagtggcgcctggttatcaggtgtggtgaggagctttgctgccctggagcgtcgctttgtgggcagaagccaactttggaatcgcctcatggctggccctggacctctcctccttccttccttgttggttgctgttaagccagccttgggcaccagggacagtggggacgtggctgtgcaccgggcccagggctggcaggaggctgcttcagggctctggaccagagcagtgtgtggctggtggtacctgtggctggcgtgggtctggcgggtctggtggtgcctgtggctggcgtgggtctggcgggtctggtggtgcctgtggctggcgtgggtctggcgggtctcgtggtgcctgtggctggcgtgggtctggcgggtctggtggtgcctgtggctggcgtgggtctggcgggtctcgtggtgcctgtggctggcgtgggtctggcgggtctggtggtgcctgtggctggcgtgggtctggcgggtctggcatgtttggtggtgcctgccatcaggctgccgatggatgagcctgcctgtcccccacggattggagttttgcccaggggtgctgtgccctggtcattgtcccctacagccaggcagtaaagtgtggccagcaccttgctgcaagagagggacagaggtcatctgtctacgagctagagcaagggcaggtgggcccactggctggcgctgcgtctgggttcggtcctggacctgctgcgtgttatcctccctgcgggcctggcatgggagtaggggctgagagatgctggtgacaccactctgacgccacggcctgaggcagccgttggacagtgcccatcttgaatgcagccctggtgacctgaagcccctgcgttggtccctcacaggccagggggtgtggccacagggcctgggctttgtcccgtttacgagaggtcaggcggtcacagggtaatgggaggcctgtggttcctgggctgccatctggcgattgtaaaacgggcagtgtgcagtgttgagggggcgctggggaaacaagctgccggctgaggaggccgcactccccgtgcctcccgggcagacacctcacggcctttctctgggtgtctgaacccaaggtgaaaagttcaggctgtccctgctctccagaggggctggaggtggggcgggagcagagactggacctggccagcccctcccgcttcccttcctctgggcccctggactctgggggcgagggcagggctgtttggctgttggacatccttgctgtccctttgctggactctccagaggaccagcatggaggtgcacaagttcacatttgtccctctcctgccccagggcacctggccctgtcccgggccaccccaggctggaccagctgcccatgtcaccaggccaggcgctttccctgtgaatgagccgatggccgcaagtgcctggcctcaggcctgggctgtggggatgactgaggcccagtgaggagtgggctggggcctggtgtgacctgcacggtctgtgggggttggagggatgcgcgacttgggcccaccccagaacttggggtttcctgatgggtgttggggtgcacacaagcctgggctcctttgtgattggcgaccccagggtcccgggacagtccctgagaagcacagaggcctggacactcccacctcccagtcaggccctgccacatcctccctgatggctccaggggcttttgttcactgaagaacacttgctgtcctcccctcagaagagtctgctcggtgggggagccgcagggggctgctccctgtccaggccagagaaaccaggcagcctctcccgccgggagaggtcccccacaggagcctgttatggagccgcgtggcgcctgggctggtgtcacccctgggagcccccttttaaagaagactcattcaatgtccctctctcagacggcctccagcgtggcgattaagcgctcagatgctggcaggttccgcggagtgcccggctgccctcggcaggggctttgtgttggctgccctgccccgggctgaccccagacgctcgccttttgtgctacgctgctctcgcccctcgggaacctttgtcccattgagccccgccattgcctggggccccttgcctgtccctgcgggcccgccccagggcggggattgtggccctggtcccctgggggggggtagggggcttttggtggcctaaggggaccctctgagcactcatgcaggcctccccccaacctcacgtccaggtctgttgccgaggggccaggagattctgacattgtgcgatggccccagaggttgacatcctggggaggattggctggtgatgcttccagaaagtggtttttgaagatgcatctggtcctggcccgtggatggctggcgggactgggagagacactccgggccactggctgctttctcgcagctgttctcctctgggaggacttgcccctgtgggcaggtgcaggggcactgagcggaggggcttgggggcccctgcccgccccaggccaccttgctctctctccaggcctgcgtcctgcaaagaggccgggtcaaaaggtcactgccccgatttttattgctgtctcttacgttctcacgacctcttgccctctgcacagatgggcggggctggagcttccacgagggccggcctttccggggattaaaaacccactgaaaggtctgagcctagctaccaagcttaaatgtcttagtagcttaaaaatggtgttaaaaattaagcaaaacacacatagacttccaggtttagcataaatagaaaccagaggtgttgagaccgtgctgccccctcaaaccagcgcagtggaaagaggggcagagccctccacaggagccctccgctggggggttggggagacggccctggcccagcgtctgcagctcccagcggcactgaatggcagtggccgtccctgtggtctgggggcctccttcccccacaggctacacaagccctggtcctgccaaggctcggggaagccctttgtgactttagaaaaataataatggagggtgaactggttcctatttttgcattgtaattgattgccaagaacccctgaaattaaatacaaccatgtattttaaatggtgtccttaatgtagaatgtttttatcaaaaccaaaactccctgttgaggccttagtgttctgtcaatagcgtgttggagtctggttcccgtctcccctgccccggcctatgtgtgctgaccctgggaccggtgaggcagttctcaccacgccccgagcctccccctcccacgccccgagcctcgccctcccacgcccctcctgcccccgaggctcgctggcgtctgtgcttcttccaggcggagggggaggtggtaggcaccttgggtcttaaatcagagaaactgtcccagcagtagtaaaagtcatcagctggccccaaagagcccctggaaacacaggctgtaccccgcctccatggagacatttggtgccacctgcgttcagtgcagatgccacacggctcttcctgagatggcttccgaggccatttggcccttcatctcgggaacagaccaagggggtgttttcggccgtctgagacccacctgggggtgtctgggccttggccatgctgccttctccaagccccatgcttctcccggcccctcctccttcccactggcgccggagacctttggtagtgggtgtggaaagacagcagctgtggggtccctgtcctggccggccactcctccttcccgccagtgccggagaccctcggaagtgtatgtggaaggacagcagctgtggggtccctatcctggtcagagggtggcattcctcccacagtcctgggagccacagggctgagatgggacttctcagcttggcatggggagggcaggacggggtggctgccatgcctcattctgtctgtgatggaaacgggagggcctggccctgcctctgttactgagcttgagccagggacacccgtgaccctgcctggggcggtcctccccagccttgtgagccagggcagaggtgcaggttgggtggctgacctggtggggggtaagaacatccacggagaagtgtgacgagtgtgcgaccagagtgtggacccagccaggaggcctgaccgtgactgcagcctcccccagcattgcaccaaagtgtgctcgtgcaggacctcgaagatgccccgtgggcagcgttcgggctgaggctgcagggggccttgggagcacggtggccctcctgtctgttctgtggaccgggtgcggatgggccgtgcaggcagacgtgctcttgggtggttgtggtggggatgcctctccgcccaccaccctctcactcactgccctggctggaaggtgacggcatctccctgaccggcagcgccaggatggcagccccacaacagtgtcctggtcgccccagaggcatgctgagcgcccatgcgtgtgcgcaggtcctacgggccgtgtccagacccagccccggggtcaggtgacacctgtagttgggtgagcgctcacacaggcacctccaggtaagggggattgaggaaggtagcgctttgtcaatggcactggttttgctccgaggctggactccttttccctttgaggagctctgctcatgtgctttgcctgctttcccatggcaggctttttattggttaaataaagacacaaacttttcatcagtctttgcaaatacttggttccggcaagttcttggcccttcccaggcttggggctgccggctcacggttcttctctctgcatttcagccaggcccccatatgctgggtttgcaggtcacgaccacccatgacggctgtgctgcgtggggtgcagttccccgtgggcgccgagggtggtgtggggctgcctctcgctcgctccaccagccacccgagggcccgtgtcctggtcgtggccgcgtgtgctctgctgtgtgggtggtcagtcctccccaggggccacctggatggtgtccactcctgccccatggcaggaagtcccagcggcacctggccacgtccctctaacatgtttctggaagtgggattctaggctggagcctcatagcgggcagatactgccccctggccatgagccatgacagttggttgatgggacttgaaggggcctctggacagtgtggctgcagccctggaccctaggagaatagcagccgtgatggggggcagggaccccactttctgggtgggagtgaggagggccggctgctgccccttgctgcagtcatcttcagtcactttcccggccgccacggccccctcctggcttcttgctctcagcagaggggacaagacccttgtgagggtgggcacaggcactccaattgtttggggccttcgctgtcccttgctgtctgtgctggtctttccaggcatccccaggccgtgtgtgtcagcaggtggaggctgggcacctctcacccacccaagctgaagcggcctcacagggggtggcaccaggtgtttctccagctgaacaagctcgccctggaacccccaccctgaaagggctactgcccccatgagaggagcttctagagatggtggccagccttgggggcccggtggagatgtgttcgcggggtcctggtctgattctgtcttggaaggaacatcgggcccctgagaggtcagagcagtggccggcccacggctccgctcaggcgccacggcggctcctttctgtttcttgtagtcactgagttcgaggttcccacagggaggaggcttcctgtggctccgccgtcagggagcagtggggctgccccagcctctgggggctttttaggtgctctgaggcgatctgggtgtggcctggccggtgtgggcagctttgcccttcgtctgagaccccgagccctggggcaggatgaggggtgtggggagagtttgctttttccagagacgtttatctgttttttttttagacggagtctcgctctgtcgcccaggctggagtgcagtggcgcgatctcggctcactgcaagctccgctcccgggttcacgccattctcctgcctcagcctcccaagtagctgggactacaggcgtgtgccatcacactcggctaattttttgtatttttagtagagacggggtttcaccgtgttagccaggatgctctcgatctcctgaccttgtgatccacccacctcggcctcccaaggtgctgggattacaggctgagccaccgcactggccagcgtttatctttaaatgtgccttggacctggcccctggctctttgggagggagagtccttggcaggccccgttgcctccaccccaccagtgcaccttggctcctggtcactgcccaccctccctgcccgggcaggaattcttacaggccctacactcctgaagggaaatcaggctggtcctggggcaggcagcctctcagagctgttgagaattgagcaatctccttgtgctctttcaagctgttcttttctttggttcacactgagcaagggctggttgctccgatagggagaagacgtgaggagtggcatttactgtgattgagcacagggcctgtggactctcccattcacgcagccacatttcccaaaaagaagtggtcctgctccccaccccccgacccccactgcagcgccacctgcctttatctgtacttggagggacagcgcagcaggctgtggctggctaccccaggtggctccacccagctctcagaagttcacctgctgcactcagaggccgtttacttgaggtttgatatttatctccaaaggaagggctgccccgactggcctggaccctccagggagttcagcaagccggaaatgcgtgtctgctgctctcctggcccctgggccacctgcttctgtggccctgggattggggagccagggctgagggcctgtagggccccctgtctgtgcctctagaggccctgagccacctcctgcagtgttttagatcccataagcaagagacagaattgtgcatggatggtgagaaaacatgaagctttttatttgtaaacagaaaatggcagggctcactgtgtggggctggggacagcgctaggcctgctttaggccgtgcaccccaacctggggtgttccaccaagaggggtacagtggcctccactgtgagtatgtggccatcctctggctcctgattgctgagttcctgattgctgtctttgcgtaacttaggaaccccgatgaagagcccgtgctcatagctccgttcctgacatgttcaggaacgcctctgttgaggtttttctctttggttctggaattcctgggtccctttgacccctgatgcgtttgttttgggtgttgatgagcactggagctgcttccccacagggatggggcattggggagattccgacacagcagggccctcacccaggaggctgctgtgggtgctggagcggttgcttccatggagctgggattcctctcatttggggctgtaggaaggggtctttcctctctgtgctaacagttgtttgtttaaaaagaaaggctgtttaaacctttcaaacttaaaacttctttttttctttggagatggagtctcaccctgtctcctcccaggttcaagtgattgtcatgcctcagcctcctgaatagctgagattacaggcacatgctaccatgcccagctaatttttgtagttttagtagagacggtgatatggtttggctgtgtccccacccaaatctcaacttgaattgtatctccaagaatttccatgtgttgtgggagggacccaggggaggcaattgaatcatcgggctggtcttttctgtgctattctcgtgatagtgagtaagtctcatgcgatctgataggtttattaggggtttctgcttttgcttcctcctcattttttctcttgccgctgccatgtaaaaagtgcctttcaccacccgccatgattctgaggcttccccagccatgtggaactgtaagtccaattaaacctctttttgttcccagtttcgggtatatcttcttcagcagcgtgaaaatggagtgcacacacacgtcagcactgtgggcgcacacacctgcactcacacattcatcaggacccatgggcacacgtgcacacacacgtcagtcctgtgggtgcacacacctgcactcacacattcatcaggacccatgggcacacgtgcacacacgtcagcaccgtgagcgcacacacctgcactcacgcacacacctgcactcacgcactcaggaccgacggacatacgtgcacacacacatcagcaccgtgggcgcacacacctgcactcaacgcactcgtcaggacccacgggcagatgtacacacatgcaccagcacccgtggacacgtgcacgcacacatcagcacccatgggcatacatggatgcacacatcagtaccatgggcacacacacatgcacccactcccgatggcttcggcttgctgggtgcctgcttcgccctcgggtgagcaagtctggaggcaggcacttggggtggggccacagtatggttcttaggagcccagtgtcccctggacccacttgctcccagccttgggtcccaaagtgctgctcccactggtctctgtgccccacccatcatgggcagggctgtctgaacagggcagagtcacgagtgatgcaagggtggggtgtggaggccttgcctagaggcagcagccagctctggcttggctgggccttaccttcactgtcctgctgtgagacgcaggagccctgggggaggacggcagtctgtatcagggcagtggtgaaactgcagattcctaaatgtgatctggagacgactcttgctggagaaatctacccaggtcccttgggtctgtccctcccttcaccctccacagtcagggacaggctgcgtggtgtgcctccccatctgtgcgtggcctcagcgcagcaggcctgtcctgcccattgctaaaggtagagcccggcagattcattgtgtggtgagggcttccccagacccaccaactcctgtgtcttcccatggtgagaagggtggggtctctctggggcctttttttttttaggaagtcactgatgccactcaggtgggtgcccagctccccacctgatctctggagtggccccttctgctggaggctgccccaggctggatgccgtggcctgcagaccccccttcttgcagtccctgggcaggcagcacccatgcgcacacgtgcacacaggccgtgagcactgccctgtgagccaggtggtggtggggggtgttggggctaaggtttggttagggcccgagtgcttgcgcacccccccatccaatttcccatggtgctgggatgctgccgcctcctggaccctggcgttgaagtgccaccttcatctccctccccagacagtaagctccagacaagggcaggctgtggccgtcactctggccagctgctcgggggcttggtggctgctgggtggtcgcctggactctgccctcctgtctcctggtgtcccggaggggccttgctgggctgggccctccaccgccccattgggcgcctgactctcagggcgcagtcagttctttggggatggccctgatctctgagcgggactgcctctggcctttcttctgcatcccctacggaacagcagcctgctagacgccctgaggaggcaggctgaggggtggaaggggcgtggccgtgcccagcagagaccaccctctgatgacggtgggcgtcctttccagcccctctcggggcatcgcttcatcccttcccccatttccttcctggccctgctctccaagtcttgtgtgtgtggtggggcctggcttccctcccggcctctcgcctgttcccgcccatccctctctggttctctcaggcctcctctgggcttgccaggaatgtaggggaattagggggagggggacacaggaaatgcctcccctcctctgacaacagctccagctgcagggggaggggggaggggagagcagagtgggtgagacgagggagggctgaaggggggagtcggcttggggggagagtgttctcctgcccacccaggcactgggcgtggcccagccccacagacagaacagttctttcttccttattttattttttattagagacagggtctcactctgtcgcccaggctggagtgcagtcgtgtgattggcctcaagcgattctcccacctcagccttccaaagcactgggattacagcagtgagccagtgtgcccagcctcttcctaagtttacaccagtgtgggcatccagtgaggggaactggcctgtgatgcggtggtccttgtgacatgtcaggcagttttagagtagggtttgttaaaacatgggttaaattgggccccacccccagccctccactcctcagccattcaggagaagcgcgaggcatgggtgcgcgaaaattctgagtctgccttccacctgaaccccctctggaaggtctgaccacgggctgggtgtggtggctcatgcctgtaatcccagcacttttgggaggccgaggcgggtggctaatgaggtcaggagttaaagattagcctggctgatatggtgaaaccacgtatctactaaaaaaaaaaaaatacaaaaattagccggcattgtggcaggtgcctgtagtccccagctacttgggagggcgaggcaggagaatcgcttgaccccgggaggcggaggttgcagtgagctgagatggcaccactgcactccagcctgagtgacagagcaagcgtctgtctcaaaaaaaaaaaaagtctgaccacagccccttctcacaagggggctgccccttctaccctcgttggggaaggcctggtctgctgtaagtgcagtgaccggacattaaaataccccggaatggtcttggaaagagccacttctgggagtcttcccttacccgccacacaccttttaaagagaaacctgaagacacctgagaagacaggcggcggcggcgatcttcagagagaagatgcccgagaagacaggcggcggcggcgatcttcagagagaggacacccgagaagacaggcggcggcggcgatcttcagagagaggacgcccgagaagacaggcggcggcggcgatcttcagagagagagatgcccgagaagacaggcggtggcggagatcttcagagagaggacgcccgagaagacaggcggtggcggagatcttcagagagaggacgcccgagaagacaggcggcggcggcgatcttcagagagaggacgcccgagaagacaggcggcggcggcgatcttcagagagaggacgcccgagaagacaggcggcggcggcgatcttcagagagaggacgcccgagaagacaggcggcggcggcgatcttcagagagaggacgcccgagaagacaggcggcggcggcgatcttcagagagaggacgcccgagaagacaggcggcggcggcgatcttcagagagcggacgcccgagaagacaggcggcggcggagatcttcagagagaggatgcccgagaagacaggcggtggcggagatcttcagagagaggacgcccgagaggacaggcggtggcggagatcttcatagagaggacgcccgagaagacaggcggtggcggagatcttcagagagagagatgcccgagaagacaggcggtggcggagatcttcagagagaggacgcccgagaagacaggcggtggcggagatcttcagagagagagatgcccgagaagacaggcggtggcggagatcttcagagagaggacgcccgagaagacaggcggtggcggagatcttcagagagaggatgcccgagaagacaggcggtggcggagatcttcagagagaggacgcccgagaggacaggcggtggtggagatcttcagagagaggacgcccgagaggacaggcggtggtggagatcttcatagagaggacgcccgagaggacaggcggtggcggagatcttcagagagaggacgcccgagaagacaggcggtggcggagatcttcagagagaggatgcccgagaagacaggcggtggcggagatcttcagagagaggacgcccgagaggacaggcggtggtggagatcttcagagagaggacgcccgagaagacaggcggtggcggagatcttcagagagaggacgcccgagaagacaggcggtggcggagatcttcagagagaggacgcccgagaggacaggcggtggtggagatcttcagagagaggacgcccgagaagacaggcggtggcggagatcttcagagagaggacgcccgagaggacaggcggtggcggagatcttcagagagaggacgcctgagaagacaggcggtggcggagatcttcagagagaggacgcccgagaagacaggcggtggcggagatcttcagagagaggacgcccgagaagacaggcggtggcggagatcttcagagagaggacgcccgagaagacaggcggtggcggagatcttcagagagagagatgcccgagaagacaggcggtggcggagatcttcagagagaggacgcccgagaagacaggcggtggcggagatcttcagagagaggacgcctgagaagacaggcggtggcggagatcttcagagagaggacgcccgagaagacaggcggtggcggagatcttcagagagaggacgcctgagaagacaggcggtggcggagatcttcagagagaggacgcccgagaagacaggcggtggcggagatcttcagagagaggacgcccgagaagacaggcggtggcggagatcttcagagagaggatgcccgagaagacaggcggtggcggagatcttcagagagaggacgcctgagaagacaggcggtggtggagatcttcagagagaggacgcctgagaagacaggcagtggcggagatcttcagaaagaaagcccagagttccatagtgggcgggtgggcagtatttcggcttgtgtggcaccagggcagggcctccgaacccatggaaagccttgcttcccccaagcccgctggctcccagccctccaccctcatgatagggcctgggtaggggctgctggtcaccctttacccccacccaggaaaaggtcaggaggctgggctccccgtcaaggagcggtttccagggacaccggctctcgggggcgccagtcctgtccttggcgcccagcacatgctactagtgacattcgcaagggtgggtctggttctcagcctccgacctgtcaccccggtgtgggcccagtgacctcagtgagctcctcctgtgccctaagctgagccactgtgtacactgaagaggaggctggggtcctgtgtgcacctggcccgcttcccttgccggtgctgggagacgggagccagtctcggaccctcatctgccagcagctcctgtggctgtgggggcgcaggcatcttggctgactagggaggatcccgtgggaatgaccccacgccatggccagggaggcgcccccacccggcccaaccgcctttgtcggggatcctgagaggctttgtgcggaggctgggtcccaggctgggttccgagggtgccggtgcgcccctcctatgggtgaggctgtctgcttacagttgaacacttctccccacttctgcgccaggcctcactcagtctccccagcacggagctcttgttgctggcccagggcctgtccaggtcctttgacagggcaaggactcagagcctcaggggggggagggcagggcctcctgaggagtatgtctctgtgaaaatgggggtgaggaggtggcaagcatcgccttttgaggacagagtcttggagaggtgttggctttctagggagggccctgtgattctcctgcaaccatgtgggccggggccaggaccaaagccatcgtgctgtcgctgtggatttggtggccgcttcccctgctcagatgttgtactgcaggcctgggccttggcttggggtctctgtgtctccatgttcaggacaggcttgtggctttgggtaccacgaggggccatccagcccagggggcttcagggagctgcccctcaagtgcatgtggggtgctggggtgcagccctgctgcccatggcccggaagtccaggcagcactgctctggttcgaagctgccccaagggtacgggaggcccgtccactagaactgaggcctggcaccatgttgtgtcggttttcatggcgagaaaacatcgtgggcgtctgctggggctggaggaggcgggaggccgaggcagcaaagctgacccgctggcgggtgggggccactgtggcgtccccttcctgcaggaggcggggaggtgcttgtttccctccagagctgctgtctgcccgcagctagtgccctgttagcaggtgcagtgcccgtgccatcttctccccagacccagaccctccccaactcatggagaccctgtcctccgggccatcccccgtccatgaatgcccggggcttggggtccatctcctgtccacatggacctcccctcttgggtgtcacagctgcatcagaggccccagaggccggccctggggggctctggccccaacacagcgtcctccccgttccactggccggggctccctcaggttgctgccctgcctctagatccctgatccctggacccatgctgccgagacgtcctggtagggttgagttccctcctctcccaccccgaggcggcctgagaagagcctcttggaggttcaggtgacctggcctgggtcagcacagtagaggcggagctgccctcagacctcttttgtaacagttatctcatggaaacctaaaacctaattgggcaacggcagctccgtgtgaagtagagattgtctggaagagatttgtccctgttctgtggagcagggcagatgcagctgaggtgcctgggggggcagggacccttccccagtgggctcaccccagtggtgtgggggtggtagaattcaagctcacaccggcccagagggcccgctgtccgtgtggacctcctgtgactgcatgggcctcttgcggcggctccctcccgccccacaccggcctatgagccctccctggcccctgggtggctgggagggctccaggcagggaagagtcagggaggggtggatggccggcgtggctgtaagaatgacaggtggacacgggggcccaccttggcctgtgctgggggccccggtggctggagagtgagagtgggtgctctcactgagggtctgaccctgctccgcagtgcagtgtggaggtggttttggtgccacacacagcacaggtgcaccatgcgggcctttctgatgatcagaattcataagtggttttattttgtaaattaacaggacagaaaagcctttttgttcttgctaaagttttatgatttcgtgtttgggccaccagggtatctggaggctgggggcagtcgtggccagggtcagagtctgggttggagataggtgtcatgcggcagttggtgtggccgtgtggacttgtccccatctgtctagtaaatttccatctgccctgacgtcagctgcctttttgacatgcatttggaaggtgttaacaaatggacttagattcttccaggccggtcgcagtggctcacacctggaatcccagcactttgggaggccgaggcggctggatcacctgaggtcaggagttcaagaccagcatggccaacatggtgaaacccaatctctactgaaaatacaaaaaaattagctgagcgtggtggcgggtgcctgtaatcccagctactagggaggctgaggcaggagaattgcttgaacctgggaggcggaggttgcagtgagctgagatcgtgccactgcactccagcctgggtgacaaaagcaaaagtctgtctcaaaaacaaacaataaacaaacaactcttcctttgaaagttttgttttgttgtttttgttttttttttgagacggaatcttgctctgtcacccaggctggagtgcagtggcgtgatctcagctcactacaacctccgcctcccgggttcaggcagttctctgcctcagcctccctagtagctgggattacaggtgcccgccaccatgcccagccaatttttgtatttgtagcagagatgggggtttttaccatgttggccaggatggtctcgaacacctgacctcacatgatctgctcatctggacctcctaaagtgctgggattacaggcgtgagccaccgcaccagccagaaggtttttttttttttttttttttgaaacggagtctcgcactgttgcccaggctggagcacagtggcacgatctcggctcactgcaagctctgcctccccggttcacgccattctcctgcctcagcctcccgagtagctgggactacaggcacgcactgccacacccggctaatttttgtatttttagtagagatggggtttcaccacattggccaggctagtcttgaactcctgacctcgtcgtccacccaccttggcctcccaaagtgctgggattacaggcatgggccaccacgcccagcctactgttcatctttaccttgtgtaatgccagtttaagacgcaaatgcaggtcgggtgcagtggctcactcctgtcattccagtgctttggaaggacaaggtgggcagatcacttgagcccaggagaccagcctgggcaacatggagaaaccccatctctacaaaaatacaaaaattagctgggtgtggtagtgtgcctgtaggcccagctactctagaggctgagaggggaggatcacttgagcagcctgggaggcagagattgcagtgaactatgatgatgctaccgcactcagcctgggtgacagagtgagaccttgtctctttaaaaaatcataaaatgcaaatgtaagagtgtttaacttgtggaatcatcaaaattgcacagttcttgatttgaaccccaaatataataattaaagtgcgtgtgcattttattcttaccacatcagggcaaacgctgcccaaaatgaacctggctgttggagttcgcttaactcacccatgtggccacgcagctctcgctctgagtgaggacagactgcgtgtgggggctgtgggcgcctgtctccctccctcccaaggctccggtcgtgggctagtgggagaaagtgactgggtgggaccaacgcgacctcctccactggacgctctttacacgggctgggaatggcagtgggcttgcatgtggcgtgtgccacctctgctcatgcatgctctgtggtcacggagaactttgcttataaaagaacatcttatcaaaggtgaaactgttcagaatgccaatgatggggacagagcgttaagcccaggacatggctgcgtgcccacaaagccagctctggatggaaaagtaacgagtggagggcgttttcttcccagacccggtggtccagccgtgagtgtccagctgcaggccccacagcagccagctctgggcgaaaatctagagggcccctgcgcaccctcccgcccggggtgccctggcccagggtgcacctgtgctctggaccctgggccgtgcggggctccagggcgcctggagactgccattttgtgtgggaaggtggaggcgacttgggaatgcgtttctttagattttaaagatgagagagtgttggccttggacaggaaaaattccaatttggtgagaaatggaaatatccaattttttttttttttttgagactgagtctggctctgtcgcccaggctggagggcagtggcgcgatctcggctcactgcaagctccgcctcccgggttcacgccattctcctgcctcagcctcccgagtagctgggactacaggtgcccgccaccacgcccagctaattttttgtatttttagtagagacggggtttcactgtgttagccaggatggataatgtccaaatgttttatccaagtccaaatagcagtgttggtggtaggtgtgctctgcctgtgggtgggggtggtctctgtctcaaggtgggctacgagggtctgccgcagggggggtgtggacgggtcttgcatgcgtcaccttccctgtgtggggcgtgggggtggtctccccctagaaggacagggcttgtggcagccgtgagatggatggattcccagggatctcccctcaccttgggggatgagcccaggctcctttctggggtctccagtgtgtccccgatggaccagcttcctgcatggcaccgccctccggccccaccccgagccctgagccccgccttgagccctgggcgctcctggccctggcctggcactcaagggctgctttcagggctgtttctcgtctgtcttttttcttttctttcttttttttttttcttccttgagacggagtttcactcttgttgcccaggctggactgcaatggcacgatctcggctcaccccaacctccacctcccgggttcaagtgattctcctgcctcagcctcccaagtagctgggatcacaggcgtgtgccaccacgcctggctaatttttgtatttagtagagatggggtttctccacatgggccaggctggtctcgaacttctgacctcaggtgatccacccgcctcagcctcccaaatagctgggattacaggtgtgcaccaccattcccagctaatttttgtatttttagtagagacagggtttctccacatgggccaggctggtctctaactcctaacctcaggtgatctacctgacttggtctcccaaagtgctgagattacaggcatgagccactgtgcccagcagggctgtttacttaaaggtacatgttccgatccctgaattcggttttattttgaggttaggagtgagaacacgattggttgtcgtcgtttcctgtgggagtggctcttttcagaggcagacagttgtctttgctcgtgcgtgcacatttgtttgcatgcgcgtgagacccccaggtggttttgctctgggagtcgtgggatgtgttctctgctcccttcccttgtcctgagtggccttggttggccacagagtcagctggcagtggctgtctgtgggtcacctccacacatggatgaaactagcctgaggtgggctgttgttggcctgctggcatttttggggtcatggcagtgccctcaggctggtgatagtgggggtggggaccttgtctcaggtaccaagttcgtcttcatcctttgatcccctcttccaaaaactaccccctccccccgccacgtgtgtgaggcctgcagtggtgtgcacagaagccacccttgggcctgctgggtgacaggtcccctccaggtgacgggagctgcctcgctcttcctgcaggtccccggtgccgcctggttttcccgaatcgcatgcacctgtcactgagctgtcagtgtggtcagcttgctgcacccacccgggaagtggagctgggggaaggtcatgttctgcaggagacctggtggctcaggccctcaggacccagctgcccctccccgaggagcagtggttggtgagaaagcacacagaaggcagaggctagagatgcagctcctctgttatgttgagcctctctaggcagggagctcagagacccggaggtggccctcctgcctcctctctgtcaggacttgacacctgtctcagtggccatggctgtttgtcttcatccctcttcggtgagggtggcaggcggccagatgcccattacaggccacctctcctgccagccagtcttcgagggctggtcaccacgtggccactttgtgaggcccctcctctaagatcaaatgtggcactgcagagctacaccaaccccgagccccgcgcagggcagggcaggagaaccaagatcgtgggggtgggggggtgcagggcagggcaggagaaccaagatcggggtgggggtgcagggcagggcaggagaaccaagatcgtgggggtgggggggtgcagggcagggcaggagaaccaagatcgtgggggtgggggtgcagcacaggtcgtgctcccggggctggctgtagcggctctcccctcccccgagcccaccgtgtgcttcttgtccagccttttgagatgaccacagctctcagtttggccccacagcagcatctgggttgacgtccctgatgaggtttggaaacagcagagaaggggttgtcctcttccaccaagagcctggctggcctggcctccctctgggcagcacctggctgggctgactgggcagagggaaggggtggcctggccagggtgagcatggggtgcttgccactccacagagggggtgcaggaggcgcctccaggccacgttgctccaggacatgccacctccacagccccctccttggagtctttcctcaaggtcttaggatggctgtttgtgccctagcacagagacccttgccctcttgtgtggcgccgggggtccctgttggtcagggatgttcctagagtggggagggagtcggtaaggcaagggtgatgttggttgtaaggggtggagtccttggtcttaagagatcaggcagggcagccctgggctgcccccggcagagcctttgccccaggcaagtcccggggctcctgggaagaggctacttctcagcctcttgagagggcctccagggcacaggcagggagcagctgtgagggtgtggctgtgatggggactcttgactgcagtgtggatgtgagctgattgggggtaggccagccttctgtgcgggacacttgggaactgaggggacacagccgccaccctgcactgctcagcctgagcacctctctggctgtttggtgctgcacgtgtttctgggcatctgagatgaggccccagggcctttgcttccagacaccaggggagagagaccagccccagaacaacagttggcgggtgggctggggtcgtcagagcttctgacctcatcaggggctcccccagagttttctgtgcgctgccgtgtgtctgggccagcgctgggggcaagcgatgccttctgtggtttgaggtcttgtaggcaggaggaggaggaggaagagggcacctgctgagatacttcactggtctgagggccccttctgccccagctagcgcttgggtgagggttgggcttgcggagccgtcctgtaaagccggggatggcaggacgcattgtcaccccctcctgccgctcttacgaaacactcttaattgagtccgattcttggtgaatcagccttccaagaaccgcgaccgcagcatcctgtgccgcttctgtgttccgcatttttctctttctgcagcgtttcctctcattctggatggaaaggcctgtttgtctccctcaatctttggcgagggtggcaggcagccaggcggccattacgggccgcgcctcccaccagccagtcgctggcaggagcgtccggggagggagcagaccccgttcaccctcaccccagaactgaagcagcgaggggacccagacgagctgcgaatgcaggcgctggggatgctcatgccagcttgctgttcttgggagtctgtttattcttttaagctatttcagcatttaccttcagtagcatcggaggaaaagaacgatacattcgccccagtgtgtcccctgggggacctctggctaattttcggattccgaaagtgaggttttgcagggctgtgtggccactcctttgtggtcggccccagtgtcatcaggctggtttcaaatctggggtctgtggttcgaggctgagtgcagggctcaggctggatggggagggtgagaagagtggggccagacttcccggggtcagcacacacatctagggtcgtcatggagcccatggcagcactgcctggccattggcccctggtggacgcctcagaccgaggtcccaggagaaccccagcaaggttggggctgcagagggagccctccccgggacagcagctggaccagaacagaagctgggccctcccccaccccctcagtctctgcagcccccaccctccttccagcaccttcccccctggatggatgggtctttgtgttttgatgccccttggctctggcattgtgggggggccccctggggcatgaggaagagggccagtgccaaggccccgagggagcgctactaattgctactcagtttccttagaaagatttggctttttgtcatcaacagcgctaaagtaacagcaaagatgacctacttaagcgaaagaaaaatccgagtgaacctttaaagctggtattctcacttcattttggggcttggggttgtcttgcagattcaatctgtttcctctgtgccacaataatcagaaaataggttaatttaagcccaatatgaaaagtgaattatcatgtgtgaaatattaatggcacttacaaaaatagctttataatttcttgaaccgtgaaatcttcagagaaggcccatagctcacgtgagccgattcttgagtgagggtatttgggggtgcacctggaggagacagcgatggtctcagcagggtttgtctctagagtgcctcagcgcgagcttctgccagtccccggagaggagtccccacgcctccttgccctgctcagggctgcacgggagttgccacgtaggagagcacagcccaccttgggcttttggggttcgggcttttggagtttgtccaggctttggggtggggctttgcctgtagaagctctgagctgtgctgcatggtagggtgaccgcagtgggctgccctgggtgccccatgaaggactgagcagtggggtgacccttcatctagcagacgttcatcagggacctgctgtgggccaggctggggtcacactcagaactgactgcagccaggtggagaccccacctcgagagctcctccttcctagctgtgtagcccacaccccctggggagccgtagcagtgtgggggcagctctgatggaggggtgtgtacctggccacagctgtctctgggctgtggtcatcacccacaggtccttttcagatgcggtgcccacctgggtgtgtggacatgacccttgcctaagggagggagagaggaaggcctggtaccaggcagtgtcctctgcctgtgcccctgctggggaggacgtgagggcctgtggcttttaggaaccttgaggaggtgggggtggtcttctgacgccggcggggctcctgaaggtgcaggaaggcacagtttgtgcagagtccccttcggaggaagcaacgcctgtccctggcggggccgctgagccaaaggccgtgtctcagtggcaccctctcccagccgaggatgtcggcaccatttgggcccgtggacttcctccagtctctgggtggtggtgagtggggcctgctgttgtctagcagccactgttctgtggggcttcactcctgggcagggtgcacgggagagcaggggttggcaggaacccggcaaatttgtcaataaacctgaacctgaagtcccacaaggacggaggctcagtagggctcgggcctgagcggggcaggccagtgtgagctgggggttggggcaggccactgtgcggagcggggttctggccaccacagggcttttgttctgttgctttggttggcgatcgggactcaccatgttagacctgaggttcgtggtgggatccaccggcgtggccctgggtggctgccctgtgtgctcagggagcagtcacgggccctgagtggtgttgcccgtgggcctggaaggtccagccgagggttggggcctgcggatgtcgcttctctgaagatgagaagccagggcgaggcccccccccaacatctggaaggttctcctgcgtcgccctctccttccaggcacatttggccgtccccttttctgcgtgtctgtccccaccatcgtgccctcttcttctctggactgcgtttggatgatttctttgaacggtttttattctggaaagttctgctcgagcatctggtatctccctggtgtttgggatgtctccttctcattcccccgtgtcttgctttaagctgcgtgtcctcgtgtttccgctgcccctgttcttgggcactgcgttgtgttctgtctgggatccccgtgcaaggcccctgggtctggtggctgctgcccggcctctgggaccgtctacctgtcccagcccccgtttccccgcttcttcagctggcaccttgaaactccgtgccaggtgagcaggcctgtggctgcaggttcccggaatctgtcgtgggttctgggttgtcccttccagtgcaggcggtggtcaccgcgccaccatgggggtccaggcagcaggatggtcatgtgatgggggccactctgggcttttcattctcctttcatctgtggcctcggaggctccccatgttttctgaggtgcacagaacatggaggggtgctcatctcatgtcagatattggaaggatgtcgtgcaggaaggttcgagggtctcggggtggtcctgagaagccgatgtgataggtgcggcagcttcctcttcccctgagcgggggcttccagagcctccctcccactggtgcccatggggtttgagcctgatagctccgcaggattcagctgctgtgagtcacagccaggatggagaggtctaaggcaggcctgatgccgggcagggcgacatttctagaaaaggtttcatctggtgatctgctaaatggcatgaaaatcacaaaattggcactcagtgaccatcaggctggctgtgtgtggctgctctcctcaacaagcaaatggctgcccccatccagagccccgactcccgctggcctcccccgtgcggggatgtggggaccagggcaggccccagagaccacctgacctctctggcaggaagaagaccacgtcgtgccgtttcctcctcccttgagcccgttagctgtctcggggaaccggtaagcccagggccaccttgtcacgtcctccactgaacgtgggtccacgtagatgccagccccttggtcttgcccagaagttgtgggaggtgctggttgccagggatggctatgcatgtttgtccccatggcagggaggcctctgggggcctggccctccccccgctagctgcttctcacatttttgtctccccgagagccacctgctctcccagggccctcaggcccccgtctgccagtctcctggcacctgggctggggtctgcgccaggcaactcccacagcagggcaggatccaccctccacgttatcattactgccatcccctgtgcctgggttggaggccacgcccacccagtggggcccctctggaaaggagacttgacctcagggtggtggcagggctctgtgggatgcccctggtgacagggaccagaatgttccctaaagtggatgtcaggcccctggctcagatggagctttctgttcttgatgggctttagaaggtgaaaaactaggcttccagaggtgaagttgcactgtgggctttgtggcaggtgagcgctgcctgaccctgaacagctgctaaagactcagacctggagccttcctggtgtcctgtgtgtccacgcaggtgtgccagtgtggcagccctgcgccaggagctgcccctgcatgtcatggcagcatccatgccagccgagcgcccctctggctcccaggcatctcatcctgtctggctctgagggccgtgctgcagtgaaaaccattcaccttgacagtttggctttcgaccaagaattcactgtcatatttttgatttttaaaattaagactgtattcagatataatttgcgtaccataaaattcttccttccacagaatatggtttaatggtttttcagtatatgcagccatcatcatctaagttgagaacatttttgtcacccccaacaagaagccccatgcacatggtccgtcactccccaggccccaaatcccagccagcactgatcttggccattggcctgtcctggtcattccatagaagtagagccacgtgactgtgtgtgtgtctgggccacgcgtggctgtgtgtatgagagccatgcgtgactgtgtccgggtcacacgtgactgtgtgtccgggccacgtgtggctatgtgtccaggccacgtgtgactgtgtgtgtccggcctcagcacagtattttcaaggctccttccttccttttcatgactgaatcatactccattgtctgcacagaccacaatctatcccgtcatttgtctctggatgcttgggtggctgcactttgctgctgtgagcacttgtgcacaagctgtcgtgtggatgtgtgttttcagtaacctgcgtgtacgccgaggactggaattgctgggcgatgtaactgtgttaagcttccgaggacctgccagactgttttccacagcagctaaataattgtacgttcctcttagcaatgcataggggttcctgtgtctccatgtcatcaccaacacttgtccaaactaaaaaattctaggccaggcgctcatgcctgtagtcccagcaatttgggaggccaaggtgggcagattgcatgagttcaggagttcaggaccagccagggcaacaaagtgaaaccttgtctctaggaaaaaaaacaaaaaaaaaaaaacaaaaaattagctgggcatggtggcacatgcttgtagtcccagctactcaggaggctgaggtaggaggattgcttgagccctgggtggttgaggctgcagtgagctgagatcgtgccactacactccagcctgggtgacagagcaagactccgtctcaaaaacaaacaaacccagttctagccatcgttgtgggcgtgagttgacgtctccctgcggtgtgattgcgtttccacagtgaatgatgtcaggcagctttgcatgcggttactggatgttagtatcctgtttggagaaatggctactcgaattctctcccatttggaaattgggttgtgttttgtgttttccttgctgacttgcagagttcttcatgtgttctgaatctggtcccttaccagctaccgggtttgcacgttttcccttgcatcctgtgggctgtcttttccctttctcgatggtgtcctttgaagcacaaagacgtcgtgattgttttctgggaagccttgttgttgtgttttctctctgttccttgtgctttggtgtcatggaagcacttctgcgggggcgggagtctggactgaggccgccacgttcctgctgtgaaaaccttcacgtgcgctcgcagcctcggctctacagacggttcagtccgggaaatggtttaaggaggccgtgcacagaaacagtctttgcagccagggacatgagagcataccgtgctgttcccacaaggcccgtggcctctgcaggtgagaattggtggcctcccttgaaaatactgaatggaggtgccaggcacccgcacaggctcttggtgtgggcataggccgtcttccacttgaagaatgtggcaagatggtctgaaaaccacaaagtttgtgtttggagacacggtctcagtgtgttgctcaggctggagtgtagtggtgggatcatacctcactgcagcctcgaccttttgaggtccagtgatcctcccacctcagcctcccaaggagctggcattacaggcataagccaccacgccgggcccacggctgaagtttgggttgtatccttttaaggaatagcagacgggttttcagccacaccgaagagaacctcagcgtagcagagtgttgctgggccatgtgcttcaggagcagggccacaggcaggacctcgagtgcccagcccgctcaccacgctgtgggcggcctcttgggaatgtcagaacaccagcacaggcgatctcctcggaacccagattgtgggcgatcctgccgctccacctgctgtggccccagggttgcaccaccatgtggactgtggctggcagcttctggaggcttcttggtgcctacaacatctgcgccactccacagcgttgcctattggtggcagccatcccctccataagcccgtggcccctgtacagagacgaattggcgctcacggactcaccctgcgaggcagcatctgcgtctgcaggacttcccggcccttggccgcacatttccctccagttcccatcatggcagctgtgcctggttgcggatgctgcatgctgaggagaggaggcgtgggcccgcccggtgtgcatgggcaggtctgagactggccactcccatggcgcatgcattcccctggagggtccccttgccccgtggctgcagcctggcaggagaagacgctgaggggacgcacgggaggggttgcagggtgggctgtgctgtgtggcaggccttggggtgtagccgcaagctgtgggtccatccccccgcaccagagtgcagttttgacaccgggtggtcatgggccgagcatccatgcaggtgtggagacggaagcctgacccacagagcttggtggtggcccctggactgacctgtgggctgctcaaccgctctgccactgtgcgttgttcacatgtgaagccggcgtcacaaaggcctcaatgtctgtttcagctggatacatgcgcgccctcgtgggggcttgagggcacactggccgctggacactggggtcccggggtgactgaggctggtgccctcctgacaggttgctgggctgcaagttgaacagaaaactggttttcttcactctgcgaagttccctgtggttgtccctggggttggagggagttgtgttgacatcatcatggctgctgctgtgcgcctctcccttggagcaggtgtggtccccggctcctggattggctgcccatgctcaggatggtctggggtgtggccgtggcctgtccccgggccggatggctttctcagcagctccctgaggcagcatgagcagaggcgggaccctgcccgggtcctgtttcccccttgtatcctttggccctaatacggggtcccgtttaccaatgagggcaaagagaccagtctaaggggaggctgaaaactcacaggcaggcctgtctggccttggggtctgggtgctgcttccaggcagaccacatcccaggtgaggtgcagacattcagagacagacgtggccgatcctggctgctgtatcaacgcgcccaccaaatggggccttctttgatcatcagtcaaaagcaagaatgtgcctgtggtgggcgggcgcgtgtgccagcttccaggccgtgggctccttggtgcccagagctcaccctgtggtgcttgcccactactcactcccgcctccccggagtcttgccctggggggtcctggtgtgggagctgccttctctagttgggtggagccttgcctgctggtgcctgtgagccctgggtgggtggatgccgggtggtcgtggaggttcacagcaggctctatgtggttgttttgtgtggatttggggtgtgaattctctcagcaaaggctgactcagaccccagtgttcagaaggttcaaggaagcgaccgtcagcgccgagtggccagcagggcggggatgcggcgttgagccccgtcattcagcttcagtgtggagaaggcccggagctgtgggcatcagctcggggacccgagtgactgtccctgcctcggggagggggggggccacacgggcaggcggggcagcagcttgtgcccatgtcctcctcacggactctggaagtgagaggcgctgaggccacagtgggggaagtggcccagctgacgacccgggctctcggtgccctgggaggagctgttgttaggacatgtgcagactgggttcagcctgtctggagtggctcaggtgcctggggacagaggccagctgtaaccgctgctgcactcggttctggattcagtgccctccgcctctgcggcgtctccctcggcagctgtccaggactccagcctccctgccagggtaggggacatggagcgtctccttgctctggggggttgaggtcttctgtgtttggaccctgtgggatctggcaggagaagcagcccccactcatgttgtgccaggggcctggggaagggagatggcagttctgtgacctccagactccctttccttattgcaggggatgggccagcgtttcgccctgagcatctgcacgtgtcaggcaggaaagggtccccaaggccttctcaatggctcttctctgttcctggcaccttacaggcctgaaacgcagggcccccaagggtggggtgtgcatttttggagagcgtcttttctgagactcccccatggggagctggtggcttgcttgtggcagtgtactgtggctgcccagtcctcggcaggcatccactgctggctcacctgtttgggccaccgcctctgcataggtcctgtgggctttgctcaggaactgttccgtcagagggcctagggtgtccacagtcttgggcccgctattcctcagcccagccctgccctgccctggcaggggggcacctgtccttgggtgcaagctcacacgcgttgcccgggtgcctgctggccaggtagcttgcctggtcatcctcggggtgtggggaaggaccccaggaggggaagtggccgcggggcagcgcggtgtgtcgtctggcctccgctgtgtaagctgacagtggcctgaagggctttgggatggggcagccccttgcaggcctatccaggcccagccccattgctttggtgtgtcaggtccagagccgtgctcctgcctcgtggcctgtgggctccaagggcgggttttgaagccccaggaagggtcacaccagaggcaagcggtcgtagctgctcttcccagagtaagactcagccgtctgtcactgggtgtggttttgtccctgaccgacagctgacactggggcccccaggggccttggtagggcgggtggcatcccaggcctgaagacggctgtctgcttcctggggctttgagaaaccaatactgctcaggtgacagtccctctgagagtgtcacttcctccgcccacaggggcgcagacaccttctattttacacgtttctctccgtttctctgatgctgcagagagcccgccctgagagccgggagtcgcctgatgaggggtcggcaggggtcttaacggagtcatgtctccgaaggctcgtcctggctccctgaagaccaggagcgtccctggccccaaggatggccctgagcccatctgcctcaaccctccagatctgcagggtcctcggccaccccccactgagcggattgggctcggggccccgggcctacggtcctcccgccacctccacggggcggctgttggggccccaccaggcagagccgtgttctcaggcgttggctctcatggaggtggcctgaggcatctgactctttcccctcaaggagtctctgagtctcccggagtcagcgccggctgttgtggcttttccccgggtgataactgagccgaatttccgcgcccgcttcagtggctgcttagacaggaagctccacccagccgggcgtcctcggccttctgtgcctctcgggagggtccgcatgattccggaaggggctctgctgcagctaggatggcacccgcccctgccaggcataggcacagcaccctgcggtcagggcctccgccagacgtcatcaacactcacttcccctcgaaagccgccacatagagggggtattttcagtgtcttttttcctgaacagctattttagtgtctctgaaaaaaaccatccacagccgtgagccttcaggggctgcctgccctgcgtccccggccctgtgcgcccgagcacttatctttctcccttgggcccaggtcagagccaggcacctgcccctcccctggccccaccctgcttgttccctgagggctgcagggtgggtgcacgtgctgcaggggaggccacgggctttggccagatcttcccccagggccctccatccccataattggagcaccttgatggacagcctgccctgcgccccatcttccccctagggaagcagggtccctgctgcctccaggaggctggttcctgatgcagcgtcttctcctagagtcctggaggtgggaagagcccccggccctgagtgtgctctgtccaccaaggcttcctggctgagggcaagggcggagcccccaccgcccgactttgctgcctcctcttgaggttggcctcggcagagtgagtgggacctcacccctgtgaagggccccttgccctgtgtggcctgttctgcattggcctgtggtgtagacctggtgccagctgccctggagactctgtgctgtcctgtggggtctttggcagtagaggaatggcccattttacggagactgccctgtgattttgcttgggaagagaccttgggtctcagttgtgccttgcgggcagcaccgtctcaggggtttccagccgcagggctgtgggagttcacgtttgcctgaggctggatgtaccggctcaggcccccagcacacaacccacatcactcactggctcttgggggatgtgcctcagcacctgacacacaacacctggttctgagtgggctgggtccaggcaccttcgctaagcttcctccaccagcgggacctggttctgggtgggctgggtctgggcaccttcgctaagcttcctccagcaccggggctggcaaggagcgaggcaaaggtgtgtgtggtgccatcctgtaggagccaggctccttggggatggtgtccttcattttgaaaatgtttccttcccatggggagggggcagccagaatgcccactctttaatgcacctgtgccagtggcccacagggacacggtgtcccctccccgcgaccacccctgtgccgcagctgcccttcccagacgcatccgtcgtgagtggctctcgccgtgctgtggctggttgagctgagtgcccagcgctgggcaccctctgaggacacactcgggttctaggaaaggggtttggcaggagaaggacgagggactcctggccaggctgagccgctgtggaaggggagagtgggtcttggtgctccatcccaaacctgctgcagccgtgggtgaggtcacccggaatggcaggacaaggtccactctgttctctcggagatgacttgtccctcagcacagcctccacgtgcctgttgcgcgtggcctaagggcctttatgcaaagtgaacttggtctcctggggggtgccctggaatctgccttctgcgccactcagggtcgtttgtggccggagtgcatggggctctgactgccatgtgccagccacggggctggtggagggaccctgccctgggaaccacaggtgccaacaaaacctttcattgatcgcaggtctcctctgagcctccggcctccataagacccaaaacagatgacacctcttcccagtcccccgcgccttccgaaaaggacaagccgtccagctggctgcggaccttggccggctcttccaataaggtgctgtggggcctgtcggggtccttggggtggtgggtactgggcccttctccttgggcagacccagcggctggcagctccacctgcccgctactgagggctggcacccggcgcagcctcagggacatgaagtggcttgtttttctcctggtcactcacacagacaactctttctcgacagagcctgggctgtgttcaccctcgccagcgcctctctgctttccgaccctggtcccccgcagtgtcagcgagtgagaaagagctctccccacacctcccggccctcatccgagacaggtgagtgggcgccattcacaggtgtttctgatcacgggggaggctccacgagggctgtgcatgcggacgcgcccatgtttctgcaggctgggtgcccagacctgccgccttttggtcagggcagtctcggtgttggttcctttggctggcatcagggagagcacacctagagcgttccctgtgttctgggtggagtcgtgggtggagccctgtctgctgggcgcagcttcttgatgtgttggcctgtgtctggccttcgcaagagacccagcaagcagaaaacgcttacgggttcttagggaactgtaagcttgacttgaagattcggagctgggaaagtctttcctgtttaacaccttcagagggggtgtgcgccaggatgtgtctgggtggtgcttggggacagaggcaccttcccgacacccgcctgcccctccagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaatgtacgtgtgagtcgctttctgtgcctcctccctgtgggctgtgggggtggcactggctgaggggggctggtcgccgggggtgcgttggtggccccatgtttcgcaggttcctccgggagcggcgcgtctccctggtgtggagctgccgggcacttccatgactttgtttctgtctctgcttcctcctcagtcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggtgagcggggcgagtggtgctgggaggtccagggcacgggcagtgagcacagcctgcaccaggtgaacgggcacaggtggtgcctcctcccttcctggctgccccatgcgctcctctctgcctccacctcagtgggcctgcctgggaccttgggggtccgtctcccaaaagctgcagccctgggtatggtgagcccctcagtgtccccaggctgatggacatcccaggaggccactacatttggcttgaccacagctttccccatcaggatcacacaccctgcgtggtggccccactgaggaagtagccatgtttctctggtataagggaggccgggctatttttagtggcagaaagagttgggagcagctgcatggagacagttccttgctctgtgtgctccaggagtgggtgttcacgcgctccgccagcaagacctggcgtctgcaaaacacaggcgtgaggggcgtgcttactaatgcctggtgttccagaaggcggctcccgccaggcctcccgagtaggaaggagagggctcggcccgcacagacacacacacacccacctgcacacgctgcttctctgggctctgcctcacggttctcacgctgcagctccggtctcgcgcctccttttacgttgtttaggtttctttctgacatgactgagggaagtgcggttcacaggcagagctgcctggggagagaggtgtgcaggcggcccgttgttcaccgggccccggcctcgctaaattcacacctcggcggcgtctggcagcttccgcggcgtgggctttagcacaacacaaccccgtcggccctcagagctgcagggttgccgacgtgccctcctgcgcgtgccagtccctcgccccagcacgtcccccgccactgttgtccttgattctggttggaggtgtgatttcccacatacatattcatgtggtgtgtttgcagcgtggggtgtgagtcacacggatattttaatggggagagtgggggggcttgcggaggcgccgggcggatggacgtgtccatctggctgcgtggggagacccggggccctcagatggtgcgatgtctgaggctgccctcctcacattgatgggagccagggcctacttggcttgctgcccccaaggggaacgtggccctagataccgggggaggccccgccgcagcctcaagtgactgactcaggcccccaggtttagcacagctgccacaggcctggcggaaactccggatgggggtctgaaaagcctttgtggggtcggggcaccacacgggttgggctgatggcgcgctgggggcggggctccagggcacattgtcagatagatgaccccacggggtgggctgaggactgctggtcatggtgaggggtgtgctgggaccggctgggcagtgaccccgagccgcctccggcccccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccaggtatgcgggtggggagactgaggcacgcagcacggtgggcgtggagccgccgtgggccccggtggccagtcctgcccagccggaaaggccttggagcagaagccaggcccgggaccacgttccgtgcgtgcccccccgacgggcacagggtgggtggttgctgggccctgcgtctcgtgagcctgtgtcctagcaggtggaggaggggccggcacgcggcactggggagggacagggagcggcgcaggagcctcgggtgggggaagcagcgtcgggccggggcagggcagcgagcaggcgccgctgaccactcggctccctttcagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaagggtcggttttgttatgcaacatgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaaaatgctttcctgccggggggcaggggagacggagaaacccatgtgcgtttcccatgtgaccccctcctccctgtgggtctgagccccggccccccccacctcctcctccctgtgggtccgaaccccggcccccccaccccctcctccctgtgggtccgaaccccggcccccccaccccctcctccctgtgggtccgatccccggccccccccaccccctcctccctgtgggtccgaaccccggccccccccccaccccctcctccctgtgggtccgaaccccggcccccccacccctccctcagcccaccagggtccagggagatgttcgttctcgctttaagtcaggagtcacaaatgacttttttttttcaattaaggaaaaagctccatctctacctttaacatcacccagacccccgcccctgcccgtgccccacgctgctgctaacgacagtatgatgcttactctgctactcggaaactatttttatgtaattaatgtatgctttcttgtttataaatgcctgatttaaaaagaaaagagcttggcatatttatctatttcgctgtgtacctgttagtccttccccgaccccgaaacagatgacattgtacaataaaggactttgagagga

SEQ ID NO: 129 - DNA, 39165 bp, Homo sapiens
gatgtgtgtggggttcggagccgcgccggcacagccgaagggagcgggcgagcggcgacggcggcggcggcgggcacaggtgcggctccggcttacggcggcgacgcggcggaggcggcgggaggccagaggcgctcaccctcctaggagcccgacggcggcgacaggggcggtggggaattcacaaagctcgtcgagcttacccgggcaccgaggcccgagtagggggtttggatgcgcgggtcccgggtggggtcggggccagagggggtcgctaggcgggtgttccacggctgatcacgcttcgttggccccaggcggtgggcgccggcagggcagggcgctgtagttgacgggagccgcggggaccccggagacccggacgcccgtcaccgcccccctcccccagtccagcagcgctccgcggggatgccctggtctcgacccggtccgtcagcccccggcggcgcagggatccgcgcccggcgcctaaactgccctggtgtcctcttcgttctggcccggggctggcgcggggaggtgcagcattaggggcgctgaggtgacacccgagaacttcccagggagagggtgcgcgggggggtggatttccacagtccttcccgcggcccccgcgggggggcggtgttgggagggcacttggggttatcccaggctcgccggtgggggtggggggactcctccctttacttccctccacccccttgcacacccacccccaggcttcccgtgtcccttgttctccctctctccgggttagagataggtgggtggctttgagtgggcggaggacttcagggttttaggggctcccccattctaggtcatgcctcttgctctcttccttggcctgtgttgagtaaggtgtgttcctgtggtggacgaaagtctgtacgatggttggtggcattggtccttaatcctttgggtctgttttaaggtaaagtgctgagagtttgggaagcaaaaatttctatttattggatttcttttggcttttctctcaagaaggaagtggaaaaagagtcttttctttttccctcttcctccatttgcattctttgtgaggtttgtctgccttgtgctttttgtcccggattagtcttgttgaaggatggagattcccaggcgtggagtctatagcttttggcttccattaagtaaaatcgctaacctttttttaagagaaagttaatttttgcctgcagtcattccagaaaaatagtgtacacggactagctgaattaatccacttaaaattgtaacttagttacatatggtagatatgttaactcctatctgatttttttggatgaaactgttgttttgtttttaaataggagatgaagtaatggatttttttccctcccttaaaatggcatagctgagaaagccccggtactactaattgagatgatctgcttaagagtcttcatattctgaactcgaaaggccttttatgttatattattgctcgctttacgcaactccaaattgctttcctatttaaatgaatgttcttctagtaaactggtgttagatttaaagaaatcactcaagcttcaccttggtaaactgaactcagtttaagattaagaaactgatttcggccgggtgcggtggctcacgcctgtaattccagcactttgggaggcccgggcgggcggatcacctgaggtcaggagttcaagaccagcctgactaatatggtgaaaccccgtttctactaaaaatacaaaaaaattagccgggtgtcgtggcttgtgcctgtagtcccagctactccggagtctgagacaggaaaattgcttgaacccgggaggcggaggttgcagtatgccgagatcgctgcacttcagcctgggcgacagagcgagactccgtaaaaaaaagaaaaaaaaaaaaataaaagaaactggtttcaaattggccctttggcctctggagcaaattcaaatgtaactcttccccaaccccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaaggcaagttttttatatcaatttttaataatggtaatggtttactttgaaatgaaaattctatgtttagtgtgtaacttaacctgtatgttgaacattgctcatgcaacaacaacaaaataccgattgatatatttgtattgcagtttttaggccataaagtgctttgcagtatgtttcctcatttgactttccaaacatcctgtgagagaagtaagactattattccgttttacagataaagtgaatgaagctcagagagataaaatgactttcccaaaattatgtagccagggagtggaggagttagggcttcttttttttttttttttgtgcttttagtagaggccaggtttcagcatgttggccaggctggtcttgaactcctgaccgcgtgatccgcccaccttggcctcccaaagggctgggattacatccttgagcccctgtgtccagccagggcttctttttcttatcctctttggcacacatcttgcttcttgaccactacatctgttgtttttctaggactcgataatttgcgctttggtgttatctccatttgcaaatggtacaatggccacaattcccgtgggctcaaaacagcatttttcagagatacacctatgatttctgatgtttctatgtttggatattcaggcttgctcaatatttgaaacaaatggaaaagacatgtatctgaagaatttgtgatttgaaaggaataacaaaaaaaatgacagctagagtaaggaaaagttattttaaactaataaaatattaatataaaaacctgccgggctcagtggctcacacctgtaatcccaacactttggggggctgaagtaggtggatcacctgaggtcaggagtttgagaccagcctggccaacatggtgaaatcccatctctactaaaaatacaaaaattagacggatgtggtgtcgcacacttgtaatcccagctactcaggagctgaggcaggagaatcgcttgaaccccggaggcggaggttgtagtgagccgagattgtgccattgcgctccagcgtaggcgtcgagggaaactccatcaaaaaacaaaacaaaacaaacaaacaacctatcaacaggtgggagcaatgaatggctcacaatcccagcactttgggaggcccaggtgggcagatcacttcaggtcaggagtttgagaccagcctggccaacatggtaaaaccccatctctactaaaaatacaaaaattagccaggcatggtggtgtgtgtttgtagtcccagctacttgggaggctgagccaggagaatcgcttgaacctgggaagcggaggttgcagtaagccgagatcacgccaccacagtccatcctgggcgtcagagtaagactccatttcaaaaaaaaaaaacacaaccacctatcagccaaggtatcataattttatttttcctgctgcattatctagtaggctaaactattattttcattccaaggttttgaatgccgaggtaatggacaagattgggattattaaatatttagtttcttgatcgggttgttttatattttttcctatttgactaaaattaatgtgtaataacagttcctaacactaagtgtttaaaatgtggcaaacattattcttgagcagttttacatatataattttatttaattcttaacaagaggttggctgtgtttcatttaggaactttgaatttttccactattagttttgattccttgaaatatccttgcccatttctattttacagaagaaatgaataaagcatattaaatgactgactgaaggtttattcacagcaaagttagagcttggactagtccttaagacttgggatcctgagctttattctggtgcctttaaggttttgagggaaatttagttaacagtgtagtttaagacattggttaagcctaatgaagataataattttagactcatttatggtagtttgctgcttgctgcttccagaagaccagcactttgaaatttcttgccagtggctgctagataagtttatattcttcaggtgtagttattaactgatttttttttttttgagacagagtttcgctcctgttgcccaggctagagctcagtggcgcgatcttggcagattgcagcctccgcctcctgggttcaagtgattctcctgcctcagcctcctgagtcactgggattacaggcatcagccaccacaccctttaatttttgttatttttagcagagactggtttcgccatgttagctaggctggtctcaaactcctgacctcgggtgatccacccgccttggcttctcaaagtgctgggattacaggtgtgagccactgctctcggcctattaactaattttaaatcaggattgacttcaagccagtgctcagtgtagaacttgcttacagttggacttgtcccgtgctgaagtttgtgctcagagattatatttcaaaatgtggaatgccccttttgatatttgtgatatcttgcccccaagctaattaggtgctgtacttttttttttgtagagacaagtcttgctctgtcgccgaggctggagtgcagtggcacgatctcggctcactgcaacctctgcctcctgggttcaagcaattctcctgcctcagtcttccgagtagctgggacttcaggcgcccaccgccatgcccagctaatttcttttgtattttagtagagagggggtttcaccatgttgcccaggctggcctcgaactcctgagctcaggcaatgcgcctgtctctgcctcccaaaatgctaggattacaggcgtgagccaccatgcccagtggtggtctactcttacatgtctgttggaggccacatttgccagatattgttgctcccgtctttttttttttttttttttttttttttttgagacagagtttcgctcttattgcccaggctggagtacaatggcgcgatctcagttcactgcaatctccacctcccagattcaagtgattctcctgtctcagcctcccaagtagccggggttacaggtgcccaccaccatgcctagcttgttttttgtatttttagtagagatgggattttacagcctagccggctggtcttaactcctgacctgaggtgatccgacctcctcgtcctctcaattgctgggattacaggcatgagccatggcgcctggcccgccccagtctaattattagtctgacataagtgtattttggataaactacttttcctaatattcttgctctgtgtttatgtgaaaaacatctgagaaccatgataaaggtttaaaaaaaaaaagatgatggattaatttacttaactgaaacaatgtgctgaggtttggttaacactgaaaccatccttcgtctgggatgtaatccctttttgtcccagaattcactgatttgaatacattttcgattttaggaaggtgtgagtttctttctgatctttttgctgtgttatattttgcagtatttgaattagtgtttgtggtgtattttgatattgcttgtaattttatgtgaatttgagaaatttaaaggaatttaagaaaatttcaaacacccatactttaagaaagattcttttctttggttcatatttaatacgtacttgagtggttgttttattatgcttaccacttcacgttttaaaaacgtactcagaacattgtgaagtacacttattttttagggtctgtgaggaaggtgaatgacaatatttccacctcttagatgagtcacatgctcctggttgtataaccagaatcaggagttgaatacagggcttctaactcgaagtttagtaatttttcactatttgcccctgaagcacatgttagtagcagaaactgaattttgagaaacattaacttttcttatcaatttaccttagtacaggttgagcatcccaaatccaaaatctgaaatgctctaaaggccaaaactttttgaatgctgacatggcactcacaggaaatgctcattggagtatttcagattttgatttttggatttgggatgctcaactgccatatcgtgcacatattccagaatctgaaaaaatcagaaattcaaaatacttttggtcccaagcatttctgataagggatattcagcctctatgatggttctcaaactctgttttaacctgcatataaatttaaatactaaggtatttaactgagaatgagatagtccttgactgaggaacagtttttattttcttctgtgagtcattgagttggttgccaaacaagccaaattgacccagagggagctcattttaaaaagtcaaactaggctttttttttttttttttttttgagatggagtttcgctcttgcgcccaggctggagtgcaatggcgcgatcttggctcactgcaacctccgcctcctggattcaagcgattctcctgcctcagcctcccaagtagctgcaattacaggcgtctgccaccatacccagctaatttttttatttttagtccagacggggtttcaccatgctggccaggctgatcttgaactcctgacctcagatgatccacctgcctcggcctcccaaagtgctgggattacaggcatgagccattgcgcctggccttttttttttttttttttaagactgtactaaatatattaacgtgttatgtaaaggacctgatgtttggtgtgaatactgacatgatttgacatgcgtatatagtttatgtaatcaaagtattgcttttggattaaaaaaagtcctgaaactcagtaagttgttcgaaatgaaacaacttaattattttacaattataaaatatgtaatatattaatacattttaatgttaataagttgtagtatcttgtaaattataaataatttgaaatgagacaacttaattaaatatagctaataactctttcttactcaagtcgccataagaaatatacttgattttaggccaggcgcggtggctcatgcctgtaatcccagcactttgggaggctgagttgggtggatcacctgaggtcaggggttcgggaccagcctggccaatatggtgaaacgccatctctactgaaaatacaaaagttagcaggggatggtgacacacgcctgtaatcccagctacttgggaggctgaggcaggcttgaacccaggaggtggaggtttcagtgagccgagttcacactgcccttcatcctgggtgacagagtgaaactctgtctcaaaacacacacacacacacacacacagacacacacacacacacacatacttgattttagatctgcctatgttgttctacagaatgttgtcaagttacttacctgatacgagctttttgtgttttttattggaataatcattattttactttaaactgtataaatacatgcaaacatcacattcctgattctttttcacatcttcagtggatattcagcaaaatcagaagtagatcaaatatatgtaaacaaaaatagaaaattaaaataaatttgatctaattctaattttgttgaatattacgtttgtatgaaaaaaagatcaacaggcaaattaatcatttgtaaataaaatttgaagagtaatgtttacttaagattattttcaaacatattggaagtggtcatttgttgtaggtgattcttcactttttttgtttgtttgtttgttttttttgagacgagagtctcgctctgttgaccaggctggagtgcagtggcgcgatgtcagctcactgcaaactccacctcccaggttcacgccattctcctgcctcagccccctgagtagctgggactacaggtacccatcaccacgcctggctaattttttctatttttttagtagagacggggtttcaccgtgttagccaggatggtctcgatctcctgacgtcgtcatcctcccaaagtgctaggattacaggcgtgagccactgcgcctggccgattcttccctattgtagcatgtggctgacagtctccactttactaagttaagaactatatataccctttttttttttttttaaattgagatggagtttcgcccttgttgcccaggctggagtgcaatggcgcaatcttggctcactgcaacttccgcctcccaggttcaagcaattctcctgcctcagtgtccctagtagctgggattacaggtgcctgccaccacacccagctaattttttgtatttttagtagagatgggggtttcactatgttggccaggctggtctcgaactcctgatctcaggcaatccaccagcctcagtctcccaaagtgctgggattacaggcgtgagccaccgtgcctggctaaaatttaaacttttaacatttagactggactactcttaggtaagtaaaatattttagtttttaatctacttaggggggaaaaatctctatagattacttatgatacaaacagatgacctaaagatagcaacttaaaaaattttttttccctgaaagcgtattagccgtttgagagtttaattttgcattttcgtttcacttcttcatttctgtagagatcattggagtaataatagtacaaaatatttctcccctcttgcaagcttttaattatacttgtattaggcagcgtatttgtcagtataaacctaattgagataaggaacagtagaatgggcaactacaaagagttgtgttgggacagaatgtgatctagtaataattgtggtggatttgatggtgatttgctaccccagtgatacagattatattttgcaattagcaaaatttttgatcaagtggggataagttgagagtcagatgaagtatttgtgctcatatgagggaccattatgaatacttttgtctaactttctaaaattagtaactgttcccactagtttacagagtattttttctatttttttggaaccgagttcaaagcctggcatgtcaaaggcactcaattaaatttttctttttttaactgaatagatttttgaaaaataacactaaactatattttagaatatttggattttcttttaaagatggcttaacctttaaacagatacaatttgcacataaactgttaatataattcatcaaacaagagaatgagcattttggaagttaagagcctttactgcagaaatgtaggatggtatttcaaactactattgaaatattatgtatttgaggagtcctcctttcctcattttcttatctagaattatatttctgagacaaacaagataactgaatgttgggttcaaatgtatctcatttatagttttttttacacagtaattacagtagttggatatttgcttactaaaatgaagtgtgcaagaagaaagtgtgaaacagtttttttattatagaagcattttctgaattatttcattattttcgacttgttacccaaaaagatacattgattggagatagtgcccattccatttattcggttgataccacattggggttttgaatgatggagaccaatacagacctgcttagattggataaggttttgtttagtgcctttctcattttttacaaaacgacttttataataacttcagagtaatcaagtttttggagctcattctgttaataacaggatatgtggaccctccctatccctggcattttttttttttttttttttttttgaaatctgtagagtggctttgcaaatagtgccccctgtggtttaggaaatagagcctctttatttttattattaaaaaatagaattgttagcatatgatttttgaaagttagaaatttatcctttttgtttgagaaatgggaaaaaacttagaaactttaaagaagaaaaacaaaaaagagatggccgtgttttcagagtaggcctggatcatcatagtcagccagtagttttctcgtagcagtgcatatgttatcaattatgccactgggaaaccaaagaagtaatcaagaattgggctaattttttttttgataaggagttttgctcttgtagctcaggctggagtgcaataaggcaatctcggctcactgcaacctccgcctcctgggttcaagtgattctcatgcctcagcctccctagtagctggaattacagtcatgtgccaccatagctggctaatttttgtattttttgtagagatgtggtttcaccatattggtcaggctgatctcgaactccgtacctcaggtgatctgcctgtctcagcctcccaaagtgctgggattacaggcgtgagccaccgcacccagcgaattgggctaattttaatccctttagaattctgggagtggaaagtgattgtcgagctagaattcagtttgttcctagtaaaggggtagaacttgtttgagaatagctttggtaatagcttgaatctgtattttgttcacatatagaattttattctactgggattcatattacataaaataaggattttattagactctagaaagcaaaagaatatataaacaatgcatcttgttgtaagatgtgatttgcttccggctgcgcgcggtggctcacgcctgtagtcccagcacttttgggaggctgagacgggcggatcatgaggtcaggagatcgagaccatcctggctaacatggtgaaaccccgtctctactaaaaatacaaaaaattagccgggcgcggtggcaggcgcctgtagtcccagctactcgggaggctgaggcaggagaatggcgtaaacccgggaggcggagcttgcagtgagccgagatcgcgccactgcactccagcctgggagacagagtgagactccgtctcaaaaaaataaaataaaataaaatgtggtttgcttcaatcactaactcattatattaggcagaaagaatgaataggaaagatataaaattagtttgagtccttttgatttcatgacttctagacttaagagtggatcatagaaatatgtaatatttctatatatacatatatatgtatatatacagagagagagagagagagccccccccccccccccgagcaggagttcatcttatagtcttacagtcttcttatatcttacagtcttcgaatctagaatgtggtagatgcctaataaaggtttggataacagtgaagtctaagtggccctataaagttaccagtgattctcgaagagggaaacaggtttagttttaaaacaaaccagcatttcgtttttatttgtgatgttgaatttattctgagatttcaaatggcattaaaagtacatattttgcattttttatgggaacaaggaattaaaaagcttaagaaacttactaaaagtttgggtaacatagtttgaccctgtctttacaaaagattgaaaaaaacaattagctgggcttggtggggcatgcctgtagtcccaactacttgtggggctgagatgggagtatcgcttgagttggggaggttgagaccgcagtgagctgtgatggcacctctgcactccaagcttgggcaacagagcaagaccctgtttttctcaaaaaaaacaagacaaaacaaaacttaataaaaatgatttaagacttctatgctttttatagtctatgttaaatttttttgtgtgattatgaaaacaatataggcccattgtagtaaatactaaaaaagtacaaagaagaaaacacaatttcctcataattgcaccatgtgataactgcctctggaatttattcatttgcgtatgtaattgtaactgtgtttgtgcaaaagcatttctagagtgcataagtattaataaaggagtagtaggcctggtgcggtggctaacgcctgtaatcccagcactttgggaggccaaggcagacagatgatttgaggtcaggagttcgagaccagcctggccaacatggtgaaaccccatctctactaaaaataataataaaaaaaatagctgggcatggtggcacacgcctgtaattagagctacttgggaggctgaggcaggagaattgcttgaatccaggaatcggaggttgcaatgagcggagatcgtgctactgcactccagcctgggcaacagagtgagactctgtctcaaaaaaagaaaaagaaaaacaaaaggagtagttactggaataatacttttggaccaattttaagacagttcatttagagcagtgtttttctaactgcaatttgtcattcatgtagccatctcaagcagggttccataaggggagatttaagcactacagaaaatgaattgagtgctggttttgtcatttctcccagtgatcgtactggtaccattctaaatgcactggagagaaggtaattcattacatacaatggatgccttggggcattttaaattctcctgagaacctcaattgaaaaccgccaggagggtcatgaaatcaatttagtgggtcaccagcattaaaaaacataaaaacctgaagtagaataaaatggaaaatagaggacattgcacataggaagattaatcaatctctgttttgaaattgccagtttacattatttgaaggccagaataatccaggactgtaaattgttaagcatatatgctaaaatgagatagaaaagtaaagccttagaattatacagattaaaatttttgacaaatagtggaaaataatgtgtatgacactgagatttccatgtagttgcagtattaagtttattgggcatcacagaccttcagtataaaatgtcacaggattaacaggatttttatcagtgtatttttcttcaagttctaaaggggatgttatattaccaactttacatggctttgtttccattaaggactcaaaataatagttgcaaaatattacaagaactcgagcctttgcattttctgtgagcatttttaagtatctcaaacctaaaattggctttgtgaggtaggtggtatgatctttcagcctgtggaaacagctgccattgctgtgactcctgacgatctgtttttgatcagttagtgcagatgcttagatcatactgtcccagttttgcattaatttgatcaattctattgattacagagaagtgaggcccaagactaagccttgaaatctctaagtagctatttgctaccttgtaacactgttctgtttcatttattgaaacactaactcacaacatgttggaaatattaaggaaacctgatagtgtactgagggattctgtttcttttggtaagagttgttggcagctatctggtagggtgtctttatacttctgaaatcatttattgaccacttgaatgtcttagtattatacacagcaaaaagaccctgatgagatatattcacttcctgtgtatccagtcatatgtttagtaaggttgctaatgatttattttgggtcagaacaaagtaatgtgcatttcatatgcattatattttatttcttgtgtaaataggccattagggagatagactattaaatttaccaacctacactactgcttctgtcttatgaacacaaatttaaaaattaatctttatcacttatagcactttaaaaattctgtttttagaaataattttcaatttttttttttttttttgagacggagtctcactctgtcgcccaggctggagttcagtggcgtgatctcggctcacagcaacctcgacaacctccacatcccaggttcaagcgattctcttgttgcagccccctcggtagctgggactacaggcgtgcaccaccaggcccggctaatttttttatttatttttattttttagatagtcttgctatgtcgcccaggctggagtacagtggtgtgatctcggctcactacaccctccacctcctgggttcaagcgattcttctgcctcagcctcctaagtagctgggattacaggcatgagccaccgtgcccagcctttatgcctggctaattttatatttttagtagagacagggtttcaccatgttggccgggctggtcttgaactcctgacctcaggtgatcctccgccttggcctcccaaagtgctgggattacaggtgtgagtcactgtgcctggccttccggctcatatatttgtaaaaaggcttaattctgatttttgttggaattttggaattcccactagtgttttgaggcattatcttggtttctttagttcattaatgtttgtcattaggacttaattaaagatcaaaatagtaatctgatgctgtaattaaaaattagagtgccacctaaaagcaagatttagtatttgaaaataagttccagcttgggcaacatagtgcaacccctgtctctacaaaaaaaattaaaaaaaaattagtcaggcttggtggcatgggccaatagtcctgactactctggaggctgaggcacgaggatcccttgagcccaggagttggaggatgcagtgagctataattataccactgttccccagagcaagaccctgtctcaagggaaaaaaaaaatgtctaagaattttaaagggttttttttggtacaaattcgaatacttgtatgaataatgctgagcaggtggaatagcttttgtatttagaaaggagtgacaagaagttttttgtaaatgaaatcaagctctctaaattatttttcattatgagactgattagcatcgtatcactaaaatagagtggttcttcattaggaaatctgattatcaaagggtcacgtatacagaataagcataggaaggtgcagaaatttagagaaactttcataaaatgtttcttagtttttacttattttatatttttttactgtatattttggaattgtttaaattgtacattcatagacatttggagttttatgacctaagaggaaagaacctttggaatgaaatttttgtgtctgaaattttgcttatgtgtttgaaatgaggatgctatctgttcattttggggtaaataatgatggggaaattgggtgataagagcattttgaaatgttaaggctctaacttaagctactaaatgatccacttctttggcaagttatataatgtattgtattttaaaatttaaatacacataaaaataaatgattcctatgttgaaaggtaagataccaggcagtagatactcataatttggtatctaatttttattcctgattagtagcattactgctgaaccatttaattatattgttctttttttgaaaacctaatttgtatgttgacacaaatgcagaatagatgagaaaatctggcatgcctctgaatgttttgttgtatcataaacattgtgcttttcttaattgtttttaacatacagttaggataatttgttataaatgtgtttatggcttaccacagcatattaggtaaaattagcttgcaacattttatcatggttagtgttgtgcgtgtccccatcatttgtattgtttaatttatatctctgaaaaatgcagccttagaaactgttgggcttccttggtgcttcatggagtagagggatatcaaacgtgaaagagaccaagagttttgtggtagcagaataaccttgtaaaaggctaccttgggaattaatgagctgcactgtcattcagaattcattcaacaaataatagatatttgatagatgagtccctactacatgctaggcatatagtgctaggtattaaaaatacaaaggtaaggctggttcttgacctcaagctgctgtttaagcagaggctgcgtagccacttaacagggattttaaatagggaattcagacattggctaggggactatgctaggtgatctttaagattccttagaagctctagtctgactcttactgggttggtcaagactaggaaataaaataaagaataggagctaagagggatgactgtttaaaaataaaggaatgtgctagcagttatttaaggtggcacctgaagtttagagacacagaaataaatagatgctaggtttggctcatgagtaaagataaaacttactcttataaatcaaactgtagggttttgaaatgaacttgatcaaaattgagtcagatttcaagtcaaggtctttgagcaaatttagaatttgcttgatattctgaagatttgagattccagtattcattataggaaaaactttgaaatatataaatcaattttagtaattttatatttttttctttttcttttttcgagacaagccccacactgttgcctaggctgcagtgcagtggcaggatcatagctcacagcaacctcaaacctgccagcttcaactgattctcccacctcagtcccctgagtagctgagactacaggcatgcgtcaccacggctggccaattaaaaacaattttttttgtagagatgggggtctctctatgttgtccaggctggtttcgaactgctggactcaagcagtccttgtgccttggcctcctaaaattccggggctataggtgtgagccactgggtagggccaattttagtagttttaatttaaaaaatctggaaacaattgatttcttgggcagtacatctagaattctttcagatataacacttatttaaagaggagctttctttgttttttaacaaatgatgtctagaaaagaaattctcatttaattcaagctgattttcctttttttttttttttttttttttgagacggagtttcactgtcttgcccaggctggagcgcagtggcgcaatctcagctcactgcaacctccacctcctgggttcaagtgattctcctgcctcagcctcccgagtagctgggattacagggatgcaccaccatgcccagctaattttttttttcttattagagatggggtttcaccatttggtcaggctggtttcgaactccggacctcaaatgatccacccacctcggcctcccagagtgctgggattacaggtgtgagccactgttcctgccctcaaactgatcttaaattttactgatttgttagaatgaacttatcctcgttcattgacacctctttggtcatgtagagctggggtgcaaaatgttctacccgttaagctactttttaaaagcattgtgtttttttaaaaaactgttttcatgaattgtaaaatgtctgaaaaagttttgaatctaagtggtatacagaacataatttagctatgtcacgttgactcaagagtttttatttttttaacgagacagggtctggctctgtcacccaggctggagtgccatggagcaatctcagctcactgcaacctctgtttcctgggctcaagtgatcctcctgccttagcctcccaagtagctgggactacaggcacacatcaccttgcctggctaatttttgtattattattagagatggggttttgccttgttgcccaggccagtctcaaactcctgagctgaagcagtctgcccactttggcctcccaaagtgctaggtaatatcacagatgtgagccgttgcgcctggccaactcaagattcttaaacattaattaccatactttgttgaattggggtaggggacaattgagatatattaaattatttgccccggtctatgctaaagcctttactcagattgtcttgctttttgaagcagtttttgtgtttgcatcttgtaattttcctctctccttaggctgtcagctgtcacttagcatctatcatttagtatttctgttgccagaagtcagttccctttcttactgctataactaagctataggctgaggaactatgtaaataagtgatcagtttgttttataaataagcagtggaatttgcccagattctgaatattagttcaaaatgtgatgtttcgttttctgttttcctttttttttttgagatggagttgcactttgttgcccaggctggagtgcagtggagcgatctcagctcactgcaacctctgttcccctgtttcggttgattctcctgtcctcctaaagtgctgggattataggcatgagccactgtgcccaggcctttttttttttttttaattccacatttacatatcatgtagagaccttcactgaatattcaactcttaaatcttttaaaaatattaatttttttcttataattttgaggtcttattagtatttcaaattcattgctcaataattcttttttttttttttttttttttttgagacagagtctcactctgtcacccaggctggagtgcagtggcacgatctcggctcactgcaacctccgccctctgagttcaagcgattctcctgcctcagcctcctgagtagctgggattacaggcgcctgctgccgcacccgactaattttttttttttgtatttttagtagagacggggtttcaccatcttggccaggctggtcttgaactcctgatctcgtgatccacccgccttggcctcccaaagtgctgggattacaggtgtgagccactgtgcctggcctaattcttaacaaaaataaagatctcccacatacatatttttttctttttttatttttgagacagagtcttgctctgtcacccaggctggagtgcaatggcgccgtctcggctcactgcaatctccacctcccaggttcaagcgattctcctgcctcagcctcctgagtagctaggattacaggtgcgtaccaccacacctggctaatttttgtatttttagtaagacagggtttcactatattggccaggctggccttgaactcctgacctcgtgatttgcctgccttggcctcccaaagtgctgggattacaggcgtgagccactgtgccctgcctatttttgtcctttagttggccctaagtcatctcctgactgatcagattttaagatacatattctaagagcggtttcctttctgttttcagcctgttttgttgagggcagtgggttacttgtcagatctctcccaggtttcttcattctcattgatttcctccattagtaggatctcagtaatcaaaccagagtttggatagtttagagttgattttgttttaatcactactgcttaacatccagagatctgtttgcagtccttagtttcttggttccaaactggaatattgggacatcaggcaaaacagctttgctactttcctaatttgttgaattgggaattggactctctctctctctctttttttttttttttggagacaaagtcttgctctgtcacccaggttggagtgcagtggcgcgaactcagctcactgcaacctctgcctcccggattcaagtgattctcctgcctcggccacccaagtaggtgggattacaggcactcaccaccatgtccagctaatttttgtagaaacggcgtttctccatgttggccaggctggtctcaaactcctgacttcaggtgatccacctccctcagcctcccaaagttacaggcatgagctgctgcacccgaccagaattggagcttcttttatttatttatttatttatttatttatttattttttttatcttgagatggattctggctcagttgcccaggctggagtgcggtggtgcaatctcggcttactgcagcctccgcctcctgggttcaagtgagtctcctgcctcagcctcccgagtagctgggattacaagtgcgtaccaccatgcccagctaatttttgtatttttagtagagactgggtttcgctgtgttggccaggctggtcttgctcctgacctcaggtgatccacccttctcgtaccaccacgcccagctaatttttgtatttttagtagagactgggtttcgctatgttggccaggctggtcttgctcctgacctcaggtgatccacccttctcggcctcccaaaatgctaggattacaggcatgagccactgcgcctggccatggaacctcttaaaggtagggtttagagaaatatccagctctcttttttgttttttcccttgtttaactcgttcctaatcgcattctccctcagtttcctgggtttgtctgttaacttcctatttttgttggtcaccttaaccatgccacatttcagctctcctttccttctttcccctttcccttaccagtgagtcttgcccccccttttaagtatccttttcccacaaaagcaaggtaatttcgtataataggaaatatgtaggggatgaagggaggacaaagtgtaaataaagtaaaccaaaataagggagaagttagtaaccacagatcatttattctttttttctcttcaatttctttttttgttttgttttgttttttgagacgattcttgctctgttgcccaggctggagtgcagtggcatgatcttggctcactgcaccctccatctcctgggttcaagtgattctcctgtctcagcctcccgagtagctgggattacaggagcgcaccaccatgcctcgttaagttttgcgtttttaatagagatggggttttgccacgttggccatgctggtctcgaactcctgacctcaggtgatccacccacctcggcctcccacagtgctggaattacaggtgtgagccactgaaccgagcccctcttcaatttctgaacgtcagttgttttctcatctgtaaaatggtaatgatacctatttaatgggggatatttgttagaattaagaatgatgtataaagttctcagcccgtagatgttcattaagttaccagttacctttctccttatttttctttatttttagttatagctcatctttaagtattaaaaaatcctttttatatttattaggaaatatagtttaatgacaagtgttagcaaactatgtggttttggatttaatttggcaaagtattgctgtagaatggtatctagctaatatgctaacaaatactgtagggatagggtatagtctagccgattgtagtacaggaataagaatcaattttccagtgctatacctttatagagttctattatttaaaatggatttctggccaggctcagtggctcatgcctgtaatccctgcactttgggaggctgaggagcagggatcacctgaggtcaggagtttgagatcagcctggccaacatggcaaaacccaatctctactaagaatacaaaaaattagctgggtgtggtggtgggtgcctgtaatcccagctactcaggatactgaagcagagaatcgcttgaacccgggaggtggaggttgcagtgagccaagatcgcgccactgcactccagcctgggtgacagagcgagactccatctcaaaaaaaaaaaaaaaataaataaataaaatagatttcgtaagtatgaaatttgatgcagtcatttctggtactccatgttagcatgcatactgaaactgttcttgtgatgggatagttcatgtgggtgtctctgagtttcaggtgataatcaggcttcttcaagggaagactgccttattggaagatgactcttgagacagggtctcactcttgcccaggatagagtgcagtggtgcaatcatggttcaatcatggttcactgcaagcctcaacttcctgggctcaagggattctcccacctcagtctcccaagtagctgggaccacagatgtacaccactgcaactggctaatttttttttttttttttttaaagagactgggtcttcctatgttgcccaggctgactccacggcttaaggaatcttccccactctgcctcccaaagtgctgggaatacaggtgtgaaccactgtgcgtggcatgatgactcttaaataatgttagttgtctttacccagtggcccagtcaggttgacacataaaattaaccttcacagttttacttcaataaatgtttcccttccatgtttttctgcagacagatgcaccatcaggaatggaattacagtcatggtatcctgttataaagcaggaaggtgaccatgtttctcagacacattcatttttacaccccaggtgagttggtatttatttgttcgtttgttcattcatttcttcattcaacaactatatgccatgcactattctaggacatgggaatttaattatttatttattttttttggtggcagagtcttgctctgttacccaggctggagtgcagtggcgcgatctcgtctcattgcaacctccgcctcacgggttcaagcgattctcctgcctcagcctcccgagtagcggggactacaggctcacaccaccacgccctcctaatttttttagttttagtatagatggggtttcacagtgttggccaggctggtctcgaactcctgacctcaagtgatctgcctgcctcagcctcccaaagtgctgggattacaggtgtgagccactgtgcctgaccacgaatttatttctttattttcaggctttcttgttaatcatagattatctttgaaaattcaaaattaggctgggcgcggtggctcatgcctgtaatcccagcactttgggaggccgaggtgggtggatcatgaggtcaggagatcgagaccatcctggctaacacagtgaaaccctgtctctactaaaaatgcaaaaaaattagccgggcctggtggcgggcacctgtagtcccagctactcgggaggctgaggcaggagaattgcttgaacctgggaggcagagcttgcagtgagccgagatcgcgtcattgcactccagcctaggcgacagagcaaaactgtctcaaaaaaaaagaaaaaaagaaaattcaaaattatttttaaataagtacattggtatttaatgtattttttgtttctatttatcattatagggaaatggtaggtgaattgtattgttactcttattagaaaaaatttcaaagaaagaatctgaaatgaaatgaattgtaaattgcactgaatatttgaaataacctttactatgtgtttctatgtgttttctagaaataggtcattttctttttgccctcaagtaaaaaatggaagttctcctttaatttcttacttttcttcaagaggtaaacaaactcttcaagaatttggtgtgcaactttgatttttttttttttttttttgagacaaagtctcactgtgttacccagactggagtgcagtggcaggatcttggctcactgcaacctctgcctcccaggttcaagcagttctcttgtcatggcatcctgtagctgagcctgagcgccagctgtcactcctggctaatttttttgtatttttagtagagatggggtttcaccatgttggccaggctggttttgaacctcaggtgatctgccagccttggcctcccaaagtgctgctaggattacaggtgtgagccaccgccccgagccgcaacttcaattttttttttttttttttgagatggagtctcgctctgttgcccaggctggagtgcaatggtatgatctcggctcactgcaacctccgcctcccgggttcaagcatttctcctgcctcagcctcctgagtagctgggattacaggcatccgctgctacgcccagctaatttttgtatttttagaagagacgaggtttcaccatgttggccaggctggtctcgaactcctgacctcaagtgacccacctgccatcagcctcccaaagtgctgggattacaggtatgagtcactgcacccggcctgcaactttgatattttaaaaagaaattcttttgaaactaagagctttcttaataaccgtacttctcaaaatcagagttttactgtttcaataaatgttcaccctagattgtaagttttttgttgttgagccctagatttttttctactagtgtaaatctgtattccctccaagtatggtgataaggggactgagtcttatttacatttgtacaatcactactttacctgttgtatttgcagtaagtcttttgagccctattaaacctgtcaattttcttgtcctgtcagaaaactgagattttggctcaaaaatggatgttattaacaaaggggaacaatatagatgtcttagtacaaagaaaatgaaatgtaagaggagattgtctggagttcaggggatagagtgtcaagtcttaaatggttacatctttttgctaagtgttactcagaatatagttacaaatatggtacttaaatatctagctgaaatttgtttgtcccatgagcttctcacatgagtctactgggcaattttatgtgagttttggtcaaaattggtaatctcttttatcttagttttgcataatttattgttgccattttatcaaatgagtaggaagtagtgaagtatttcaagaagattgctcagtggggtttgatacaagaactgcccagtagctgggcgacattcagagctctctctctgaggtatataagaagagccctgggagctcctcactgagcctcctgtgagtcaggacatagccttgcagtctgccactgaagcagcctcaccaaagcaaagattccctgctttggaagggtggtgggcaagataaagtcctccaaagtagttatagattattctttttctggagtaaaacttacctgctcagagttgttacacagctgtataaagtccttaatgcttttaattctcaggtggttttgagggaaggagaagagcctgtgattttccttctgtgtatctttttagtgcttagaaattacttgccaaaaaaaaaaaaaaacacgaaattacttgcaagctggttatggttgcttatgcctgtaatcctagtgctttgggagttggaggtgggagggtatcacttgagcccaggagttcaagaccaacttggcagcatagcaagaccctatctctaaaaaaaaatgggtatgtgtggtcccagctacctgggatgctgaggcaggaagattgcttgaacccaggagttagaggttacagtgagccatgatcataccactacgctccagcctgggttacttgcaaactaacaaaaaatcccttataattttgtttgtaatgcctaaagtgttgatttttttcctaagaattctttactgtgacctttattttctgagttgtaatattgtctgttttggttagaaaaaaaaaagtttaaccacagaaatgcatgttacatatttgatttttacttaattgtaatatgtaatatatgtcttgttttgcttttacttgttttcagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttaggtaagtattcagagattatctttctaaaattaaatatctaatgaacacatttattgagcattttcaaacaggctttttgtttgagctaaattttcagataattggagcttttacctttaaaaatgctacccttcaaaactctgggtgatttattttaatctcagttgctatacttttctagcgtggtgatagctcaggagactgagatagatacaggctacctggcctcagactgcaagttatttttgtccgaatttttttcctttcctaccttttatttgctgtcagtcttcaggagatccttgtttttctttcctcctttttttttctttttttgtgacagagtctttatcgcctaggctgaagtgcagtggtgagattgcggtcactgcagcctcaacctttgggctcaagtgatcctcccacctcaccctccctagtagctgggaccagaggcgcacaccactgtgcctggctaattaaaaaaaaaaatttttttttttttttttgtagagatggtcttggtatgttgctcaagctggtctcgaactcctgggctcaagtgatcctcctgccttggcctctcaaagtgttgggattacagttgtgagccaccgcacccaacctttatttttctttctgatttgccatgaactgagacaccatttaataataagaagtattatgtaagtaagagtagttaggtatagaactcaaggaagcttagttatggaataaagcaaggattgaaagctctgggggccaggcatatagcataaatgtggaatattgactggtcatttaaaagaaaaatagctggttacttaccgtgccttttaaaatactgtggattaaatgagacatgtctgcagatattgcctgtgttaccatccatatagcagcacagctttgcttagtgattaggcagtgtgacagttactttagctgcattggaacagttggagggtcctctatttatttaagtttttatagagaattgagattcttgggggttttcttttctttctttctttcttttttttcttttttttttttgaggagtttcactcttgttgcccaggctggagtaaaatggtgagatctcagctcaccgcaacctccacctcccagattctcctgcctcagcctcctgagtagctgagattacaggcatgcaccaccacaccccgctaattttgtatttttagtagagacgggttttctccatgttggtcaggctggtcttgaactcctgacctcaggtgatccgcctgcctcggcctcccaaccaaagtgctgggattccaggcgtgagccaccacgcctggctgattcttgggtgggggttttctggtttttttgtttgtttgtttgtttgtttggagacagagtttcgtatttgttgcccaggctagagtgcaacggtgtgatctcggctcactgcaatctccgcctcccaggttcaagtgattctcctgcctcagcctcctgagcagctgggattataggcatgcaccaccacgcccggctaattttgtatttttagtagacacggggtttttccatgttggtcagtctggtctcgaactcctgacctcaggtgatccgcctgcctcggcctcccaaagtgctgggattacaggcgtgagccatcgcgcccggccaggggttttctatacatttattttgagggttttttgtttcgtttttcttttttagagacagagtctcactctgttgctctaggctggtggagtacagtgatgcattcatagctcaccgcagcttcaaattgctgggctcatagtccttgcacctcagcctccctagtagctaggactacaggcatgtgccactgcgcctgcctcattttttcattttttttgtagagacagggtctcactgtattgcccaggctggcattaagctcttagcctcaagtgatcctcctgccttggcctcctaaagcattgggattacagatgtgagccaccatgcctggccaattttgagatttttaaaactcagttttcttcagatttaaatatggtaaacaaaaattagtaatgactattatgccatatttacattgtattttatttcttaaattaattctaatgacttctaaaaaattattgagataatttatataccataaaatttacccttttaaagcctacaattcagtggtttttaatacattcacaaagttgtgcaaccatcacagctaatttagttccataatgttttcttttctttctttttttttaagatggagtttcactcttgtcgcccaggctagagtgcagtggggtgatttcggctcactgcaagctctgcctcccgggttcaagcgattctcctgcctcagcctcctgagtagctgggattacaggcgtgtgtcaccacgcctggctaatttttttgtattattagtaagagacagggttttcgccatgttagtcaggctgatcttgaactcctgaccttaggtgatccacccgcctcggcccataatgttttcatcactccaaaaattaaccctataatccattaggagtcactccctgattctccctttctcgaagcctctggcaaccactaatctattttctatctttatggatttgcttattctggacatttcatataaaaggaattgtacaatatgtggcttttcatgtctggtcaagaagcttatgcttctttcatgaaagataatgttttcacagtccatgttgttgcatgtaccagtacttctttttatggcctgataagattccattatgtgaatataccacattttttttattccttcgtcagtcggacatttgcattgggtctactttttggcaattaagaataatgctgctataggccgggcgcggtggctcacgcctgtaatcccagcactttgggaggccgaggcgggcggatcacgaggtcaggagatcgagaccatcccggctaaaacggtgaaaccccgtctctactaaaaaaaaaaaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaataatgctgctataaatacttgtgtagaagtttaagtgtagaactatattttcagtttttttttggtatgtatttaggagtgaaattgctaggtcatgtggtaattatgtttaatgttttgaggaactgccaaacttttcaaaagcagttgcaccattttacattcctgtggtagcttgggagtttcaaattttgcatatctttgtcaacacttgttattgtttgtcttttgaatatagccatcctagtggttgtgaagtggtatttcatggttttaatttgcaatttctcagtgaatgatgatattgagtatcttttcatgtttttcttggacattgcatatctttggagaaatgtctattcaggtcttttggctattttaatgctaggttgttttactattgagttgtaagagttctttatatattctggatactggatccttatcagatatttgatttaccatactgttttctttttactttcttgttagtgttcttttttttttcctgagacaaagtctggctgtatcaccccagcttggctcactgcaacctctacctcctgggcttaatccatcctttcacctcagcctcccaagtagctgggactacagggatgtaccaccatgctcggctaatttttgtatttttggtggagttggggttttgccatgttgaggctggtctcaaactcgtgagcttaagcaatccacctgcctcagcctcccaaagtgttgggattactggtgtgagccaccgcgcttggccgtgttagtgttctttgaagcacaaaagttttaaatgtttattacatccaatttatctatttttttcttgttttaggtatcatatctaagaaactattgcctaatcccaattccaagaaatatttatttatgtatttatttatttatttatttatttttgagacagagtctcactctgttgcccaggctggagtacagtggtgccatctcagctcactgcaacctccacctcccgggttcaaccaatttttctgtctcagcctcctgagtagctgggattacaggtgcgcgccaccatgcctggctaattttttttgtatttttagtagagacagagttttaccatgttggtcaggctggtggtgaactcctgacctcaggtaatccacctgcctcggcctcccaaagtgctgggattataggcgtgagccaccacatccagccaagaaatttatgtttaagggttgtagctcttacatttaggtctttgatcagtttagagttaatttttgtatacagcataaggtccaaccttattcttttgcatgtggatatagttgtccgtatgttgaaaagattattctttcctttttttttttttttgagacggagtcttgctctgttgcccaggctggagtgcagtggcgctatctcggctcactgcaagctccgcctcccaggttcacgccattcttctgcctcagcctcccgagtagctgggactacaggcgcccgccaccaagcctggcaaattttttgtattttttagtagagacagggtttcaccatgttagccaggatggtctcaatctcctgacgtcgtgatccgcccttctcggcctcccaaagtgctgggattacaggcgtgagccaccgcgcctggccagaaaagattattctttcctgactgaattgctttggcacctttgtcaacaacaattgccttataaagtatgagttttttaaatttctggactctgaattctgttctactgatctgtatgtctatctttaaatcatgtcacacagtcttgatttctgtagctttgtagtaagctttgaaattgggaattgtgagtctttcaacttcgttattctttttcaagattattttgcctattttgggtttgttgcatttccatatggattttagaaactgcttttcaatttctgcaaaaaatccagtggggattttgatagggattgcactgataagtagatcaatttggagactattactgtcttaacaatattaagtcttccaatccatgaatttgggatgtctttccatgtatttaggtcttaaatttcttttagtgatgttttgtagttttcattgtacttgcactgcttttgttaaatttattcctattttatttgttttggtctaatttataaatgaaatgttttaaaaattacatttatggattgttctagtgatttttttaatggagtgatattcatactttgttacttgatttttttctctccaagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggtaaaattgttatctaaatgatagtccattatgaaaagatacttttgtatattgctctgtcgcccaggctggagtgcagtggcgcagtctcagctcactgaaacctccacctcacaggttcaagcaattcttctgccttagccttccgagtagctagcattacaggcacgtgccaccatgcctggctaaattttgtattcttagtagagatggggtttctccatgctggccaggctcgaacttttgaccttgtgatccaccagccttggcctcccaaagtgctgggattacaggtgtgagccactgcgcccagcccccctgtatattcttagtaagaaaagtcaaaacgagatgctacaaatgtacttaagattattgttttacactgaaaagcaattttaatatattttaaaattttttgagaaaatagttttttaaaataattacctctatatagaactgataatgatagctgaattttaggtattttctgtgctatgttttccagaactgaaaattttaacatggtgaaaataaagtaaaacttgtattgtgattctttacattacaggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacaggtaagaattactgtttgtataatggtgccctttcagcatggaaatggaaactgttacttctctcttttttttttttgagacagagactgctctgtcgcccaggctggagtgcagtggcacaatctcagctccccacaacctctgcctcccgggttcaagcaattttcctgcctcagcctcctgattgtagctgggattacaggcgtgcgacactatgcccagctaaattttgtattttttagtagagacggggtttcaccatgttggtcagtctggtcttgaactcctgacctcatgatctgcccacctcagcctcccaaaatgctgggattacaagcatgagccactgcacccggccaccgttacttctctaataaaggaattactttttgtcaagctcagtttactaagctagatttcaaaatagataattctgttaaacatagctttatgctgtattgtccaagatgattattttgatgtttgttgcttttattagtttaaatttttatcgggttactgcagtttagttacctaaattgctaatctctagccctctgaatattatatgttatattattttaatgtagtatatgagctttcaaatctacaaattaacaaacaggaactgttgcctgttatgttcaaaagcactggagcaaaaataagcaattctcttttgttaatagaatctcacaatttaaggaacatgaacaaataactaacatgagcaggctgtgatgagcggtatagtaaagtatagggcataatgaacatgaacatgctggatgtgttccttcctcttgttcctttgctttttcttaaatttagtgtcctgtcagatgtcagattaatagtattagatgcttaatggatttagtatacatgaaatagttcgttttgtaaaaagtaatttgaaaatagatattttctatgatatgaggattaaatggaaaaacaaaacaattaaaattgatagcgccttttaaatcacatagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctcttctttttaatgtgtaccctaggaggaattttactgaggttatagcataccccatgagcacagtggggaagaagaatgtgttgttatgtgctgctgctaaacagaagcagcagttgtaatttgtttttcagtttaaatgtggttatagttagatttttttttaagcagcaacttttcaaaaataaaatgtgataatttctgaacttttgtttgtgttgttaatagtggtgtgaaaatattaacgttcttgagaaaaactgataccactgttgtgtatcagtttctatacaatccataatcctcctgtacagtttttacatgtagttatgagtcttactaaaatttatataatggacttgttttcctttaagttgtaaaatgttaaacaccttgaaggttattttggacttctgtatgtttaaatgttgtcttaccaaaatttgcacgaatggaccattttcatttactacttaatatcaaaatcaggaatttacagtcaactgatagtacatgataggtgcatataggacagtttagttacctgctactaaaagatttttagataagttttagaagataaaggaattccatagtttcaggagggacaacatcttctgcactttttttttgcacagaaaagtctgtcattctctaatggcaaatttcatatttgttaattcttggctcaaaatatattaggtaaaattcttagatctgtttttaaagggagtttcctgaaactatcattaattgacattattaccccatggattttatgggataataaatgtttttcatgttctcttataagatactatgtatgaaattacttcagagagctatatttattttaaaataaattagctagggttaaggttatattctatttccagcatagaaggtagataatctaatggtgtagaaagaatcactaggttgtcatttaaccagttattttcatattttgcttaatagtacatatccaaaaagaattttgtacttccccaaatgtaatttatttactaaattgagtataacctaaatgtgtgttttctattttccatttaaattttgctatattaagactaatttaattcgttgagtcttggaatcttctcaaggaggaacaaatattaaaatgacatgtagaaacaaatttttttttttttttttttttttttttttttgagacagagtctcgctgtctcccaggctggagttcagtggtgcaatctcggctcactgcaagctctgcctcctgggttcaagccattctcctgcctcagcctcccgagtagctgggactacaggcacccaccaccactcccggctaatttttagaaacaaatatttaaaatgacatattctcccaatacaatctatttagatctggagaaggaaaaatcagatatttatgatatagttttattttaattttgaattatttgtgtcacagctcagctttttggaagacaaactcaaacacctataatttcatttatatttctaattcacttggaacctttctgctttatgttacctagaaaatgataatttgtttaacccaaaacttctaaaataaattgcttaatccttgaaatatgttattggaaaattttaagcagtgcttaaacaccattaaattattatgaacttgtaattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataaggcatatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaattttttttttctagtatagggtacttaagcatttccacttttggaagaaaagtgtattagtattttatattgcatttcatttaaaaggacagttttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaatttgattcaagtta

SEQ ID NO: 130 - DNA, 7007 bp, Homo sapiens
cttttgaagttaacaaaaattgagtccctggctgggaggtcccccgagtgttccgctgtgggctggaggtggcgtttctgtcgtgatttatgtggagtggttcaaaacagaagttaatcactcgggaagcggacgggaggggcggcgctactgcgcatgcccgggagccgcctggagtttggaactccacattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtagaacgccctaaggacccctccccgcgggacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggatggttctagcgcagagccgggtgtctgccggggtgggctccccgcattgttcgggctccggcgggggcggctctgattcctttccatggcccgcctcccaccccgggaatccccagtgctccttttccacggcttttctggcgtccccccgactctcccgcggcactttggcctaccttcccccagcgccgtggtcctccctggcgaccccctctgcgctcctggggtcctcctgcgccccccctcctccaccggcgcgctgcccacagccgcgtgccctctccccggagctggggaccaaggctgggccccgccggccgcatcggtgggaacttccgcggtccccatcccagggcgcacagggtccagctcctcggcgccgactcctggaaacaatgaaaggtgacgggctgaaggggaaactttgcgactggttcagggctctttgggggagccgaggctgccgaggttacccgggtttctttccccttttaggtttccctggcgagtcgtctggggtgggcaggcctctgagaaggtgggattcacggcctcatttctagtttcttgggtcctggagttcctttgcttgtgctaactcgtgcagtgtgcgggccggcctgtttcacttgaggccgaggaactctcaagaacaaaagctacttgcttttcctccttgggcccctccctctccccgtgctcctccgccgtcctcctctaaaactacctgggaggggggagccttccccgtcggctctggaaagactcctgaggaagtcgggccctccttactgtcttgtcttataaaagtctgcaaatcttttcaagttttcttaaaacaagtgcactttcagctccattcctgagcccggggtaagcttggtttgtgataatagtgtgtcctcccagaaagctgagagtgacgccaaaagatctcctaaaatgacttaaaaacaatgagaaggatcgataaggaaaatccactaagtctttttgctcccagtttttaactgttgaattcctgctttgggattgctctttggctggggtagccaaccataccttggatttggtggcttgagtgttcaatgcctgttgcttctcccaaggagatactgattttttttttcttttgttcctggagaccgggtctggctatgttgcccaggctggtctcgaactcctgggctcaagaaatcctctcgccttggcctcccaaagttctgggattacaggcaagagacattgctcccagctcaaaggagaacttctggtcaggaaacttgttgagttaaatttgctttttcctaattgtgcatctcgacttttcccatcaatcttatttctagagtctcttcacaaccggtgtctccctgcctccctgtctcatgatgttaccgagctattcagaaaagaaagtgcagggctgggcgcggtggttcacgcctgtaatcccagcactttgggaggcctaggcgagcagatcatctgaggtcgggagttcgagaccagcctgaccaacatggagaaaccccgtctctcctaaaaacacaaaattagccgggcgtggtggcttttgcctgtaatcccagctattcgggaggctgaggcaagagaatcgcttgaaccctggaggcggaggctgcggtgagccgaggttgcggcattgcactccagcctgggtgacaagagcgaaactctgtctcaaaaaaaaaaaaaaaaaaaaaagaacgtgcaggaacaaggtcgctgcttagggcggtgggatcctcaggccatgttgtggctttctccacaacatttccttgtatgtggatagcgtgaaagaagcttgtgatcctgcccccaccctccccaccgccacattttttaaagtgtaagcaaagcaagacgtttggaaacaagtcttaaccgggaaacttttcaaaagcgctgttacaataggaaatgagtaaggaggaaaaaagtctttgtttttccaagctgagccacaactaggagggagagttttaatgaaaacagtcctgacagcagcaaacgtggttttactgcagtgaaatatcagctggcgtagccaaggcactgaagtcttaacttcctgttacttcagcttttgtgcacatattggaaatatttgttaagagttccagaggtctggcattcatttatttaaatgaactgagaacagagtaaagtcgcgctgcagtttggtgttgcttaactgaaacctgcttttgtgtgtcactaacctattctgaaagatcaggcttcttgtcaaactaggcaagcagatcaaagggcagccttcaggggctttttttgtttcaaactctttgtgattaccaacttacagttgggaattcactgttcaatgagcaaattttcacactttttctagattaaaaaaaggaaggagataatagccttgagaagaatgtctggcttttcagacgttggagagtttaaacaaattgctttattcaaatttgctttagtcatttaattaacttaacactttttttaaaagttcgatttctttaattattaaagccaatgtgagacaggaactcagctataatttctttaagctattttattaatagttcttcacccaaatttcaatataggttttgaaagtctcatcttgccaatagtgaaagtagtttcagttttaaatgggcacttttaaaaacctttttaaaaacttaaatcatcaggggaggggaatttcaaatacatggcagttaaaacttaggattcttgtgcagtttatttgtagctgtttgttaagctgtgagctaaagtgaatttgcaagatcatccacctctttgttagaactttactttgtctttggagagttctgccttttgtaggaataccctgcagcaccttctgccccctgcagtccaaaactaaaaatgtgtcaccaagtcagagtcattaaaagggtgggaaaaattcctttaaaaaacacggtgtttagcttaagaggaatattccgtgtttatttcctgtcaaggggaactggctcaattaaggtcaagtcatattttcaaccaaaattacatactacagaggaaagaaagcatacaaagctaaaaatgcttacctttacatttttgttattttaattacttcccctaatatagaagtactgatttttttcaagcatgccattgtttgtaattcatttctgtttttaagattctagattgtctacaagcaaaagaatgtatttctttagtcattcggagtagcctgctgtagtttttgaaaggtggaattaatagcgtttgttatttaattttttttaagttcagaatgatgtttaaatatctgtaaaggccagttctggagctttattgaaccccgtccatctgtgatttaaatattctctatggcttgtgaattcttaaaatttctggcaggattaaagtacttacagccaaaagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacttggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtaaagaaagagagcgtgaggtttatggatgcatttttagtttcaaagtcattttatggcattcctgtgtgtcaagtcattaagctccttgccactcaaagacagaaggaatatctttttattgtaaacttgatagtgttaaaagctaataactagctatttagagaacacagaaacacttgacagtcatctatcagatagcatttcctttaatgcctaaaagaaccttcctttatgcaacagacattaaaaggaggttaaaccttactctattgtccaggaaactggtttgatatttaaacaaggacgacttcagtgaggtaattcatgttatgtctgttgacacagtcatttgaactgggaaaaatcagttactgggaggagtggcccttttcataaggagaggttttcctgtagttgattaacttaaatgttggggcagtaggtgataggttaaaatggggagagttaaaaagtaaacctctctctcaaatcatttttaagcatttgagattgtatgtctttttcttcgtcctgaaaaggtttaagtatgaagagacaaaaaaggaaatttgtattagaaactagaaggcttatgacaggtggtagcttgctttcttggcggagctcagataccttgaaataacattgtaaattcagataaggcttttcatgctttctttaattcagagagcaagatcaattaggtaccccatagaacattctcagaacccgttggctgagtgaatgaggaaaatgttaaagcgtaccgatatgatttcaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaa

SEQ ID NO: 131 - DNA, 15093 bp, Homo sapiens
gtcagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatggtaaggctccgggacgcggcccttccctgccctgccctctccgcgcccgctccattaaagttctccatccagtggagagccctggctggctggccctctggcagagcggtgcccgggtgctcccttactctggcaaacctggatctcaggctcacctgttgtggaagtggaagaggctgaaattgacaggaactgacggattgggaaggatagagaagtatgcgcaaggccaaacccccaacccgcaaacctcatcatccacccacttctagatgagccgtaagtttagctctaggttttttgctgtttaggttcaaatgatgggacttcttgtccccttggggaataattttgatctcctgactctcccttctcttagtcgactcttcaactaacctctgtctgtccttctcccatctcaccttcatccctcactgatcaccccgatctgatcccccttgctccacctgtagcccccaactcactcccactgccccctgcctctctcctcctaacccagccagttcaggcttctaacccagttcaggctcctaacccagacagttctccggcaaggtttctgcaactaagaaaagtaaaccccagagacagaatgaaagagccgggagttggaaggaccaagagcagagacagagagcaaggaccgaaactgcttcttcatgacaccaaaatacaaagtaaaacatgcagtcagccattcacgtgatcgagagctgagtcggagatgtgcagcccaaataccacaacgactcgctgcatttttcactttccgtctaatgtttcgaaatcaaggcactgacgtgaagatcaaagacggtataagaaagaaagcaagagacagatgacagagtcctcccccccaaaaaataaataaaaaacaggtgcatgattagagagatgtagagaagttagaacactagggagcgggagcagagtcgctgtcaaatggagagaacttagaggatcaaggaggagagaaagggaaccaaccagccgttggccttgcacatacttcagtctgcttgatcaacaagactcttaaagtagaaatgtttgttgcattcttacaaagaagacaatgccttcagcagtgtttcccatggtgaatggtgtgtactgggggtaaagggagagtagagctaggaattggtattgagtatctctcctcggagctacaggtgccagctcttgtggggatgtcctcagccatgtgtagagccagagctgatttattccatctgtccttgcccagccagaggttggacatctggctataggcaaagccctcccagaaactagggaatgaggcaagcacttagcttggggagcccaggagacctatgaagagaaggaggcagatgtcagcaagcaggctgtctgtgtacttagtgaggtggctttgagctggagcctgggccaagccagggtggggatcaggtgtgtggatggggccaagcctaggaatagtgctagagcagggacagggattgggcagagccagggactaacacatctgagagctcattgccaacttgcttagccctcggcccctgccttcttccctggtaggcatcagactcagcttggctcttctcagcccccactgcagcttctgatcacagagagcacagggcagtgatttagggagacacactagctctagaatcagacacatgtggattcatgtgcccactctgccccttacgggctccgctggcctcgggcgagtcatagcctctctgaacctccctttcttctttggtaaaattggggtcatcaatgcctgccccccctcccagctgtggtactgacactcttctccccagggacagagctgcccagccctccgtctgtgtggtttgaagcagaatttttccaccacatcctccactggacacccatcccaaatcagtctgaaagtacctgctatgaagtggcgctcctgaggtgaggaaaagggaagagggagggggagggaggagtgaatccccgccttgtcctctactctcctagcatgggaagatacctgccttgttaatgaagtgagtgcctgagggcccctaacacatagccagcagttgacaagtactgactgagactcccttgctgagcaatgtgccgggagctctgggtgaaaaggccagagcctttgctcactccagagtaagaaaagccttgtgccaaggcttttctcttttttgttttgttttgttttgtttcgttgagacagcttctcgctctgtcacccaggctggagtgcagtggcgcaatctcagctcactgcagcctctgcctcctgggttcaagcaattctcccatctcagcctcccaagtagctgggattacaggggtccaccaccatgcctggctaatgtttgcatttttagtagagacgggttttcaccatgttggccaggctggtctcgaactcctgacttcaggtgatccacccgcctcagcctcccaaagggctgggattactggcgtgagccaccacctccggcctccaaggcttttctatcttactggaaaaggagaagcatccacagtacagccagacaacaggggaacactaatgactgtaaaggcagtggggagaagggagagaccaggctgtgctgtaggagccagaaagaatttctggaagagctgggcctactcgtattcctatctaaaaatctgctagaccacatggaaattggtacggggtcccaagaccaagggagacccctcacaatgagctgccgtggactagaggatatagcctgagggctgtcccagtttctcccaatgtgggagctctcttcctggcctcttgcgtctcccttaaaggaggtaggattgagcacaagctcgtttccagtgcctaacctggtatctcctcaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaaggtgcttttcctcccttgacttagaacatggctctgaagtcccttccagccaggaactctagtctagagcttttctgtctattaccatagctcaccatgtctgccagcctccctggccggagaactagttgcccaaacagggcaggactttggagaatgttagataaaaatagcccaagttgtttgagatttaaaagggaactggagttgtttatcctacagaagagaggtcttggggtgggttgggacagctgagtcaccaggtccaggcctgtgaacttgttttttcagggagggttcagggagaggaagcgaatccatgaacactcagcatagggcagcaagcagtaggcagaatttgggtgaacgccccgcttctttaggggtgaacacccaggggtcatccctttgaaatgggaagtgctactaaagagaagttatggatccctctctggagaggtaagaggaaaggataagcccccaactcagtgggatttttcatcccaccagttgggattgagaaagttttgtgtgcatggagacctcgctctgtaggattcagagttagagccgatggtctaggaggtcattggcttccaaatgcctgcccacaggccactgctcagctggtgcagaaacgtttcccagcaagtgtgtttaaaatatctatttccagggcccagcctcagaaattcagaccaactgtgtcttgaatgggcccagggcatctgtattttttttttttttaacattttgttcttctttgtattttgatttgagcaaggcaattataaaaagacatttttgaggaaatcaccatatttgtatatgaaatggtttttagggcatattactaggtatttgtttgttacatgtgataacagcatggtagttatatttacaaaggtgtgatatgtgagagatacatacttacgtaattaggaattaagtaatacagtgcttgggatttttctttaaaatgctaaagtaaatttcatggggggatattgatgaccctcccctgccaccaattacttcaaaattggcctagtgtttgcaattactaaagctgggactttggaaatcattatattctcttctacttttctgtctattggaaatttctacataaaaatataatcaatgcaatttatcacattaaccatttaaaaaagaaaacaacatttaaaaagaaactaagcaaagttaaagtagaaagaaaatgtcctaacctgtagaaaggtatctatctacacatatctaccataaatattatgcttaacagtaaagtgttgggctgggctcggtggctcacggctgtaatcccagcactttgggaggccaaggtgggtggatcacctgaggtcaggagtttgagaccagcctggctgacaaggtgaaaccccatctcttctaaaaatacaaaaattagccgggcgtggtggcgtgcacctgtagtctcagctactcagggaggctgaggcaggagaatcacttgaactcaggaggcagaggttgcagtgagccaagatcaagccattgcactccagtctgggtgacagagcgagactctgtctcaaaaaaacaaacaaataaacaaaaaacagtaaagtgttgaaaacgttttataaaaaagtttttcttttaattgacaagtaataattctacatgtttatgaggtacagtgttatgtatacataatacatgtataccttgtggaatgatcaaatcaaggtaattagaatatctatcacctcaaatatttagcatttctttgtgccaaaaacatttaaaatattatctttcagctattttgaaatatacagtccattattattactacagtcaccttgccgtgcaataggcaccagaacttattcctcctgtctcactgtaacttggtacccctctccttgttccctatccacttctcccacctgcctccttccagcttctggtaaccacttctactctctacttctatgaattgaattctaaaagaattctacttagattctatacataagtgagatcttatggcatttatctctttgcacctggcttatttcgctcatgatgtcctctaggtccatctgtgttgtcccaaatgagagtttccttttttttcaatttgagacaaagtcttgctctgtcacccaggctgcagtgcaatgtcttgatctcatctcacttcaacctccgcctcccgagttcaagagattctcttgcttcagcctccttagtagctgggattacaggcacgtgccaccatgcccggctaatttttgtatttttaatagagatggggtttcaccatgttggccaggctggtctcggactcctgacctcaaatgatccacccgcctaagcctcccaaagtgctaggattacaggcgtgagccactgggccgggcctcagtttcctatttttcaaggctgaataggattctgttgtatatacataccacatttaaaaaacccattcatccattggtgggcatttccatatcttggctgttatgaataatactgcaatgaacgggggatacaggtatctcttcaatacactaatttcaatatctttcgatatatacccagtagtgggaattgctggatcacatggtagctctatttttagattttcgaggaacatccatactgttttccataatggctgagaaattcaccaccagcgacatgcaagggtttcccttttcaccacatccttgccaatgcttgttacttccatcttttggataatagccaatctaacaggtgtggagtggtatctcattgtggttttaatttgcatttctctgatgattagagatgttgaccattttttcatgtatctgttggtcatttgtatgtcttcttttaactgtctattcaagtcctttacccattttaaaaacaggtttatttgttttcttgttattaagtagtatgagttccttgtatattttggatatgaaccccttattcaatgaacatttgtaaatattttccacccattcatagattgtgtcttcactctagtggttgtttcttttgctgtgcagaagctctttagtgtgatgcaatcccatttgtctatttttgcttttgttgcctgtgctttagggatcgtatccaagaaatctttgcccagaccaaagtcttagaactttgccccaggttttcttctggtggtttttatagtttcaggtgttacatttgtctttaatccattttgtgttgattgttgcgtaagaggtgagacaaagatctattttcattgttctgtttgtgaatatccagttttcccaacaccatttgttgaagagactgttcttttcccattgtgtgttcttggcccctttgttgaaaatcaattgtgggtttatttctgggctgtccatcatattccattggttgatgcatctgattttagggtatatgtatttttaatgtgctccccaagaagtccttacattctgctgcattgacaaacctgtggccaagttttaggcctaggttctaattaagcttaattctggaggcaaagtctcggcggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacggtatggggttccccaaggccccagggccagaactcccttggcttccctgtcccctgggctggaagcacccttgtgtgccattgggaactttgcttatggactaaagggagggtctgggatggtgggtgggcagaggagggagtagaaaccacctcagccctcagagctatgctcttgtgagatgctcctcaaaggaattgcctactagggcaattgggcaccccagagcccttgtagatgaagcaataaggctctgagaggctgtgtaacctaccagagggcgcccctgttatgggagagctggcatctgcaaaatccaccctctctcctctccaccactgttgattccagccccttctgggaagatcttcagcatctataaaacaccgctttttcttttaaaatacaaaataaaattgtggtcattacagagatcatgtgctgcattggtaattgtggggtttgtcatcttagacaaaggatactgaagggggttggctgaaatcacctctaaaggcccaccagctctcagtgtccgtgtgccatgaaataaaaggattttgttaattgctatcatttttgtttcagttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtgtgagtcagctgggctgctctcagcatggggagggagactgggagggcctggtgcaatccaaaacgcgtgcacctgggatgctggtgccagccactgtgttaggtgctgcttcacatagctctgcatccttaataggagagaggtcctactgtcctcattttagagatgagggaactgaggctcagtattagcaacttcctagggttgcacagctaggacttggtggcagaaccaggtctcttggatctagggtcctcccactggagcacagcggtgtttcccaacaacatccccctcccccggggccatcttcagtgagctgtgctagttcctgttgttacagtcttctgctgttcttcctcagagccagggatacaaagggcttctccttacttcccctactctgctctgctcctcgccagagctgctaaagtcagcaaatactgctccaggctgtcagtcaggtgccggggctgtagggggagggagataatagaggacatggaggccacggtcttgcctaggaggatcttgcatcctggctggggagatagagtgtgcacagaggagactgtaacaagcaactcttattggacagcagatgagatgtccagtgcccaatgaaacatgccaacagtaagtgctctgggagggcccagtccagtgtgggcagagtctggcaaaggtgaaagtgactcctgctagatctgcaacaaatttcagtttgtgaaggacactcaacagctcagtgtcatttaagtctcaatgcagaggaaggcactaagtgggtatcaggcagtcttaagagtttttcatacattcattcactgatacatgaaatagttccaaatctcagctttacaacttttgaggtatatgactttgggcaaattacttaacttctatgtgcttcaggatcctaatatgtaaaaatggggctgatgatagtatttacctcctataagtataaaagttaaaagaatctgatggtattggtacatggtcagtgctgtgtacttcacaactaccttatgaggtcagtggctctgacagagtaattaatttgtccacaattgcacagctagtaagtggtgaagctgggacttgaacccagatctagcagcccccggagcctcgattcttacctgctgtaccatcctgcctcactgttctgtttgctgtgatgggagtcatgtgcagagagctggaagcagttagcgcatctcctgagggaatccttcagggcatggtttggaaggccaggtagggattcgcagaaacctagacacatctagagttgtggcctgtagtttgccttgggccactcactgaatggttcctgacagtgggcaatggatttcatgggaccagagtcctatgtccagaatcaccgtgccccatggtgacaggccacaaacacatctctctgggcctgcagatttcaccgtgaccaacgtcatcatcttctttgcctttgtcctgctgctctccggagccctcgcctactgcctggccctccagctgtatgtgcggcgccgaaagaagctacccagtgtcctggtgagtcttgcaaggaggtcactgccccgtccttcccagccacacccgagcttccaggagggcagggagctcttttcctcccagccagtccattgccttagcttgcctctgctctcagccctgatgtgattgggagataccttcatcaagcgctgtggggacagagggaggaagtgagcatgaagcccagtaccgagaatgttgccatccagtagctcagatgagacacatggaatcacaaatctcaatgaccacgagccattttgatatgatctactagtagttggccatggactagcccctgtgcattgcatctctgattatgaggcacagttattatccccatttcataagtgaggaaactgaggcacagagagattgttacacacagagggccacacagccaggaagagtcagggagggaacccactttcctactgctattagccatgggtgttccacaagagagaaagaaggaaaggccagaagtgctggtcctcgggctgctgccagagtgggccagaggagagaggacactggggggcggtggggatgctgcgccactggagaggggatgctggcaggggacagggaggggctcatggaggaggccaagccctcctcccctcccagggtgtgtcctcttgctacattgtactgacaaatgatacatttgtggcaagccagtctccaaaactcagcttgcaaagattgggcagcattttccaaacctcggcctggtctctggcctggagttcaggccgcattgaagattgcccaccatagcctccatagctggcactattgcatgatggctgagggatcagctgggaaggaaccagctccgtctgcaaggcaggggccccacaactggaaggggaatctccagagcgatcctgggatctctagggaaaacaagacgagagacaagtgcagtggcacaatctcagctcacttgcagcctcaccctctcaggttccagtgattctcctgccttagcctcccgagtagctgggattacaggcatctgccaccatgcctggctaatttttgtatttttagtagagacggggtgttgaccaggctggtctcgaactcctgacctccggtgatatgcccacctcggcctcccaaagtgctaggattataggcatgagccaccgcaccctgccccttctgtacttttggatcacagaactgacttgtccttgagggttttttctcttcaggataaatatagctcaatcccttcatctgatgatcgtagtcattaccacatgaataaattataatgcacagagcactgacacattcattagtttgttctcattcattagcttgtttgatttgatctttcaacagttcatcaaggtaagtattattggacaaggaagggatttcaaatcaggacagttgaggatgaattccagatgtgttctttactgttgtgccactttgtgcaagtcatttaacttctctgagcttcagttttctcctctaggaaatagaggtaataatacttctcttacagaattattggagggtaaagttcaattcaacatatatttattgagcaccttctatgtaccacactttgttctaagcactgtagacacattacaacataaggaggcaggtactgtcattatttccatgttacagatgaggaactaaagcacagagagggtaagtaatttggtcagggtgacaaagctgataagagtcagagctgggatttgaacccaggaagtctggctctagaggacacatcctaaatcaccaagcaatgtgataggaatagggactcaaccaataagagctgcatttgaatcatcatgtaccaaggaaatgagggcagatgtgcaacagtgagtcagtgagtcagtcggcagaccttaggagggcctactgtgtgccagctcagtttagactctggagacagggtagtaaacaacactagacagttcctgccctcaaggagtttgtgttcttttgggaatgtggagtaagtgagtgtgtgtatggtgagagacgaaaacaaacaagtaaaataattctaggaacaaagtgctaggaagaagtaacagggttaatgtggagagagtggcaggagtactgctttaggcaaggtattcaggaaggctttgctgaagaagtgacatctgagctgagacctaagccatgtacaggacacagccatataaagtgccgagagcatttcaagcaggagggagagtgtgtgcaaaggccctgaggcagcacggtgcttgatgtgttctgggacagaaagaacaccagtgtggctagggcagaggggttatgtggcttccttgaaacccttggcaattaacagagagcagccccttcactgtgagttccacacttgtgccactgccccacgctgcagccaccatgttcgcgtgagtcactactcggggaatagaaaacttaatttggtgtcttacatccagaattttagaaaatgaagtaggcaggagggcatagactgggatacaatagaataagaactgcagaaatatcgtggcacagctcataatgatgagtattattttgtgaaactggtttcagttatttacatacgggttatatatacaagtcattatgcaacttatttctgattttgagtcatagtcaaaaaagtttgaaacatgcttctagatgggtctagcctgctttcaggtttgaaaagcactgtggatggagccacctgagagttttcaccatgctcagcagaccttggttctgcctgttactccatctgggcctgagaatacaagtttcttgtgtatctggcctgagccaaactgggaattgcattaggaggaaagctggattcgaaaacaaaacagaatacattccagtgtaatttagactgtagtctcctccatcgagctctcctcctgggcctggccttccccggcagcactgggatgggtgctggaaggtgactcctgcttctctcactctgccctctcttccccagctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccacaggaa

SEQ ID NO: 132 - DNA, 30875 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccgggaggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttccccaaaagacccaagatcccaccgtggctgtcatctgacccttctggagactatcagttcaagtggaggcccccaccagtccccgagtgccctgacagccctccctgaccccaagtctgccccctcagtgccagccctccctacagatgtgcctcccatcacccgctgcacctcccctccttccggttcaggcccgagcaccctgaaatctggattctgtcccccagcgccccagctccatggcttctaaacctaaatccattgaaaccttttctgtcctctaaattgactgcctaggttccaataacaccatggtcacctccttcctttctcatgaactcttccctggccttccgggatacccctccggtttcccgccctgtcaggctgtctctgcttgggaccctcctgctctgtcaggtttctatgtagctaattgtgatgcccaaggccttttctctccttccctggcactgttcctttgggggatttcagccaaaccctggcattaaacacgggctataggcccatgactcgcacatttatatctctcttggtaccagttgggtgatgggtggtggtttattatagtcttctacttttctacttgcatgtaggtttcaaattttcttttctttctttcttcttccgtttttttttttgtttgtttgtttttttgtttttttgtttttttttgagacagggttttgctctgttgctgtggcccaggctggagtgcagtggcttgatcttgcctcactgccacctccgcctcccgggttcaagcgattttcctccctcagcctcccgagtagctggaattacaggtgtgtgccactacgcctggctaatttttgtatttttattggagatggggtttcgccatgttggccaggctggtctcgaactcctgacctcaggtgattcaccttcctcagcctcccaaagagctgggattacaggcgcgagccaccatgcctggccaggtttcgaattttctattaaaaggtttgaaaataatttctgtctctagcccacatctcttcttggtgtgacctctgggctcattcatctggctgtctccctgacattcctacttcagcctctctccagcatctccaacctaatgcagctcaaatgggactcgtgagttccccagctgagctccaatcggggcaccagctgcttaagcccaaaatggacattgacctcagcttttatgcatcaaatgtatcaggaagtctccagtttgtttttacgtctggaaatatatctgaaatccatgtgcccaccctaccccctcatagctttctgccaccagacaaatccaaggctcctttgtctgtccccattttactcctgcccctccagaaatttctcctcacggctgttcaaagaaaatctagactcctcagcacagccaacctgtctctccctccctcacccacgtggcctttgaagacatggagccatagaggagaaccaagtgctggatgtgggctttttcatgggcatctgttttgaggagaaaagttgtaaatgtttttgtcttattttcatagcattgggaatggtaccacctcccgaaaatgtcagaatgaattctgttaatttcaagaacattctacagtgggagtcacctgcttttgccaaagggaacctgactttcacagctcagtacctaaggtgggtctggcctcactattggcaggaacgcaccggaggagccagccctgggctggtcactgggttgggccacaggaggaagggagtctgactacggtcaccgtgtgactgtgacaaccctcagggagcctccctgccagccttttgctgtctgggaaattctcgtggccaccttttctcttttaggttttctagttgtgatggttgacgatttgactgttaatcacagggctgctggcagatacagacattttatcatgcgtatgtagatataatcagccatagtggtaacctcatgctgtgcccatcccagcttgtttgtcacagttgatatattttaaaagaaaaataccactgctgtcatctctaggtatgagtagtattgctggaagtcagcaatgttgagtggatgctacccaagaaactgagatatgcaaagcggtcaggaagccccttgctaccatatatcacctgttcccctccaatggattataacatcatgccccagtgccatgcgcgatgcacataatttgcataatgagtgctcagtttctccgtggttccatcctgaaattaaaagtaagacagctactgactgttaaaaaccccattctcggacaacagcaggggctgtgaaggaagagtgagtgtcaccctagacggtcatctcagtggtgatctgaacgccctctacctctcctgcctgtcagtgtttccctacgcctggtgaaggaagtcagtgccagcactcccttggcagcctgccaccatacgccacatgctggactgcaggtgacacacctttaggccaggcgcaaacagcagcaggaggcccaaggctgacaagccaacacacctgctttctgtgtgactcagaaacatacgaagatagacaagtccttcagtgaggcaggaggaaatttcttcccagatccagctgtcatttcacaaaaatccccaaggcctgctacatcagagaagaagtagaaaggtgaataagatagtcctcgtctgtgcattgctggcttttgttttttaacttttagttcaaaataattccagactaacagaacatttcaaaattttaagtagaatacaaagaatttccaaatagcctacaatcagattcaccaatttttttttttttttttttttttatgagacggagtctcgctctgtcacccaggctggagtgcagtggcgcgatctcggctcactgcaacctctgcctctcgggttcacgccattctcctgcctcagcctcccgagtagatgggagtacaggctcccaccaccatgcccagctaattttttgtatttttagtagagacggggtttcaccgtgttagccaggatggtcactatctcctgacctcatgatccacccacctcggcttcccgaagtgctgggattacaggcgtgagccaccacgcccggcccaggttcaccaatttttaatgttggtcacattctctcccttcctctctctctctcatgccctttgtgctgtaatatttcactgtgtatttcacaagaacaaggataatctcttacatcacatagtacagtgagaagctcaggaacttttacattcataaaatacttgtatctaatttacagtccatagtccagtactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgtttgtttgtttttcttttttttttttttgagacggagtctcgctctgttgcccaggctggagtgcagtagcgcgatctcatctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcctttttttttttttttctttgagacagggtctcactctgtcaccaaggctggagtgcagtggtacgacctctgctcactgcagcctccacctcctgggttcaagcgattctcctgcctcagcctcctgagtagctgggactacaagcacatgccaccgtgcccaactgatttttgtacttctagcagagatggggtttcaccatgttggccgagctggtcttgaactcctggcctcaagtgatccacctgcctcagtctcccaaagagctgggattacaggcgtgagctaccacacccagcccatgccatgcctttttgccattatagtcgaggcacttggctttgcatgtttatcttttatgttagcgatcccaatgacttcatgaagtgacttcatgagggtatccacacctgggttccaggtctcccccgcgtggaactacagagtgagtatggcatgtgctggagaaaacaaaatatgtgctggccgtgtccttggggaagatatttgatccctaaagatgtgattgcctcatgtggctctacaaaagagttgtttagagtttagcatgagcaattgcacagcacaaactctctgttgtttgcgtgcattggggcagggcgtccagagccgggggcacttcagaggatgtactggtgattttaatataaaaacatccaaaacaattagatgtaaatatgaggaatgggtcatattacctatttaatgcggggagaagtatttgtacatgcaataaaaataacctagtgaaggccaggcgcggtggctcatgcccgtaatcccagcactttgggaggccgaggtgggtggatcacctgagatcaggagttcgagaccagccttaccaacatggcaaaaccccatctttactaaaaatacaaaattagccgggtatggtggtgcatacctgtagtcccagctactcagaaggctgaggcaggagaatcacttgaacccaggaggcagagattgcagcaagctgagattgcaccattgcactccagcctgggtgacagagtgagactccatctcaaaaaaaaaaaaaacctagtgaaaaagatgttattgcaaaacaacttttgaaatactgcacatgctggacaattgatgcattagtttaaaagaaggaaatgggccagtaatcccagtactttggggggccaaggtaggataatcatttgaggccaggagttcaagaccagcctgggcaacatagcagcctcttgtctctacaatttttttttttaattagctggacttgagttggaaagaaggaaggcggaagggaagaaagaaggtagggaggaaaaaaaatatggccacatgtgagaaaacccccttaatgaaatgaccgctggattttccaaatgatgggatgttaagcagccgtgaagaaatggttgattgacaaatatttgtggtatattaagtgaaaaaatagcatgatcccaatgatctctatctactttttgcaagggatttttctaggtatcactaagaatgctgtgagatgtgatgtgctaccttagactatgaagtcaaacagatctgagttcagttgggcagatttcttaggctctccacgcctgacccctgtgtacttaataaatgttggctgttgttatttttatcaccatcactttcatcatcacttctgggagcaaccaaattggttttggcaccagaagatgtcttgggggaccaatcagatagctcctcacttttttattttattttataaatttttaaattaaattaaattaaattttttgagacagtgtcactctgttgcccaggctggagtgcagtggtgcaatcacgtctcactgcagcctccacctcccaggctcaagcgagcttccctccttagcctactgagtagctgggactacaggcgcatgccaccatacccaaataatttttttattttttgtagagacaaggactcaccacgttgtccaggctgttctcaaactcctgggctcaagtgatcctctgcctcggcctcccagagtgctgggattataggcgtgagccactgagccgggccagctcctcactttttgcaggatgagagcctgggcttcctttgatcacgtggagccaattacacctccttggctgttgcgagcttagattcaggagattgtatttccctagcatccaacaggcatgtccaaatgtcatctcttttcttccacttcactttctgtcatgttccctttagcggttgctgtcggggctggtgttctgactgagactgatgaattgttttataatttttccagagtaattgcaatgatagtcatttataggacaggacagtcacgggtcacttaacaactggggtagattctgagaaatgcatcattagacagttttgctgtgtgaacgtcatgcagtgtacttgcacaaacctagatggtgtagcctcgtatacacctaggctatgtggtttagcctattgccccaggctgtaaacctgtacagcatgttactgtactgagtgctgtaggcaatcgtaacacaatggtatttgtatacaggcatatcacagagataaggcagttttggttccagactaacacaataaagctaaaaccacaatagagtgagtcacatgaatttttttgtttcccggtgcatctaaaaattatgtttatactgtagtccattaagtgtgtgatagcgttatgtctaaaaaaatgtgcacagcttaattttaaaatatttacttgcggaaaaatggtagcaatcatcagagccttcagcaagtcataatccttttgctcgtggagcatcttgccttgatatggatggctgctgactgatcagggtagtggttgctgagttgcagtgactgtgacaatttcttgaaataagatgacaatgaagtctgctgcatcaactaactcttcctttcatgacagatttctctgtagcatgagatgctgttcggtagcattttactcacagaagaacttctttcaaaattggaatcctttcaaaccctgctatcaactaagtttatgtaatattctaaatcctttgttgtcatttcaacaatgttcatagcatcttcaccaggaataaattccatctcaagaaaccactttctttgctcactcattagaaacaactcttcatctgttcaacttttatcatgagattggagcaattcagtcgcatcttcgggttccgcttctaattctagttatcttgctgttttcaccacatctgcagttacttcctccactgaagtcttgaaccccttaaagtcatctatgagggttggaatcagcttcttccaaacccctgttaatgttatattttgacctcctcctatgaatcaccagtgttcttaatggcattttgaatggtgaatcctttctgggaggttttcaatttaccttgcccagatccatcagagaaatcactatctatggcagctataactttacaaaatatatttctttattttattttatttcattttattttattttttaagatggagtctcactctgttgcccaggctgaagtgcagtggtatgatctcagatcactgctgcctccacctcccaggttcaagtgattctcctgcctcagcttcccaagtagtgacaccacaccaggctaatttttgtattttttttttagtaaagtcagggtttcaccatgttggccaggctggtctcgaactcctgacctcaagtgatttgcccgccttggcctcccaaagtgctcagattacaggcatgagccactgtgcccagcttcaaaatatatttcttaaataataagatttgaaagtcgaaataactccttgacccatgggctacagaatggatgttgtgttagcaggcatgaaaacagcattaatttccttttaaatctccatcagagttcttggggaaccaggtacattgtcaatgagaggtaatattttgagagaaaactttttatcctgagcagtaggtcttaatactgggcttaaaatattcagtaaaccatgctgtaaacagatgtgccgtcctccaggctttgttgctccatttgtagagcacaggcagagtagatttggcataattcttaagagctctctgattttcaaaatggtaatccagtgttggcttcaacttaaagtcaccagctacattagcccttaacaagagtcagcctgttctttgaagctttgaagccaggcattgacttctcctctgtaactatgaaagtcctagatgacatcttaatagaaggttgtttcatctacattaaaaatctgttgtttagagtatccaccttcatcattttagctagattttagctagatcttctggataacttgctgcagcttctacatgggcacttgctgcttcaccttgcacttttatattatggagatggcttctgtccttaaaccttatgaaccaacctctgctaacttccaacttttctttttttttttttttttttttgagatggagtctcgctctgttgcccaagctggaatacagtgacacaatctcggcttattgcaacctctgcctcccgggttcaagtgattctcctgcctcaacctcctgagtagctgagattacaggtgcatgccaccatgcccggctaatttttttgtatttttagtagaggtggggtttcaccatgttggtcaggctggtcttgaactcctgacctgatgatccgcccacctcagactcacaaagtgctgggattacaggcgtgagccaccacacccagccccaacttttcttctgcagtttcctcacctctttaagccttcacagaattggagtgttagggtcttgctgtggattagactttggcttaagggaatggtgtggctggtttgatcttctatccagaccactgagactttctgcatattttcaataaggctgttttactttcttattattaatgtgttcactggagtagcactttaaatttccttcaacaacttttcctttgcattcacaacttggctaactgtttggcccaaggggcctgttgtggcctgcaatatgccttcctcactaagcttaatcctttgcagcttttggaatagggatgcccgaggagaaggagagaggcaggagagtggacagtgggtggagaagtcagaacactcacaacatctattgattaatttcactgtcttatataggtgtggttcatggtaccccaaaacaattacaacagtaacatcaaagatcactgatcacagatcaccataacacatataatcatgatgaaaagttttgaaatattgcgagaattaccaaaatgtgacataaagacatgaagtgagcatgtgctgttggaaaaatggcaccaatagacttgctcaatgcagggttgctgcagaccttcgatttgtaaaatgcaatatctgtgaagtacagtaaagcaaatcacaataaaatgaggtatgtctacatctaaatgtatttaaacatagaaaaggtacagtaaaaatacagtatcattatcttagggcatcaacgttgtatatgtggtctgtcatctaccgaaatgtcattatgcagcacatgactttattgaaaatcattgtaatatctttattttggtaaatttttgtaaatcaatgtctcataaatcacatgcccctgttttcaaaaatacgtaatcaaggaagcaagctttcttggtcaagtatgctgaatactcaaccccttggagaggcacgtagtcattaagatgttcaagtctctgagaagttctgttttgaagacacgtatttctatgtttaacacagtttccactcccgcgccgcccccccctccaaattaagtaccagtcagcctcagggagactgaagccagaactctcctgattgacctatctttttgattgtgtagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacagtaagccattttgttttccctttttttgtaatgtcatcatcttgccttgtttttttccacattggttggtccatcaacaagaattctttgagggcccacaaatggatggccttgcacaaggagcttaaggaatataataaagagagttgtatccctaaagaattcatgggagagacagaaaaagataggcatatcatcaatgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatgatgcggacagccggcttgcccagagcgaaggacagagggagggatagggctgatggcaggtgggttgggtcagactggttggtcagcatcaaaaattgttcccaggttaggtggagattgcagtgagccgagatcacgccactgcactccagcctgggcaatagagtgagacttggtctcaaaaaaaaaaaaaatattgttcccaggttagatttggagggtcatggtgaccaccagagtcccctaaatatgagatgagcatatttagaatatcaggaattgaaaactaattaaaccatatattagcaattgagagagtaaagaagattagaggttaaaagaacctaattcacaaaattcacatacagcccttcaaaactcacatagagaaaagcactaaaagaattgtctctggctaggcatggtggctcacgtctatgatcccaacactttgggaggctgaggtggtggatcacttgagcccaggaattttctttttttctttctttctttctttttttttttttttttttttgagacaaagtctcactctgacacccaggctgaagtgcagtggcgcgatctcagatcactgcaaactgcctccagggttcaaatgattctcgtgcctcagcctcctgagtagctgggacttcaagtgcctgtcactatgcccagctaaatttttttgtatttttagtagagacggggtctcaccatgttggccaggctggtcttgaactcctgaccttaagtgatccacctgcctcagcctcccaaagtgctgggattacagacatgaaccaccacacttgtccttgagcccaggaatttaagaccagcctgggcaacatggtgaaaccctgtctctacaaaaaacaaaaaaaataccaaaaaaaaaaaaaaaaaaaaattagccaggcatggtggagtgtgcttgtagtcccagctacttgggaggctgaggtgggagagtcatctgagcctgggaagtcaaggctgcagtgagccattatcacaccactgcactccagcagcctgggtgaccagagtgaagtcttatctcaaaaaaagaagtgtctctatatggggagtggtctttatgccggtccctgctctggacccccatgacccctacagttacatcctccctggtagagaatgatgctaggatgcctttcttccctttcccaattccatcccaagcctgggtaaaaacgtcttacttttggaatcataaattatcaaagttagattatattttctaatggtacctttacaaaaacaaaggaaagatgaacagaaaagtaagtttcacaatagttaaaagtacaagtttttgctcctataattgctaactggcttaccaggtcctaacttgtcccaaatcctgttagctcccatccatggaagttccctttagagcctaggtacaacacggttaagcagcttgtcaaaaagtcatacaggtcatgagtggctgagcaaggattcagacccaggctcttgcttctgtgctcttagcaactactacccaatattggagatttgcctcttgaagtctatgtattttagtgataggaaagtgtttccaggcatcatgcataacctatttatacttgctttggcaaagtattccaacaagttttcttgtctggttttcagacgagcactttagaatgatggaagcaggtccattaacagccctgaaaaagtaacagcagccaaagaagaatacaggacataactcaaacaccatgattgcctggaaccatttatgaatcattctatagttattattgagtacatctgtgtaacagctgcattctgagcactgaagctacaacaatgaacgagacaaaatacctcatggagcatatatgtgctaatcaggaatacagataataaataaatagatacatattacatgacaggtagtgactatggttcttaagaagactgaagcaaggcaataggacagaaagtaatgggagctgcacttctacatagaatggtaagatacagtctctctgaggaagtagcatttgagcagagacccatatgaagtgaaggagccagccacatgaatatctagtaaaagagcattcagaagggaaacagctttagacattgttggaaatatatatggttaattatatatgttaaacatgtaaaggtggccactaaaaataatagagatgccatctgtagcttccatcctgaaaaaggaaataaaattcaagccaacaaaaagcaggaataaaagaggagaagacaccaaaaacataaaatagaaatttaaaaagaaatccttatagaaaatacaaaatagcgtagctggaataattccaaatgtatcagaaaccacaataaacataagtggactaaacttcattaagaaagacaaagattatcagattttttaaaagaaactaaatccaactacccttcttagccatgtcaatcaatgtcatgacaatagtatatcaaagcagtgtacttccgtggactaattgttctgcatggttatgaaaaattaatgttgaagtttttaaaatgtgatttttgattgtcattttgcttgttcttctgcttagccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaaggtaaggttggctaattgcatttcagaggtagtaggctttcatattctttgcagaatcttgcaaggtggcagcaccttatggactggtcctctgtaagccaagagcttcccagactgaggggttactggtatctctggctcaagcttcccagactcctaagggatatgtgtagagcagactttcaggacaaagtctgcacagtgacagcagacctttccctccctgaagggcagctgcaggggaaggcacagttgagtcagagttagctaagggaacttggagctggctgaattaggtgatcagcaaattgacaactgtcccatgacatcaacccctgtgtcccacacacaccgcaaatcagggacgtccgtggtcaagacagccccttgttgctctattcttcaggggacaatttctttaaaaacatgggcttggagtcaaaagatctgatcggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccattgcctggaatgatgtatatatggtcagtacatcagtacatgaggtttccttcctctttgctagacatgttaaggttatttttattcatccttggtcaaggtttattctgacacctaatgcttctgagctgaatgccattcatggtcctaaactgacatatatatgttatgtatgtcatattacatatatgttatcccttccacattaaatgttgattttaccacttaattctcaaagtgtttgggaagaagggatcacccatgtttattatcttaggaatgatgtagttaaatttatatacacacactgcatagcccaaaaaatctcaagttaatttttttccccaaaaaatgttccattaaatgatgcagtgtcttagtcctttcctgctgccacaacaaaataccacagactaggtaacttataaacactagaaatttatttctcacagttctgcaggctgggaagtccaagatcaaggcaccagcagattcagtgtctggtgagcactggcgtgctctgcctcctagatggtggaaggcaaagggcaaggatgtaaacagctcccttgctgctcttttctaaggtcaccaatggcattcaggaaggctctgccctcattatttaatcacttctgaaaacctccacctctgagtcctatcatagtgacagttaagtttcagcatatgaattctgatactcacaatcactgatcaaatgcaggcatctctgctaagccctggggtataaagataagagcagattgctcccctccgggagctagcaacagacctcaattaaggatctagttttacagtgagcagggtcaggtgcctcctgaggcaagtgtgaatgcaaactccacttactgtttagcttcttttctcacacatgcccacaacatgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgtgattacaggcatctgccaccacaccccgctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtagaggcatataggcatgctgtcaacgaccccaaccccaaaaaagaactaaccaattgcgactgggtgtggtggctcacacctgtaatcccagcactttgagaggccaaggtgggcagatcacctgaggtcaggagttcaagacaagcctggccaacatggcaaaaccccgtctctacaaaaatacaaaaaaaaattagctgagtgtggtagtgtgcacctgtattctcagctactcgggaggctgaggcaggagaattgcttgagcctggcaacggaggttgcagtgagccatgatcgtgccactgcactccagcctggacgacaagagtgaaactccatctcaaaaaaaataataattaaaagaccagtttattttatttatttatttacttttttctttatttctgagacaaagtctcgctctgtcaccgaggctggagtgcagtgtggggtgatcctggctcactgcaacttccacctcccaagttcaagcgattctcgtgcgccaccacgcccggctaattttttgtatatttagtagagatggggttttgccatgttgactaggctggtctcaaactcctcagtcccccaaagtgctgtgattacaggcacgagccaacacacccggcctgctttatcttttttaaaaaagaagtgatggcttgtgtgtcatttaagctggagaattcaggaaccaaaatggtttgtgggcaccactgtcagtccttgatgcaccccctgagtggcctcagggtccctgaactgagaggagcacctgctacctgctccttcctattttaagtctaaaacggctattatcactgataaatgtgaaaaaaaaaaaggtggtgcccttccactgcttagtcatgttcttatttttgtctccattactagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacggtaagccctgagatgcacctccgctaagcatcctaaacagctttatagacacctgccctagacatgattgcatccaactcaaattccagctcagttcagaaatctatcgccctgacattatctctcagccctgactgctcagcttcatgctaggaaggagaccacacccgcttctgaggcagctcattcactcttagatcaaaggagttgctagaaaccttttctgtctggtggagcgaggtctgcctccatgagccccccttggcagtacttattctaccatcccaggctccctaaagcaaggctcatcagtcctcccaagaccaccagcagagctcaagccctgtcacataccccaaaggtctttcctccccaggcggcacatctccagccactgccgacatgtgatgggaagcaagtgtcaggaaatctgaccacggtcctcagccagtgctgcctgattcagggccccttatatgcaggaatccaggatgtcaacacagtccttcacacaccatatggatcacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcacgcctgtaatcctaacactttgagaggccgaggcgggcggatcacctgaggtcaggagtttgagaccagcctggccaaaatggcaaaaccctgtctctaccaaaaatgcaaaatttagccaggtgtggtggcgcacacctgtaatcccagctacttgggaggctgaggtgggagaatcgtttgaacccaggaggcagaggctgcagtgagctgaggtcatgccactgcactccagcctaagcaataagagtgagaccctgcctcaaaaaaaaaaaaaaaagaaaagaaaacatttcaaatagcttgcaaataccagtaatcacccatgaactgacaaaatccaaacattttacaaaacaaaagggtatgagccattgaaaacctgctttcatcaaacaccattttcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccgctatgcttcctgtacagcctgcagattcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcgaactcctgacctcaagtgatccacccacctcagcctcccaaagtgctggggttacaggtatgagccaccatgcccagccatccagttttagttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccttgtggataaaacaggaaagagtagtctgcctcatggtgtggtcagatgaatctgaaacaagttagagaactttacacggaggatgtagattagtagattctcccacagttcacaacctatgcagagcagggtcctctctcctgccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaagacctgggatgtcaaatcccaaggagacctcacgtgtccagctgtggtgtggactgggggccgctccagccagctcactgccgtatgaccctggaatcaccaagagcagactcacatgtttgagctgaacatgctggaagtgtgggccagacggcaccgcttctgggctccggtgcatgaaacaaacaagaaccaagaactgggataaggagtgctgaaacccgcaaggacaggagctggggagatgggaggccgcctgcgggaatgaaagcacaagagaacgagggccatggggttgggggcggcacaagtgctcaggtccttccagccgcttccctcatacagatgccacttccatccctcagacgtttaaggagtgtgcactgtgagccacgcactgtgacaagcaccatgtcgtgccagcaggtgactgcacttgctgtagctccagggtcatgtgctgtgtcagggctctttgatccctgtgtccctttaaaacgacatgatcttcatgggcagtgtttgttctcttggcccctctcagagccaaatgctgtgctcgtgagggcggtgctggttggcaggggatgggcacagagaaatcaggtggccagggcagctggaggagggacctggagccgaacaaggggagctgggaccacgagcaacccaggtgacatcctggactctgtcaaagataagcaaagcaggacgctaattaaagcagtcaaaacattttattcagtaatgactggagttgggaaaagggccgagttccatttactcagaggtgttttaaagggagaacgagggccggggcaggaggatcgcttgaacccaggagttcgagaccagcctggccaaaatagtgggacccccatctctataaaatattttaaaaattagctgggcatggtgacacatgcctgtcgtcccagctacccaggaggctgaggtgggaggatcacttgagtcctggaagtcaaggctgcagtgagctgtgtttgcactactgtactccagcctggacaacagaacaagactctatctcaaaaatgaaaataaataaaaggagaatgagggagtagaaagaaagaatgcgtggggagttgagcagaatcagggaagtgaaaaaaattttaaatcagctaaggggatgggtcagtgccgtgaggccctctgtgtctgtgaaccggtgtttatcaaggctaggcttctaccctcccacagagacagggagacagaggccctgtacttcctgatgatttcaaaagaatggctcgcagatcattgagaaaaatatccctgcgttgtgggagatacatacatgtctcaaagggacagaggaaggattcaccactataagccctttttaataaatgctctccgaaagagaggtcaaggcctcgcatcaggggctgggaagaacaaatggtaagttccttaggcagccttgggtttttccagacaggaattcaagggtgtggccttggcctgctagaagctatgctggggtttggccaagtctcttagtgcaggggtttgtttgttttggctttggttttggtttttgaggcggggtttcactctgtcgcccagtttggagtgcagtggtacaatcatagctcactatcacagcctcgacctcccaggctcaagcgaccctcccacctcagcctttcaaattgctgggactacaggtgtctgccatcatacccagctaatttttaaaaaattttttttgttgtagagaaggggtctcactatgttgcccagactggtctcaaactcctgggctcaagtgatcctcccacctcggcctcccaaagtgctggggttacaggtgtgagccaccacacctggcttagtgcaggggtttggatagagttgttcacgcagagtttctgtttttctcaatatagaacgagatggtgcctgtgtttaactcaggctcaggtgtccaggggagtatcacttgctgtgtcaaggcagaagtggtatatccagacctgggaggcccattgctacactgccagtagtaggtacagtggatcagaattcttgcttgttattcttttgatgtatgtcagcaataattccagaaaccaaactttggagaagataggaaaagggtgaaactcttcaaaaacctctgggtcctccaaccagttgctgtttctgagacgtcccccaagataaacgtacaggctctgttttcagggattgtgatggttaaaatgctcttgggatcactgtgacccgacctgtgacaagaatgtaacatgcccattacccctggcagaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagaggtaggtaggatggagtgagatgtggatttgaaaaccttgatcggaaagagctttcctttctagttagggctgcccaattccagacaacatgttttccaggaaaacacacacgcgcgcgcgcacacacacacacacacacacacagacacgcctcttgtgtgctggtccattctcttgtaaccatgtcaggtgaaggaacagccccgaggaaaggggcgcggggttgtccagtatccctctctgcacctagggcatcgctccttctccagccttcactgcccaaagccccaggtccctgaggagcaaaggtgatggttctagggcaggaggggaaaaacagagctcagtgtggaagaaagagaaaactggaggctaaatgccaggaaatcaccagagggagagaatgggaggaaagaaaggaacatttccagttttggaatatacgagagcgattgaaattctgggtagtgtttcctggactttaggaaggctatttgtaaaagggttaggaagaagaaacaatgcacctgactaatgataacaggactgaagaagccctaagaaatgaaactctggatagtcactgacactagagaatgaaaagattccaagcccggacccaaaggaactatctttggtctcatttcccaggaagcagactctaagatagagatttgtattcaaaaggcttgatggggaacatccttgggaataataccctaaaggagtgaaggtagccagatgtggcagagagaggttgagctgtcacacagccacaacagaggcctcagccaatcccatgtggcctctcgagctggggtggccctttagagatgtcctaagctgaggcaagagggatgggcgtgtgaactccacattggccatgcgctggatgtgggctactcccaggaaggggccctaagctagggtgagaggtgagacagcagcagccaggagctaggagcacgagtgcctcattcctgaaggcaccacagcctccattacagtcacccctgggaccacttggatctactggaagcagctcctccaggatctgagttgatctcgtttcctggggagggttacaggaggaagatgagtggaatgcactccagcccccaccgctgctgctggtgtcgggaccacaaaggaatgcttgtgggctggctccttcctccgctgccctgagggcccgctctcctctcccgggaggagcctgtgctgtaggggctgctgacctgattgggtgacccagccctcatcccagaaagcactgagcctccggtccccaagcccatctcaggcaatggcctgtccctgcacttgtcaatttgctgtcaaaatcgggcaggggagtcccaggaggtgcccagtgactctggcgggtacccactgtgatacagtggtgacttctctcttgcctgccagtctcttggcctgaggaggtggcttaaagtttatcgggccttgtttcatgtcccctggtagaaatgctcccactctgggaaccttctagaccaggtgtcagcaaactttttcttaaagggccaggtaaaaaatattttagaaggccaggcacagtggcttatgcctgtaagcctagcactttgggaggctgaagtgggtggatcacctaaggtcaggagatcgagaccatcctggctaacatggtgaaaccccgtctctactaaaaatacaaaaaattagccaggcgtggtggcgggcgcctgtagtcccagctcctcgggaggctgaggcaggagaatggcgtgaacccgggaggcggagctggcagtgagccaagatcgcgccactgcactctaacctgggcaacagagcgagactccgtctcaaaaaaaaaaaatacaaaaatacaaaaattaacccggcatgctggcgcatgcctgtaatcccagctactcgggagactgaggcaggagaatcgcttgaactcgggaggtggaagttgcagtgatccctcacaccactgcactccaccctgagcaacagagcgagactccatctcaaaatttaaaaaattttaaaatttatatatatatatttgaggttctgttggcaagaaataaaaatcaaaattatgtagtcacttatataaccacttaaatataatcatttaaaaatccgaaagccatgtgaaaaaacaagtggtaggccggatctgccccgtgggcctttgtttgctggccctgccctagacccacagagcctcaaatcacaaggccagggagcagcggtttccccagtaggtcactgggcatgatgagggtgaacagggccactcctgccctgcgcttgcttcctgacgcaggtgttccacctgctggggacacagccccacatgattgttggtcttgggtgcatgccaggggctggaggacaatgccttgccctcaccaggtgtcatctccaagctggcgcctcccctgcactttcaacaggccgctccgtccttcttccagtctggcagctgctgggtggtgcagggtgggatacgaccaggggggtcccgccttcactgtcagtgggcccattggtctggcaccatgtgatacggcgtctctactagtttgtcggggctgctgtagcaaagtagcactcgttgcgcagctgtaacaacgggaattgattctctcacggttctcgaggccagacgtccaaaatcaaggtgtcactaggatggtttccttggaggctgtgagggaggatctgtcccaggcctctaccctaacttctgagggttgctggcgatctttggcgttccttggcttctagaggcatcacccagtctctgccttgatcttcacaagccttctccctatgtgagtgtctgtgtccacattgcccctcctttatacagacaccagtcacgggaggagggctcaccctgctccactataccctcattctaacttaactgatcccctctgcagcaaccctatctccaaatacagtcacattctgaggtagagggattaggacatatgaatttcttttttttttggagacggagtctcactctgtcacccaggctggagtggagtggcatgatttcggctcagtgcaagctccgcctcctgggttcaagtgattctcctgcctcagcctcccaagtagctgggattacaggtgccctccaccacgcccggctaatttttgtgtttttagtagagacagggtttccccatgttggccaggctggtctcaaactcctgacctcaagtgatctgcccgccctggcctcccaaagtgctgggattacaggcgtgagccacagcgcctggcccagaacatgaattttgtaggaacagaattcaacacctaacaggatcctctaccaggagagaaaacacctgtgaaaccttgggaatcctgacaggccctgcaggacacgaacagcaaatcactcctaaactaaaggttagctccagccaggatgcaccactgccccttccagagtggtgcaagagtcgacgtcatcagcttgctaccaggtggctggtcagtctcctcggggaatgccgtcatatcaggggctcagcattgatctctgtcgcaggcaggttggacattccacagcagtggtggctacccagccgtgggagtgggagccccttctttcaggcccacgcgcagcctccatccctgccaccacggctgctgtgttcatgagccctgtgccatgtacaggtgaccagtggcagaggctggctgacatccactggctgtgtcatcatgtctccctggctgtctgctgtctatgatacatgctctcagtgggagttaatatgggatgcagaaatctccacgctccagctactccctcaggtccatccttcttcccaaacgtccttgtccctaaccttccagtcttccttccccagggcccctgaccaccaggcttgtcactaacccctgcctgggatcccacagctggcctgatcttgggctgcttttctttccacataaaggtgatgatcagacccacggcccaaagctctgcccgtggggacactttctccctggttggggctgaagtgcagcagcgggccactttcggtgtgtgcccacataccatgctaaccttgccatgaaaccaggccggcctttcctcctacttctgctaggcataattacccatccccctttatggtcatcatgtgagcagacacagacacggtgcgacaggggtagaggggacaggagtccgagccacctgcatgtggccaacatgcaccctctgaccccatctcaggacctactgggtctcaggcctcatgatggtcacttctgggcagcaccatcacctcgcgtccctcgtcagaagctctgtctctgccgggaccccatagcgtcccaggagctgctttttcaaacagagtacaattatctgctgcagatggccccgcctgaccccagaactctcgtatctatgttgtgactttcctcttgggatttgccataaactccacccagcatcttttcccaccccagacacttcaaggatatgcgaagtcacacattccccaggttggattcacaggccgtccctggtgggtaatgtaccagtcctgaggtgtgcatagggctgcaggctgcacggcccataccttctgcagggccctttcctgcctggggcccctccgtgccagcagcctcctgtgtggtttgataaacatattggaacagtcagtattcctaggcgtggaacatgctgcctccagaaccctgaggcctccacagcacaatgcttccttcctagtggtgggaggggcaagatacaataattggtcctttaaagaggatgtcctggcatgccccactgcaagggtcccctcaaatatcacagatgtggcaggtccctgaatctctacagggtgagtttctcaccctctgcagtgtgtgtgcctcaccaatgccttgccacttcttggcgtgtctggtcctattaatgtattgttgtgatagctaatatcaggcccttgtccccgcaccaccagtcagctgatgcaggctgcctctggcaagggcacagagccttgaccgaggcaactgccttctgggaagggcacagcctagaaagggactcagctgtgagccatttcagcctccgatattcctggaggctgggggaacaagcgcctcctccacaaaagggatctgggcaacatagcactgcatctaccctcgatggcaagtggggcacaggaccataggcaagtgtttcagagcgactagaaccccctacagagagtgccaggccgagcatggtggctcacacctataatcccagcactttgggaagccaaggctggcagatcacttgaggtctgaagttcgagaccagcctggccaacatggtgaaaccctgtctctactaaaaatacaaaaattagccacgcctgtaatcccagctactcaggaggctgaggcacaagaatctcttgaacccgggaggctgaggttgcagtgagcagagatcgcgccaccgcactccagcctgggcgacagagtgagactcgatctcaaaaaaaaaaaaaaagtaccaaggagactgcagcaccagcatgaactaagaatcctctatgagcttttgagaagccacagctgcagcaggaagaacaaagaatgagggtgggccctttgcttgggtaaaaggtgttgtgttaactgagaaccaaaaggaaacaaaattattcacctgctatttttgcttctggcttcaccatcagagaaactggtcagacaggaaagaacagacggaatgaacggtagaggggcctgctggcataagctctcacctccgaggctagaagactttgcagacttgaccgtggagccagcccctgtaagatctgagaaatcagagatgggagtggagggtgctggagaagggccaggcaactacggagcagttcgaggtcctcacatcacgactttctccagcttgactcataatgatagaatccattaaccaggatccagaggatcatttcgagttcagggagatttgctaggaatggagactttgagttaaaaaagcactagggaggttcatcctacactgatctattgagccagccaccagtttgtgtgtgtgtgtgtgtgtgcgtgtgtgtgtgtgtgtgtccaaccgggagactcagctgatactgcttccttgagatttaatacaccttcctttgatctctcctgtccccattatcccaggaaaatccagagtagcttccagtccattctcattaatccactggatccaaagtttagagaggttccccttccctccagcctccttcctggcccaacagaggagcaccccaccaccctccatcagctgctcaaaacccacaagggaaaaatccctacaggtccatgccaggaggtagtggagctaccctcaggttccattaagtcataccagaaggctgagtgtagaaatgacattaagaggggttccatctgtagggaaagggttcaagatgcaaagctttacagaaggttctccgtctaattgtgaagattaagagcactggtggacctaggaagatgaagaatggagagtgggaaaccagcagagatttcaggaaatgtataggggcatcttcatcgttcaaagcaccggagagacaaagattattagactgtggtccctgcccttaaggagccctggctacaggtgacacaaactgagaagagttggtgtctattaaaagtgagaaggcagctctgtctgatagagcatattgcaagccatgtgtgttttagatttgctagtagccacatttttaaaaagtccaaagattgggccgggtgcggtggctcacgcctgtaatcccagcattttgggaggccaaggtgggcagatcacgaggtcaggagatcgagaccatcctagctaacgctgtgaaaccctgtctctactaaaaatattagccaggcaaggtggtgggcgcctatagtcccagctactcgggaggctgaggcaggggagtggcgtgaacccgagaggtggaggttccagtgagctgagatcgcaccactgcactccagcctgggtgacagagcaagactccgtctgaaaaaaaaaaaaaaaaaaaaagtccaaagattggccgggcatggtggctcacacctgtaatcctgacactttgggaggctgagacaggttgatcacctgagatcaggagttcaagaccagcctggccagcgtggtgaaaccccatctctactaaaaatacaaaaattagccaggcatggtggcgggcacctgtagtcccagctactcaggaggctgagggaggagaatctctggaacctgggaggcaaaggttgcagtgagccaaaactgtgccactgcactccagcccagacgacagagcgagactccatctcaaaaaaaaaaaaaaaaaaatcttcgtttgtatagcagtgagtatccccacttgtaaaaaaataaaataaaaataaataataaatcaaaagatgccagaggccgtggctcacgcctgtaatcccagcactttgggaggccaaggtgggtggatcagctgaggtcaggagttcaagaccagcctggccaacatggtgaaatcccatctgtactaaaaatacaaaaattagctggcgtggtagcacatgcctgtaatctcagctacttgggaggctgaggcaggagaattgcttgaacctgagaggtggaggttgcagtgagctgagatcgtgccactgcactccagcctgggtgacagagcaagactctgtctcaaaaaaataaaataaacattaaaaataaataaataaaataaaatagattttccagccaggagttctgtgaaaaaatctttgtaaacccagaaaaagaaatggagaaaattgatcattaactgtcctctttccctccacagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgata

SEQ ID NO: 133 - DNA, 35645 bp, Homo sapiens
ccaggcacgtgcacagtgagtttgtgtaaatccagttagaccaaaatgagcgaggtggagagcctcttaaccggatgctacgggtgatgactgggaggaggagaaaaattacctctttatcttgcatgaacatcttaattttcaggtattgggcgtcaggcaaagataattaaagctatgtccatgagtcttatcccttgaggccttgtccgcttgatattttctttgcctaactcacttttaaaattttattatttttatttttttgagacagtgtcttggtccgtcgcccaggctggtgtgcagtggcgcgatctcggcttactgcaacctccgccccccgggttcaagagattctcctgcctcagcctcccgagtagctgggattacaagcatgtgccaccaagcccggctaatttttgtattttttagtagagacggggtttcaccaggttgaccaggcaggtctcgaactcctgacttaaagtgatccacccacctcagcctcccaaagtgctgggagtacaggtgggagccaccgtgcccagccctaactcacttctgaagttgctgctacttgcactgatttcagtttttttttgtttttgttttttgttttcaaggtggagtcttgctctgtggcccaggctggagtgcagtggtggtgcgatcttggctcactgcaacttccgcctcttgggttcaagtgattctcctgcctcagtttcctgagtagctgggattacaggcaggagccaccatgcccggctaaaatttttttgtatttttggtagagacggggtttcaacatgctggccaggctggtctcgaactgctgacctcaagtgatcttcccgcctcaggctcccaaagtgctgggattacagacatgagccaccacacccggcccacgatttcagtaatttctttgtgttcagtaaaactaaaaaatgactctgggctgggtgcggtggcctgtaattgcagtgatttgggaggccgaggcgggtggatcacctgagctcaggagttcgagaccagcctggccaacatggtgaaacccccgtctctactaaaaatacaaaaattagccgggcgtggtggcaggcgcttgtaatcccagctattcgggaggttaaggcaggagaatcgcttgaacccgggagaagggggttgcagtgagccgagatcacgtcattgcactccagcctgggcgacgagcaaaactcggtctcaaaaaaagaaaaatcattctgtcattctggccgctgtttgaagaatgcgaataatgcaacagggagatcagatacaagactggtaaccgaggtgtcagagttgagactcagtttcgcagattgcattggcaagtgaccaagtgggtggtgccacggttgacaaccctatttcttacatcactgagtggatgtacaaggattaaaccacactggggaagaaaagtgctcaaccctgaggcaccctcacacacctcggctcttgtgaacactagtgttcctgccgaagcacgcctacttaccccgctgagcagagcctgagcctgcaacctccagagacctggggaaagccacatactccgcttcccgcccccggcaagggcgtgtcagctacaaggggcgtgtcatctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggtgagctgtccgcgccctcccggggccttccttccgcccggcttctcggaccgcgctgcgtccttcgcgggccctgcctcggtccaggccttcggacctgggcttggccgggccacagccctttgggtcccctgcgccggtctgaggggagacccggccgggggcggccggaagctgggtgaggccgggcagaaggacgaagaagggcgtggaggggctgtcaggggagggcgaaaccgcggacgccgctctccagaagtcgtctccccgggggcgcggggaggcctgaatggctctctttggcgtccccgttgggcccaccctctcccagcgtcacggctatgctgggcgaggtgacccccggggtcgtagctgggggcgtcggcggtgcagacaggggatgccggcagagattggagcccggcttggctgtttcccgggctgttggcattgaccggggctctgcccttcctctaatgcccttatctctataggaagtgccccttgagtgggtgtcgtgacttcacgagtgaaccctggtacgccctggagcagagtcggactgggagggatcaagtgtgggggcagccggttagtccggacgcgggtttacctattactttctgagcgcagtgctctgggtggattaattgccctgcaaaagctgccgggacctccttgcagtctttgcacgaggcctgcctgtgtcatgccatttaaatcgcgtctgggccgggtcggtggctcacgcctgtaattccagcactttgggaggccagggcgggcggattgcttgaggtcaggagtccgagaccagcctggccaacatagtgaaaccccgtctctactaaaaatacaaaaatcagccgggcatggtaacgtgagcctgtagctccagctacttaggaggctgaggcaggagaatcgcttgaacccgggaggcagaggttgcagtgagccgagatcacgccattgcactccagcctgggcgacagagcaagactccatctaaaaaaaaaaaaaaaaaaaaaaaaaatcgcttctgatgagccggttgtcgtggcctgtggctgtccatccttacgtactgtgttttgttgatggcgctacaaaccagacaaggtggagtgtgattgaagaaagaaacgctggccggtgcagtggctcactcctgtaatcccagcactttgggaggccgaggcaggcggatcacctgaggtcaggagttcgagatcagcctggccaacatggtgaaaccccgtctctactaaaaatacaaaaaagttaaacgggcggggtggcgcgtgtctgtaatcccagctactggggagtttgaggttggaggatcacttgagcccacgaagtggagattgcagtgagctgagatcgcatcactgcactccagcctgggtgacagagtgagaccctgtctcaaaaaagaaaaaaataaattatcacaagacaaaatttgtgcttatcaggagttcacagttaagacatatataagcttacttggtgaaattagaaaaagttatcagataaaacattcaggtttaaacactggtgagggtgtgggaatttgtggagccttggaaacacactcattgaatgacctcatctacctggggatgtgaagagggaaatcctgtgattcctccattgtctgacttgatttccttttttccttggctgtggcaacatgttgaagtgctgtgagtcaccaaaagggggaacgtgagcaactctagaaatgccagtgccagtgagttacagacaataaagcattgaccgcctttagctcacccctcatcaagtctgttgaaaacttgtaaaattggacagctagagctaccttgattttttggtttccttttaacagctgactctcttcacaggacagttgggctctacatcaggattgcacccaaaactggaatatcactcctccaggaggaagatatatttgaaaattagaattgtgggcccggtgcagtggctcatgcttgtgatcccagcactttgggaggccgagatgggcggatcacctgaggtcgggagatagagaccagcctgaccaacatggaaaaaccccatctctactaagaaaaaaataataataatacaaaaattagctgggcatggtggtgtgtgcctgtaatccgagctacttgggaggccgaggcaggagaatcacttgaacctgggaggcagaggttgcgatgagccaagattgtgccactgcattccagcctgggcaacaggagcaaaactgcatctcaaaaaaaaaaaaaagaaagaaagaaaattagaattgtgtatttcactgtaaaatttgaaattcagctttaactccttggaaaggaaagagatgaaaaacttgacctagactgggtgcggtggctcacgcctgtaatcccagcactttgggagaccaaggcgggtggatcacctgaggtcaggagttcgagaccagcctggctaacattgtgaaaccccgtctctactaaaaatacaaaaattagccttgcaaaaagtagcctgtaatcccagctactcgggaggctgagcaaggagaattgcttgaacctgggaggcagaggtttcagtgagccaagatcatgccattgcactccagcctgggcgacaagagcaaaacttcatctcaaagaaaaaaaaattctatcagagtgaacaataagtaggatgctagcacatacctgtaatctcagctacttgggaggctgaggcaggaagttaatacttgatgagcctaagtttttggtgtctttggatgctgcttgtcgatctaaggggtttccaaacgcttcttttttggtaaaattgggattatgactaggaatctgttttttggagtttcccaggtgatccttgtttggggtccttgtctaaggcacaggctggaaagaggagggagtggactggcagggaagatagagcagtaagcgaatagaatacctggggaaagggacgccagaagagtgattgttgtctggtgaactgtgctgtcagtgtgtatgtcagaagccaacaaagtggatattctcttcactcagcttagggaaaaaattaatttttgtttcacagatagattcgtttccttcccaggagtattataggcctaattactgtcatagttctcagtaactttaaaaaggctgtggggaagaatggcataacagactagtatcttgtacccagcctgcctttttcttattctattttttttttttttttttttttttttttttttgagacagtcttgctctgtcacccaggctggagtgtggtggcacaatctcagctcactgcaacctccgcctcctgggttcaagcgattctccagcctcagtctcctgagtagctgggattacaggcgtatgccaccatgcctggctaatttttgtatttttagtagagatgaggtttcactatgttggccgggctggtctcctactcctgacctcaggtgatccgtccaccttggcctcccaaagtgctggggttataggcatgagtcgctgcgcccggcttttttattttttattttttatttttttgaaacagagtctggctctttcacccaggctggagtacagtgatctgatctgagctcactgcaatctctgcctctggggttcaagcagttctcctgcctcagccttccaagtaactgggactacaggcatgcaccaccatgcctggctaatttttgtacttttggtagagatggggtttcgccatgttggccacgctggtctccagctcctgacctcaagcgaaccaccctccttggcctcccaaagtgctagtattacaggcgtgagccacagcacccggccttttttttttttttttccttagagtcttgctctgtcaccagggctggagtgcagtggcgccgtctcggctcactgcaacctctgcctcctgggttcaagtgattctccttcctcagcctccctagtagctgggattacaggtgtgtgccaccacacccagttaatttttgtatttttagtagagacggggtttcaccatgctggccaggctggtctcaaactcctgacctcaagtggtccacccactttggcctcccaattagaattagaggtggagcgaccgtgcccggctaagggcctactattttttttttttttttttgagacagagtttcactcttgtcacccaggctggagtgcagtggtgtgaccttggttcactgcaacttccacctcccaggtttaagcgattctcctgcctcagcctctggagaagctgggattataggcgtctgccaccacgcctggctaattttttgtatttttagtagagacggggtttcaccatgttagtcaggctggtctcaaacttctgatgtcaggtgatccacctacctcggcctcccaaagcattgggattacaggcgtgagccaccgcgcccggccaggcctcgtatttttgcttttgctcatgttttcatgtctgagatagagggcctactattaaagcactgtgctgaggctgcaagaaggtactagtgtgattaaaacaatctggtccgggcgcggtggctcgcacctgtaatcccagcactttgggaggcggaggcgggcggatcacgaggtcaggagatcgagaccatgctggctaacacggtgaaaccccgtctctactaaaaaatacaaaaaaaattagccgggcatggtggcgggcgcctgtagtcccggctactcgggaggctgaggcaggagaatggcgggaacccgggaggcggagcttgcagtaagcagagatcgcgccactgcgctccagcctgggagacagagcgagactccgtctcaaaaaaaaaaaaaaaaagaaaaaaataaaacaatctggcattataatgccatcctgattttagttaatctagttgactggctggcctcataagtagctgtgatgatcataatttttatgcgaaacacctgtcattgagcatacaggtgtactgaaagaattgggtggaacagggtatttgaaatcagaattgttctggaaagtcgggtacataaagctctatctttagcacagttgtctgtattgcacaattaatatttatagaatggtacaccttatgttatctttttatttttccacctaactctctctctagattgaaaggtacttgacgtgcagagcaagatcttatctttctttgtagtcacagtactcaagagggtgataaatgtttgttgatgataatgtaatgtcacctgtccaagtgtagccatcatcttcagtagttacttgatctgctgttgtgtctggcaagactgctatgtgctgctgcagaggagccattgtcaccttgaactatctctgtggcagtctggaggagggcaggagggagaagggaaggaataaatgagcaaagctgagtgtggatagtagtgtttgacggcagatgaaaaagcaaacttggtgaagtgtggcctgggtggtcatctaacttctacctagaagacattaaacctttactctcttctttttatgtaggaaggcagagggaaagtcaggccttcggttggcttggtaatagcaggtatcccagtaattagaaaataacttaaaaaactccattcctctaccatatacttgagaatttgtcaatctcagcaaaattttcaaatgtctgtgttcagtgtcatatttgtcctgctctgtaagactttttgtgtttataaaaaggcaagtggacccagaaggggaaaaatatgctgttctgagaaactagctgctgtaggttatgcttttctgtctttgcttgtggctcttctggttatttgagaaaggcaaaaaaacccaaagtcttttttctactctgttcccacagtcactcaacacaacacttctgataccagatatatgggagttgtttccccatacaccaagcaattctctagtagacacaccggtgcggtgtcctctaagtcagttaaattctgatactctatctggagatagcgtcagatcccaccaattgagggctcagtcccacaaaactgtcccaacttgaggcactagtcacaagtagtaaattgtcacctatacttctgacctactagctataaatcgaaagttctgacaatccctcctcgagtttgattaatctgctagagtgggtcacagaactcaggaaaacactttacttacatttaccaatttactctaaaggatattaagaaggatacagatggctgggcgtgctggttcatgcctgtaatcccagcactttgggaggccaaggagggcagatcacctgaggtcaggagtttgagaccagcctgaccaatgtggtgaaaccccatttctagtaaaaatacaaaaaaattagccgggtgtggtcgtgcatgcctgtagtcccagccactagggaggctgaggcaggaaaatcgcttggaccctgggggcagatgttgcagtgaaatgagatcacgccaccgcactccatccagcctgggcgacagactggaagaaaaaaaaaggatacagatgaatagccagatggaagagatgtatagggtgaggcatgtaggaagaggcatgaagcttctacgccctctctggaactttcgtgtattcagctatcctgaagctaatgcaaaccctggtgtgtgtgtgtgtgtgtgtgtgtgtgtgtgtgtgtgtgtgtgtgtgtgtgtgtgtgtgtgtgtttatggaggcttcattacaaaggcataattgaatacgttattggccactggtgatcaactcaacctttagaccttctcccgtcccctgaggttaagggggtagggctgaaagttcccaccctctaatcacatggttggttccccaggcaatcagcccccatctaggagcccaccaagagttacttacttacaacaaaagatgctcctattacccaggaaattccaagggatttaggaaattacaaaagttttaggagctctgtgtcaggaactgaggttaaagaccaatatcagaatgaaggattctcctagtgcccccatctacaaaggttttaggagctctgtgccaggaacctagggtgcagatcaaatatatctataaatctttttgtttgtttgtgttttgagacagagtcttgctgcgacacccaggctggagtgcaatggcgctatctcggctcactgcaacctccgcttcccggattcaagcgattctcctgcctcagcctcccgagtaggtgggactacaggtgtgcgccactatacctggttaatttttgtatttttagtagagacggggtttcaccatattaaccaggctggtcttgaactcctgacctcaagtgatctgcccacctcagcctcctgaagtgctgggattacaggcatgagccgctgcatccagcctcaaatttatctctgtatcttcttctaaattacagtatcacacccgtgcatatgcccaaaaatttttttttttttttttttgagacggagtcttgctctgtcgcccaggctggagtgcagtggtgcgatctcggctcactgcaggctccgcctcccaggttcacgccattctcctgcctcagcctcccgagtagctgggactacaggctcccgccaccatgcccggctaattttttgtatttttagtagagacggggtttcaccgtgttagccaagatggtctcaatctcctgacctcatgatccacccaccttggcctcccaaagtgctgggattacaggcgtgagccactgcacccggcctcatatgcccaaattttaaaggaggcaccacattcaagtccaaatgcctaaaggtagaaggatcaagaaacagtagtatgaggccatttgagaagtatatatagttatccctcagtatctgtggagattagttccaggacccctcaagggtaccaagatccaggatgctcaagtttcttttcttttcttttttttttttttttttgagacggagtcttgcactgtcacccaggctggagtgcagtggtacgatttcggctcactgcaatctccacctcccgggttcaaatgattctcctgcctcagcctcccgagtagctgggattacaggtgtgcaccaccacgcctggctgatttttgtatttttagtagaggtgaggtttcaccatattggccaggctggtctcgaactcctgacttcaggtgagccgcctgccgcgggctcccaaagtgctggtattacaggcatgagccactgtgcccagcttaagtttcttatataaaatggtgtatagaatttgcatataacctatgcatatcttctgtattctttaaatcatctgtatttataatacccaatacagtgctatgtaaatagttgttatactgtatcgtttaggtaatcatgacaagaaaaaaaatctgtacatgtgtagtacatatgtagccatctgttgttttttttttccctgaagattgattggttgattgagacggcatctcactctgtcaccgaggctggagtgcagtggcgcagtcttggctcactgcaacctccacctcctgggttcaagcgattctcttgccttagcctcccgagtagctgggattacaggtgcctgccacaacccccggctaatttttatatttttagcagattccgggtttcaccatgttggccaggctgatctcgaactcctgaccttaagtgattcacccacctccacgtcccaaagtgctatgattacaggggtgagccaccatgtcaggcctttttctgaatatttttaatctgaggttggttgaatccactgatgcagagcccatggatatggagggctgactgtactgtattgagcttctaaggtatgcagagtattggcactgaggggatgtgcaaatacaacaacaaaccaagcatagtctttgtttactaggagctggtagtaactgtgggaagacacaaaacagtaaaatcactttgtaaggtttatgagagttttgagaggccagggaagttaaagagtggagaaatggagaaaatgggagaacttgtactgaacccattaggacagaggaggaagggaagagaaggaaggaggccaaagaaagaagaaacccttcttagagcactcagggtcttactgaaaactttacccataaaaagagaatgtcactgatagactccttttagaacagggattgatttttttgtttttgtttttgtttttatttttgtttttgtttttgagagaagtctcgctcttgtcccccaggcttgagtgcaatggcttgatctcggctcactgcaacctctgcctcccgggttcaaacaattctcctacctctgcctcccaggtagctgggattaaggcacctgccaccacgcccggctaatttttgcatttttagtagagacaaggtttcaccatgttggccaggctggtctcgaactcctgacctcaggtgatccacccacctcagcctcccaaagtgctgggattacaggcttgagccaccatgcctggccacaggcaacatttttaaaccatacgattgtcctggagagagaatctgaagccttgctctgattctgaaagggatttgcaaccaaaaaaggataaggattgttctgacaagtaccctttcttcccatcttcaaaagtacacatctcttaatttgtgtcttcaaacacaaattgtgttcaaaaaaggaagtatttgagtagattaaagacagaaaccctaggacattcctttgtaaacaaacagccttttaccaaacaccaactgtcaagggacttgcctgagtacttgtccaaaggacagcgtgtccccatgtgtaggcagtggtctaatctggttcctaggagaggactgctgaggccacagcaacttaactggctagtgtgggtgaggcagaagtgtttgaagctcaaggtctgtcaaggacagctgattagagtatgtctgtccctaatacagggttagagctcagtaccaatgctggggatgaggtgagttgaagacacagaaactacatggttttttggaaggtcacgaacttttcaaggaactagtgggcaactggaaatgatatgtgaaagagtagagggagctctggcctagctgccagaaaactctgggcaggtcaggtctgggaacagtggctaatccaggcccagcttcccactgttgatttggacatacaggcctaagataagagaccgtgcccagagccactggtcacttagcacaggtagtgggaaatggtagccagcaaatgtttaattgaatatcttatgtctcctagaccacagctgagcaaactaggccaagctcaaggtcctgaggggaatgaggagctgagctcagtcccttttggccccctttctctttccctcctcattttaagtatggaagctcacttatttcctttttgtattggccatttgtgtagggttttgtttgaaaaagggcttgaggctgggcgtggtggcccacgcctgtaatcccagtactttgggaggccaaagaaagattgcttgagcccaggagttcgagaccaacctgggcaacatagtgagaccctgtctctacaaaaaaatttttaaaattagctagacatggtagtgaatgcctgtagtctcagctgctcgagaggctaagttggaagtatcacctgagcccaggagttgaggctgcagtgagctctgattgacccagtgcacttcagcttgagcaacacagcaagaccctgtctcaaaaaaaaaaaagaagttgggcacagtggctcaggcctgtaatcccagcactttgggaagcctaggtgggcggatcacctgagatcaggagtttgagaccagcctgacctctaaaactacaaaattagccaggcgtagcccagcggctcatacctgtaatcccggcactttgggaggccgaggcgggcggatcacctgaggttgggagtttgagaccagcctgaccaacatggagaaaccccatgtctactaaaaatataaaattgctgggcgcagtggctcacacctgtaatcccagcacgttgggaggccgaggcgggtggatcacaaggtcaggagatcgagaccatcctgtgaatggcgaaaccccgtctccactaaaaatacaaaaaattagctgggcgtggtggctggcgcctgtagtcccagctccttgggaggctgaggtgggagaatggcgtgaacccgggaggcggaggttgcagtgagctgagaacaccagcctgggagacagagcgagactccgtctcaaaaaaaaaaaaaattagccgggcgcggtggcatatgcctgtaatcccagctactcgggaggcagaggcaggagaactgcttgaacccgggaggcggaggttgcggcgaggggagatcacgccattgcatgccagccttggcaacaagagcgaaactctgtctcaaaaaaaaaaaaaaaaaaaaatgtagccgggtgtggttttgcatgcctgtaatcctagctactcaggaggctgaggcaggagaatcacttgaacccgggaggcagaggttgcagtgagctcagaccgtgccattgcactccattgtttcgctgcaacgagagggaaactccatctcaaaaaaaaaaaaaaaaaaaacaggcttgagtatacctctcacagccctggagaatgcctgagctgttggacagttgccttttccattatgtctgcttttttctaaagctattcattcattgttgcctaatcatgtcctcagtcagtagttgatgttctgggctatttgaatttcctctgaataatgattaatggagataatgatgtttgaccagttctgggaactcttgggaattaaaggaattaaactcttggacattaaacttcactttaatgtgtatagttgtgggtgctgccccattggagaagattgtgacaggaagttacacagttttacagcaaactgctgggattttttatttttttttcagtaaattatgataactgtagcattttcctttgcaataatgataacctaaggccttggtgtttcctctaaaatgtacatagatacaggatgtgggtttgttacaaagttgtataactattgcctttttgtggctgaccccttccctagagaacaacatgaagagaccttgctgctgctatgaaacccagactctaaggacaacttgggggacattggatattttttcacagatgtagacatcaaggagtcagtggtttgtgtatgcgttgagtggagaaggctggcaagcatttgctaccatgactgttaaaaatgtgcctgtacatttctttttttttttttttttgagacaggatctcactctgtcacccaggctggagtgcagtggtgtgtttttggctcagtacaacctccaccattgtgggctcaagcaatcctcctgcctaggactcctgagtagctgggatgacaggcatgtgccaccacgcccagctaatttttgtagtttttttgtagagacagggtttttgccttgttgcccaggctggtatacatttctttatataaggagggggcaagtaacacagtgttatgctaccaatcaggctttcagagaccataaaacaaaatctaaaaggtacgctcttagtagtcatatctgtggaatgtaaggaagccagtttaagaccaatgtaatgcagcattttcccttcacacatgaaacagtgagttactcgagcacaaagcatcaaatgcttattccccccacaaggccattcttatctttcaccaagtgtttagtcactaggcagccatcatcctccctccctctctcccttcctcccttactttcttcctttcttccttttgcagtggcacagtcatgggctcaagtgatccgcctcagcctcgcgagtagctgggaccacaagcactcaccaccacatccagctagttttattttatttttaaaaattttttgaaacagagtcctgctgtgtcacataggctggagtgcagtggcacggtcttggctcactgcagccgccacccccagggtcaagtgatactcctacctcagcctcccaggtagctgggactacaggcatgtgccaccatgcttggctaagttttgtattttttgtagagatggggtttcaccatgttgcccaggctggtctggaactcctgtactcaagctatccacctgccttggcctcccaaggcgctgggattacaggtgtgagccattgcgccgagcctcatccagctaattttataatttttggggggaggtagcaacagagatctccatatgttacccaggctggtctgaaactcctggcctcagtgatcctcctgcctcagcctcccaaagtgttgggattacaggcgtgagccaccgcgcccagcccattattcttatatctgagattcacctttaattgccctctgtcatcagcactttgagaatgcctcaattttgagaataccttgtattctggaaatcattcattcagtcaacaaaccctgactggtgtgtaattgggcagtaggaggccaagataaatgacctgtaatctggaaaacaaacatataaacatacacataccataacgagatatgagtgctaggatggatcacaaaaggcttacttaggtagctctgaatataatatcaggcctacaatattatcacttatgttgttttttggatcttatttttagaaacagcacaagctttttcttggaggaaatatagcaaggaagaggggagctgttctgactgaagcagggtatgggaggcccacagcctttcctgctttgcctcctgttcaaagccatcctccctgcagttcactgagaaatgactccttggagctccaaggaagtcctacagctagctagtagcagacctggtagtagaagttagttcttctgattcttagctttcttagcagtcaggtaccagactgataaacgaaaatcaaatttctcccagttatatgttccatcccacaaagaagtaataaacacatttctgtcaggggcttcagcctgcctggatttgttactgggtttgttttaaatgtttagcttccaggcatccaaatacatacaaaaaaggtctattcccaggaacatactgtaacccttttcattgtcatttgtgggcagtgccaagctgcctctaatagcttcttctgtttttttggtggaaattcagtttcctcagaaatctatataagggatatttgataaaggtgactaacaatctcgtctctgtaaattgatgaagggatgagaggggtattagactcatgtcctcttttgaatgcacactgcttttgtggtccggcagggtttctcagcgttagtgctgttgacattttgggctagattgtttgtggtggtggggtatgtgtgtgtgtgtgtgcgtgcgtgcaagcacatttgtgcgctataggacattgagtagtatccctgacctctacccactattgtcagtagcacactcccgtctttcagttgtgacaactaaatatgtctgcaaacatttccacgtctccaaacatgttccttgggggacaagttggcccccagtggagaaacactggattggagattggttgtcatgtgataaaaatgcaaatcagatttgtcacaggacaaagtaaattttcagttacctaattaaacctttactttttataagtcgctctaaagaaacaaaagtgtgtcctgtcttccatcctgattctcggttactggagggcccttcacctaagtcatgttcaggatctccttgaaggagttaaactaaaacaatacaatatcttcccttaggtcttttgcagaatttattttgctaggccgggcactatggcccactcctgtaatcctggcactttgggaggccaaggcggctggatcacttgagttcaggagttcaacactcgcctgggcaacatggtgaaaccccatctctacaaaaaataccaaaaaattagctgggcatggtgttgcatgcctgtagtcccaggtacttggggggctgaggtgggaggatcacttgagctcaggaggtcaaggctgcagtgggccgagattatgccactgcgctccagcctgggtgacaaagtgagactctgtctcaaaaaatatatatattttgctagaaatcccaagatttttctctcttttctttttgtttattttctttctttttttgagatggaatctcactctgtcactcaggctggagtgctgtggcatgatctcggctcactgcaacctccacctcccaggttctgagaagctaggactataggcgcatgccatcacatctggctagtttttgtatttttagtagacgcagggttttaccatatttgccaggctggtctcgagctcctgaccttgtgattcacctgccttggcctcccaaagtactgagattacaggtgtgagccactgtgcctaacccccatatactttcaaacaaaaaatggaaatatcactgtctccatgaaaagccatacaggcagcatcaaaactacactaggggccaggtgtggtgcctcctgactgtaatcccaacaatgggagggtgataggattccttgaggctaggagttcgagaccagcctgggcaatatagtgagaccctatgtctacaaaatactttttaaaattagcatagtggtgcgcacatgtagtcctagctacttggaaggatgaattgggaggatcgcctgatcccaggaggtagagactgcagtgagctaatatctcaccactgcactccagacacagtaaaaccctgtctctaaaaaaaaaaaattaaataaataaataaatggtttacactgagggtcacagactttgagttgaggttcgtcatgaagaatctccattttcattctaatagcactagatacaggctgggtgtggtggctcacagctataatcccagcactttgggaggccgaggtgggcagatcacgaggtcaagagatcgagaccatcctggcgaacatgctgaaaccccatctctactaaaaatacaaaaaattagctggatgtggtggcacgtgcctgtaatccctactactcgggagtctgaggcaggaaaatcccttgaacccaggaggcagagattgcggtgatccaagatcacgccactgcactccagcctggcgacagagtgagactctgtctcaaaaacaaaacaacaacaacaacaaaaaacacaaaaaaggctgggcacagtggctcaccttgtaattccaacactttgggaggccgaggcgggcggatcacttgaggtcagcagtttgagaccagcctgggcaacatgggaataccctggctctactaaaaatacaaaaattaattgggtgtgttggcacatgcctgtagccccagctactcagaaggctgaggcacaggaattgcttgaacccaggagtggggagaaaaaggaaatattaggggacatttgttaagtttatatttttttcttttctcttctttttcctctttttttgagacagagtctcgctctgtggcccaggctggaagctggaattcagtagttcagtcatagctcactgccgcctttacctcctaggctcaagtgatcttcccacctaagcctcctaagtggatgtgaccacaactgcatgccactccctccacccccgtctgcctaccagctaattcaaaaaaatttttttttgtagagatggggtctccctgtgttgcccaggtcagtctcaaactcctaggctcaagcaatcctcctgccttggcttctcaaagtgctgggattacagacatgagccactgggctcagccattaattttaaattgcaagtgacatattctttagtttattaatcagcaccatatgatgtcacagttttataactcatttatctcatttaattctcatacccaccttgtggaattgttatcactgtcctttacagatgaagaaagaaactccaagaaattaagtagctggcccaagtccacccaactgggatgggcagaaccagggtttgctcttggttgtgcctttctacagcctgtgccttaaccacatctatgtgctgcctcttggcctctgtgtggccagtagattctctcatggctaggctcatcttaattaacatttgttgggtgcctactatggctcaggctctagagatcattgtaaaatccagtccactgccccagctcctcgtgtgtcttttgaacacattagtattgtgctgtgcagaaaggacttctgtgcatatgcctgctattacacttgttgaacccaatttctacaaactttcattcagatggagggattcagtcttcttatcatataatacatacagaaatacaaatatttaaatatttatctaaattaatagtcacatatgccatttatacagttagtgagttacagccaagtgacagttgtgatgggaggctgtgtctggggagttacatactggtgaggaaactagaaaacatggctgtcgggccggcactgtggctcacgcctgtaatcccagcactttgggaggccgaggcgggtggatcacgaggtcaggagatcgagaccatcctggctaacacggtgaaaccccgtatctactaaaaatacaaaaaattagcggggcgtggtggtgggcgcctgtagtctcagctactcaggaggctgaggcaggagaatggcatgaacccgggaggtggagcttgcagtgagccgagatagcaccactgcactccagtctgggcgacagagtgagactctgccacaaaaaaaaaaaaaaagaaaacaaggctatgaaaatttaacacattgactgggcagggtaatgcatggtgatctgttttctcttcgctccaatcctgaaaggtttctttgaagagctggagtgtctagaaagctttcctagaaagctagtgtacattttgctaagtaatcactgtgtcacttagattttctgctctttaagtgtggttatgagatgtgttccaaacaatttgttactaaccatgaagttgatgaatgctttgcctttaaaaaaataagtttgggtggggtgcagtggctcatgcttgtattcccagcattttgggaggctgaggcaggcagatcgcttgagtccaggagtttgagaccagcctggacaacatggtgaaaccctgtctttactaaaaatacaaaaattagccaggtgtggtggcgtgtgcctgtagtcccagctgctttgggggctgaagcaggaggatcacttgagcctgggaaatccaggctgcagtgagctatgatcacaccactgcactccagcctgcgtgaaaaagtgagactgtctaaaaaaaaaaagtttggccaggcatggtggttcatacctgtaatcacagcactttgggaggccaaagtgggaggattgttgaggctaggaggtcaagaccagtctcggtttgattgggttaaacattatccctgtaagttggctctcattctgagaagttgtttagagtagaagagagggctgcatttacagctaattgctagtaatttcacatcatctgcaatatattttctggacactctgcccgactagtcctatgggacgttgtcattcatgtgcaaatcaggccctatatactaagggaggaaaacagttgaggacctcctttttttaggcactcttggtgccttgtgcattaagatagtgagtcagaggataagaaggaagcagattccattccccttaccactctttgggtgtaggcagggcctgctggtagtgctgggaaagccgaccatccttctttgagcaagtccaatagctgctgctgctagttctgtcccaccataggcacagtctatgtaggatgagccaaccatatgtggagttactggttcttggtctgggcttgttcctttccccaatttcagtccccaccagaatctgggcagtcattgtgaagaagcctaggaataataccttactctataggcctgtggaaacgtgtaaagataccttgcaggcccagagtgagaaattggagccaccttgttcgattgaccaaaggcttgtcctatggagttactaattttacaggaagtttatgttaacatactttctatccattgcactaccatttctgaggcacaatatatttcagtaggcagaaagatagaactgcttagattttaaatactcaatacatgcttgacacagtttagtctatttctcttcagttactatggcagtgggtgctatagagatgtgcagaccctattgtgacctccctttggtatagggatgctctggagcccctggcttcattgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggtgagtgttttagggacaagcagcatcaacttcggaatcttcaactgggcctgagcacttatttctcagaaataatagaatcttgctcacttttctttctttttttttttttttttagatggagtctcgctctgttgcccaggctggagtgcagtggatcagtctagctcattgcagcctccacctcctgggttcaagagattctcctgcctcagcctcctgtgtagctgggattacaggtgtgcgccaccacgcctggctaataattctatttttagtagagttggggtctcaccatgttggccaggctgctctcgaactcctgacctcaagtgatctgcccgcctcggcctcccaaagagctgggattataggtgtgagtcaccatgcctggcctcttgctcacttttcatactaaaacaacaaattacaggctgtagtttaacctctctactgcatgcataaatgcagtgtggtacgagtgcctctgtagcccataacttcagtttccttgttgctagcagtctgtggtgacactatactaatctcacatgcaggaaccaatgaggattagccagggacacaggaggagtcaccttgcattcagaatgactcaagtttagtctcaacttgaccattagctctctgagtgatcttgcccatgttaattctcttgatcttagtttcttcagagccagtgagacattgcttgaaagtgacttagcctggtatacccaggtctgtcagacttatagtctggtgctctcttgggtgaacttgagggccttctgccaaggcaggaatggcttcttttaaaaaaaaattattttattattatttttttttttgtagagacggggggtctcactatgtttcctaggctggtctcaaactcctggactcaagtgatccttcagcctcggcctcccaaagtacagagattataggtgtgagctaccagtaccagcctccaggaatggcttctaaggcttcaggctgtttatagagaggaaagcacctgggagctgatggcactctcaggtttcccaaaatgacagttctgcatatgcatcttaatcacctactttttttccctccacccccaaatgctattcacagtccttgtttatgatagaagctgaagcttacaggtgacaatttttgtgcctgtatgaaaggaaacatgactgactccacttatccacacgacacctgctttcaaggttgttcagtgttggaataatttttgcttgatggtaacctagggatgacccaaggtttcattagttaaagccagccctgtgggatgcatgaagtctagcctctgtccctgtaaaaatcccaccagaaccattttagaattcactcaggacttcacccctcccgctcctggtgctgcttatggaactaaagaatcctcatcttctcagccctgggacacattgtcctcatataaagcgaggtggcaatcagggaacaggggcgagtcttgtgcttatttcagttataataggaaggctctaccaggactcatcattgtcccaacaatagtcgattccaggccccttctttgaactcatttcagtgtctcaggttctgtccttggtgtctgtcttcactgcttgctcagttgtatttgaacatggctagagatgagcacacttctcttctccagtaaaaaagcctgcaagaaaagtcttggacttcttgaactgctattcagttgtcttttttattcaatgtattttttgagatggagggggtctcactttgttgcccaggatggtgttgaactcctggccacaagtgatccttctgcctcagagttccaaagtgcagagattacaggcttgagctaccacaaccggtctcttgtcagtttttgaggttacttaagaggttaatgcctttaaattagtttgcagttgttttgcttttgcctgccttcttgcccaaatgcgcaagtgcttatttagtaatctgactcaagtgctttgtgtccccagagtccccacttttccaggattcattgtctttttttttttttttttttttttgagacacagtcttgctctgttgtgcaggctggagcgcagtggcactgtcggctcactgcaacctccacctcctaggttccagaaattctcgtgcctcagcctcccaagtatttgggattagagtcacacaccaccacacctggctaatttttttatatttttagtagagatggggttttgccatgttggccaggctggtcttgaatgcctgacctcaggtgatctacccgctcggcctcccaaagtgctgggattacagacatgagccaccacacccggctggattcagtcttaacttgctctttttttttttttgcatctcactcccttgccaggctggagtgcaacggtgtgatcatagttcactgcatccttgaactcctggggtcaaaagatcctcttgccccagtttcccgagtggttgggactacaggtgtgtgtcaccacgcctggctaattattttatttttcgtagagacaaggtctgactgtgttgcccaggctagtcttgagctcctaggcttaggtgatcctcccaccttggcctcccaaagtgtcaggattataggtgtgagccactgcacccagcctggatttgctcttttatcaagaggttaatatttattcttccgttcagtgaaccgtgggattgaattcccccagcgattgaaatgaaagggcttatgtataacatttcctgaggaatggtagtaccagagttcagaggagacctcaggccatttattctataaactcagaagctgtagttctagatgatgtggcttcttcagggtgttgagaagtctctgttatctcgtgccttgttggattagaactgattgagctctgtctgctgccccaaacatgtggctcagccaatctccagtggcatctgcaatgtgggtattctagcctccagtgctcacgtggctcaccttagaaagggcagatattcctatttcctgacgctgctggagaatgaggtctgagtcagaagtcctcaggtgtgacctgcccagaactatctgaaattgctggatttcttgttcttcctcagtgtttaacaatcacccaattgctcattctcaccagcgacttcctcagtaagagctcaatatttgaggtggtgctgcattttgtcaaacattcatgcgtgttagcccacttagtcttcgcagcacacagtggattaatggatttttaaaagctggtatttatgcacgatggaatactactcaaccataaacaagaaggaaattctgtcatttgtgactacatggatgcatctagaggacattatgctaagtgaagtaagccaaagaaagaaagacaaatggtgcatgatatcacttatatgtgaaatctgaaaaagtcagttatagaaggagagtgtaacatgttggttaccagcggctgggggaagggaagggtgggtgtggaaaggggagatgttgatcaaagggtacaaaatttcagttaggagaaataaggtctgatgatctgccttacagcatggtgactatagttaatatggttaatattataatagtattgtatacttcaaaattggtaaaagagtggattttaaaagttgtcaccacaaagaaatgataagcatgtgagctgatggatatgttaataaccctgatttaattattccccaatgtatacatgtgtccaaacatcacactgtaccccataaatataattgtcagttaaaaacttaggagtcaagtcagatctgaagagaagtcaaaacagatttcatacagttaatttagagacatgggacccaattaaaaatttgtattactttacttggtattttagaatttagctgttattttcttgttacacacacaggcacaggcacacaaatcctctatttaactggctttctcagtaggaactccatctgtgtatttgcaacagctgtaactcaggttggatgctccccagggtgctggcctataagtcatattggaccctgatctgaatctgagggaatctggatctctcttgtaggaagcttttggtttaactgggaagacaggatgacagtcagttgtggaagctgaagcgtaatcacctcatattaatatggtggcaattttatatcggagtgagctctgagctgcaaacagccttctaggaagcaggcaggggacccccatccagggtgatggtaagaatcctgatgcccaactgcaaggtgttcagcagggagggagcactcgtggagtcccagtgcagaagtctctgagcagccacttagcctccctgtgtttgtggggtaacaacccgagttcatgttgtgggcatctcatgcagtgtagtagctggtcactgtcaagtgtcactatttcattgagtcagaagcctgcagaattgttctcattccagggagtgagtcagtctgctgttgcttactctcggtgctggctgagctcagcaacctgctctcttccttcagttcaggtttctccagggcaaagaagtctttattgttcctttctgtatgaccagatgggaaatgaattataatatagtccttagattatattcccacctggtagcaatgcactgagttacctgacctgaaatttgttggacttagtctccatggaggaggatttaccatcttcgttgtctcagaagtcctggtagtgcctcatgccagcaatttagcaggagcaaaagctttgagacagtgttctggatctgctgagctggtctaaaggaacctcttttgcttgaagtaactgtgataggaactttgttactgcttctgttagctcaggtgttggaatgagaatcagcagctgatgaggtgaacagctaggagtactggaattatggagtagtggaggtagattttataaacagagggtcccagttttttggaaatgggaaagagagagggtagactggcctttctagaatttgtaacagaaaagaggacccaggagcttccattgactagttagttaatgcagtgcgggatcttagctggtttgcttggtccaattcctgtctctcggtttcttttttcccttcccttcgctgccttcccctccctcttccctttttctttccaagagaattgagtcactccatataaaagaagcagccagttggctaaaaagtccaacaaaaaacaagtatttatagctctccaaatttcccacttgtcattatcagtatacttttgcacacagttatagtcggtgtttgggatcctttttaaaaaaataaaaagtttctgtaggcttttccatgcatgaacacagcttatcaacttgccccggctgtgccaggattccattgttgactgttgtttgagcagtcatgccctttgttcttaggctgtgtgttgtttttttcctaacatcatagtatggctgggtattattttgatacagattacaattactattactatttcttgaagtgtatttcccagagtggaatattttaggatctttttttctcttttgtgggggtggggaacatgtagcttcttgtggatattagacattgaagtctaaaaaggttctatatttatgatttggccctcaattttctagagattccaatggttcctgcaaagaaaagagcattcaagtatagaaaccagccagactaagtctggacatgtagcttttcagaaagtgaaaaaaaattatgtttctgcagttgcaaggtggcctctgaatgccacactgtgtggccactcccttggacagtggctaggccacagggtcgcctcccctggccccagtctgtgggttgaatatgctaaccgagccttcccaggagcctcctctgcccccagcccccaggtctgtacagatggtagttggtactttcagcccgccttgagaactcagtattcttcctgttagctttccttcaaagtaaaatcggtagaacctattttgagtgtagaaaatttgaagtcgtggacagcagattacaaaaaattgcccaccaccatgcctggctcatttttgtatttctagtagagatgggctttcaccatgttggccaggctggtctcgaactgctgacctcaggtgatctgcccacctcggcctccctaaatgctgggattataggtgcgaaccactgtgcctggctcctttttgtatttttcggagaagcacaaggacttgttgtttaattaagcaagactatactctcccagagcatgcagttattattgagtaaaacacagttaatgagatttaatcacgttccctatcactgttgtgcagcatgataagtaggtgcaaatggcaagaagcacgctgaagttactgcagttggtaacctgggccatggatggcacttgtctttgcctcattttgcctgtaagaagcatggggcctgtggtcctggggtacctggaccctcagcctggtgtgtgtgtgccctcagcctggtcctttacttccatcacccatctagaggctccaggaccctttactgcacccctccctcctctagatagctcagtgttttcatcccagcacctttttctctgctgcctgagaactgagcagccagagacaaattttggctctcagggtcctcaagggtgtacagcaaagctgttcttattatttaaagtattttatttatttatttttgagacagagtcttactttgtcggccaggctggagtgcagtggcatgatctcgactcactgcaacctctgtctcccaggctcaagaaatcctcctacatcagcctcccaagtagctgggattacaggctggagtgcagtggctccatctcggctcactgcaacctccgcctcccaggttcaagcgattctcctgcctcagcctcctgagtagctgggattacaggtgtgtgccaccatgcctggctaatttttgtatttttagtagagacagggttttaccatgttggccaggccggtctcggactcctgacctcctgatctgcccacctcggcctcccaaagtgttgggattacaggcgtgagccaccgcgcccggctagcaaagctgtacttttaccaaaaaaaaaaaagaaaacatttataaatcaaggtctgaaggcccatgtgaggcttattctacagcttgcaatgcctgtttttgccccttggtaagtggacgcacagctgggcagccttatgctatctctgtgaactacccatttctggctttgttcataatattcccttgatctggaggccctcccccagccctgccccaaatcctgtctgtgttgagggtcctgccccaggaagccctctgcatactcttccctgcatgtaatacctgcctgctttcacattcttctagactgtgctgtgcatcgtacagttcatcagcattattgcagagtagagtgtctctgatttggagtcaagagaaggttccatttttctgtacatcccgatgtttattttctgagtgttctcagacatcactaagcctcagtcaaaataaagtatgatcatgatgtaacattcattgagtgcttatcacatggtaggcattgtgctatatgagttattgcttgacttcctaaaataatcccagtagagatgctaaatctaaaggtgagagagatggttcaaaaagacctcagtgagcaaaccatgtactataatatcctaaaagataacaaaaatgtaactaggtatctagagaaaactcaggaaggatatgtgccttgggccttttaaggaccatttcttaacacttctgtgttcttcttgacacctgtttctgggtagagcacatagaaaatgctcagtaaataagttctttttccttggcccagtttggcctgatttggccccagttctgtctttgtgagttactttattagttgtcggtgctactgtgctgctattcatgtggaagattccccaaatgggctgcgccttacattgcctgagcagaagccccgagggatggaggatgagcttgccttgttatgggactgtgtttccctggctgacaaaggctcagcatttgcagcaggcaatgggaattgattggccaacttaatatttccttcagcctagcaaagtcctgagtaggctagggacagtctgcttttttggtaactcctgtaggctgccttctgcacaaggcacccagcctctcacaggtaggatgaactggcctcagcacgcttgcagaggggtggaactgtgcgttgcttgccaagctttttgtttccctaaggtttttgaggttttctttgtttttggtaactttcaattttttttttttttttttttttttggacagagtttcactcttattgcccaggctggagtgcagtggcgcgatcttggctcactgcaacttctgcttcgtaggttcaagtgattctcctgcctcagcctcctgagtagctgggattacaggcacgcgccaccacatccggctaattttgcatttttagtagaaacagggtttctccatgttggtcaggctggtcttaaactcctaacctcaggtgatccacccaccttggcctcccaaagtggtgggattacaggcatgagccaccgtgtctggcctaacttttaattttgatacggtcttttttttttttttttttttttttttaagacagtttcgctcttgttgcccaggctggagtgcaacggcgtgatctcggctcactgcaacctctgcctcctgggctcaagagattctcctgcctgagcctcccgagtagctgggattacaagtgtgcaccaccatgcccggctattttttgtatttttagtagagacagggtttcaccatgttaaccaggctagtctcaaactccagtctgcctcggcctcccaaagtgctgggattacaggcatgagccactgtgccctgccttgatacagttttaagcatacagaaaaatggtaagaatagtacaaagaactctcatacctcttccccagattcactgctaggattttgccttgtttgcttttctgacttgccagtgtcccccaccctgcagcatatgcacatgcacacacactgtcttctgaaccatctgacagggagttgcaggcagtgtacctttacttctgaataccccagtgtgtatttcttaggaacaaagacattctcttatataatcgcagtacaattatttttaaaaaccagcaagcttaatgtcaatacaatgctattacctaatacattgttcatattcagattttttccatattccactatggtcccagtaatggcagagctttattttaaagaaaacaatcctggggtgtgtgggtgtcaccttggttacattcgctctgaggaaagcagaaccgacaggtatttggggaagtgactgccgtgggtgccacatcaccagctccttgtgtctctgcaggaccagaggagcgagagcagcaagaaccacacccagcagcaatgtcagcggaagtggaaacctcagagggggtagacgagtcagaaaaaaagaactctggggccctagaaaaggagaaccaaatgaggtgagcgatgggggctggctgcactgaatcaggtgggcccagcacctgtcgtgctcagcacacctggttttgtctgttggcagcactggggagtggccatgggccatgagctctggacccctgggtgcctgcttggccctgcagggaccgcatacagcttcggctgcttagaactctccccactggtccattgtctcatccaaggaggcagggcaggtgctcctgggagtgctgataggatttgatggtagttatccttttttctttttaaaaacttgtgcgtttcctcatctgggctgagaaagggtaaacgcaggcaaagctggctctgttcagtcttttaccacataaaagactgcagggcagcctttccttactctgtatagggacagctcatgctaaacctgagcttccaggccctgttctgcatcattagcctctcatagccctgtcattggccaagttttttttttatcccttgaaataattgctaataataaattgattctcagcacatggatgataacgagctaatctcctaaagaagacagcagaagccagaccatgataaggccaaatttttctcactcttgtagatggattgtgtggacacatgtaagcccctgcccaagtaccaccatctttaggatcacatgttttctaccttgtccatccatccacacacctttacaactgtgtaatttcgttaagcagcacaaacccagcgtcctggccctagcctctcggttgtctcctttgcatccttccgtgcttggtcctagtcacatatagtctcaaagaagctgtgggtccaaggtgggaggaaggcagtagggccatctgaggagacccatggtcacagccttactgaggtgtgtgaattccagaagacacgttccaaggcaggctgttcttagagaagccagcaaatactgaagggaatacagatgtgtgtctcttcgaccactaggtggccacagaagcaaagcattgctcatttgggtggttcccaacacagacacatggacgtgggtactactctcaaggagcaggccacagttatcccttgtgtcctgagtccttggagcagaatgtcatgtctgcttgtcctgtgttccctgacaagttgctgctatttgtgttggagtgaagtgtctgagaagccccagcctccagtacaacaggtggtcaccttggggtgtggactcaatcttctctctatggtcctttctggaaagctgggaagggctaattgacacacaaacacctcccatctctccacagaatggctgacctctcggagctcctgaaggaagggaccaaggaagcacacgaccgggcagaaaacacccagtttgtcaaggacttcttgaaaggcaacattaagaaggagctgtttaaggtttgtgccccgcattgggttccagactgtcatatggggttggggtgggggccttggtcccatgagaaaagtgcccctggagccactctgagggaaaagctgggcttttctccacactccattccttcttgacgttaagctctggctctcggctgggtacagtggctcatgtctgtaatcccagcactttgggaggccgaggcaggtggatcacttgaggccaggagtttgagaccagcctggccaacatggtgaaaccctgtctctactaagaatacaaaaattagccgggtgtggtggcgcgtgcctgtactcccagctacttgggaggctgaggtgggagagtcacttgaacctgggaggcggaggttacagtgagccgagatcgtcccactgtactccagcctgggtgacagagcgagactctttaccccgccaaaaaaaaaaaaaattggttctcatggcttagatagaataacatagtggtgtgaaggaagcaaaagtatgcgtgttccaaagacttcaccatgccattcctttaagaaacaaaagcttccttgtgtgttaaataattcactacataaaaatggaccataggattgggtctttggggttgggggttgtcacttgagcctctgcatccagctgctcggatgtggtgtgctcaggcatagctggcctcctcctgtcacctccacagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcaggtactattgggggctgccagctgctagggctgaagagggaaactttgacagtggtagcagatccatagtggcccatgaaggcacacatggcattaggacagatgagctgcagggtgccgagaggaaggtggccaccagattggccaccagagcttgtgggcccagtgggtggttcccagcatggaggcctggtgtgatagatgccagtgggtagtgttttgggaagggtgagtcctctcgcacatagaggggtctggaagaatggagctggcttcctccctcattgcaggatgctggtcttgaagaatggttaattttcttttcaagttttgctctgagaagccctgctttataagttaatagagagccagtgccaccaaggagagtaaataagctctgtttacaagtagcctttagatgaggctgaacctggggaagcttactctgtccccaggtcctgtcagcttccactgaggcctcccagggcactcaggatgagtatgccctgccacagtctcattctcccatgttccaggttttctgttgcttcttgataaaaaaataaccagcacctagaaatggggatgtactcatgccctcctgtctgtgctgtggtagtttcagtggcttgagccacctcagagaaggctacatctctggtcagttcccaggggagacccagcatttggcagccttcttggggtaccaatatccacacctccccagagctcttgctagggagggaagaccatcaggcagtgcagctgccgcccaccagtgctgcttgctgtgtagttggcacacctgagcaagctcacctgctccagctcactctctctggagggcgtcctctaaaaggagagtgtagccaggcgcagtagctcatgcctgtaatcccagcactttgggaggctgaggcaggggcattacttgaccccaggagttgaagaccagcctgggcaaccaaggtgagacaccatctccccacaaaatttaaaaattagccaggtatggtggtacacacacgtaggaggataaggtgggaggaccacttgagcctaggagtttgaggctgcagtgagttagccatgttcataacactgcactctagcctgggcaacagagacctcatctcaaaagacatttaaaaaaaaaaaaaaagtatgggcagcccaaagatggctcagtcgatcctctgctcctgcagatattcaatgaactggaccaggccggctccacactggccagagagaccttggaggatgggttccctgtacacgatgggaaaggagacatgcgtaaatgccctttctacgctgctgaacaagacaaaggtaggtctgtgtgtcctgagctcccctcctggggcaggtgtagcaggagactccactgatgccatgtctcctattggtgctgccacacaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagcta

SEQ ID NO: 134 - DNA, 64258 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcagggtaagggcttcgggcgcacctggagggctggggcagctagcggctgggggaaaccgccttggtcaccgcagtctgtgggaggctggagggaggaaaggaggtgcgacggatccccttttctgtggctgccttgaggccccgcgggtacctagctgtgtggtcgcgggtagtggctcttgcgccccctgctgcgcttgctcccttggtccggagcgctccccggaatgcccggtgaagctgtgcgggaaccctgcggtctgtgtacaggactgtgtccttgcaaacctgactctcgagcttccttcccagtgcccccaggagcctttacacaaccgcgtcccaggttactctaaggggagactgcccgagagggcgcgccccagcggggtgatgtacccgcctggggagtcctttgtaccagcgcccctcttctccctctgcattgggggtccacctcgcctggtcctccccccacccccgcgggtgcatgtgtggatgacagtgccctgactatgaagggactgacatcacgggcgctgagtcacggatcttcccgctgcacggagtcactttggcagccaccaactctgggaagccaagtgccccagtcctgggaattgagtcgggaggctggcaagggagtgagacctcctggggctggcacgtgctggactcccctctagaaaagagaaggacccgtgagggagagggcagaggcacttactgctcccgttgactgtaatctgcccctggcaaaccaggcttttcttgggctctggccgcatgcccagctgcgtgtctagtctctcttctggaagagttgggcaactggctctccagaggtttattttagggtcccagtgcttctttgaggacacagcagaaaactaaggggcagctgacaggcttctggaacagctgacaggctggggaggctgaaggctaagactttcaaccactagatcacactgaattccagtcctaggtgaacactgatctctccctttgaggaggtgactttctgcaactagaggctgagctggagtgtctgaggctctctttgctttttggatggttgtggtccttatgattggaagaaaaaaagaagggattccattttcaatacacatttataactcctgccagtaacagacactgttgattggggcacccattcaatgttttctaatcctccactgtatctacatataactttgtttgaaagaggagactgaggttcagggaggttgggatggcgggatggcaggttgtcaggccccggtgatggaggccaacccctcccgtggctctgtgctccagtgtggtagatgtctaagactctcaaatatagaactagatcagcaggcagagctgggggcattggggcaagctgagagtcactcttgtctggctgagtgctgggacagaaaaggctgagggagggaagtggaggcccaggcttgcccatggtggtgttagagggatgcaagacaggttccagggctcggatggcctcaggagcaagcagggctcccttggctgcctctgctgctgtcacgccagcccaaggctcctgccccagggaggttactgttactgctgtagttgccaccacctgttgctcctgagtggatgctaggcccttccagggcagccagttacagtcagttttccatttccctggtgctcaggaaggattaggagaggtggtctcatggcctgaacagcccatgaaaggcagaactgagagactggggaggaagtgaaagtcctcccagctcagaaggaaaatgcagagaagtagaaatacccagcccctctcccacacccacacagactcagcccacaaactggagagtaaaaataaagaaatcgtacaggaagcatggagcaaatgactgtgagatgtttcgctttagagaagtgaggagcagagggggagcagaggctggagttggctgagaggggaaatccgcaggtacagcctgcggggctcttagagcccagaggtttgttttcctcgggatcagctgccgcccacacaccctggagctgccaggacttctcaggtgtactcgttgtctaagggcctggactagctgggacttaggcttctgccggttccaacactctggtgctggaaggctggacttgggtgactcaagttccctcttcctactgcaatgcaagaaaatacacaaaagaagtatgtatacctttaagtatctcaaagagctatctcagcttctgaatttccttctagggcacctcttcctgcccccattacccacacacgtgcctagcctcaccctaaatcagtatttctcaaaagcttagttctgagcctagcatcagatctggtgtgtgtgctgggtgggagggctttggtaaacatgatgatttttgaaccctaacccagatttattaaataagaacacctaggagtgaggcctggggcatgtccttttaaacaaactgccccttgtgattcttaggcactgtcaggtttgaggacggctgcctaaatggtgtcattgaggaactgaatgaaggccctcccgcttcgggctctctgttgccagaaatctctccttgctttggcttgctgcttgtttattcattgcagcaaacatttcttgagtcggtgtagagcctgtgaggcctgtgtaggatcagctatgcagactccaccctaaaaggagcctgaaaatggtcatgggtaaatcctgagaagggctgagaaaccccagactctgaccgggccactgggtaccaactacccgtgaacagattgtctggcttggggtagggggtggttagagagaggaagttcctctgactgaggaccaagatcccaaggcagcaggcacactgatcctgaccctgaccctcatctccagccctcagcagccagggtaaacaaatactcccctcactgggtatttgtagattacacaaagtaacctaggtgctgactgctgaaaatatacactcccttcccccgtctcctgaatcctggtcccaccaggcctggaagccacagacccagcaagcaaaagagtttccagtcaatgaatctagtctggattgaagctgtgctctgtaatacggtagccactagccacgtgtacctatttaaatttaaattatgccagcgcagtgactcacgcctgtaatcccagtactttgggaggctgaggcaggaggatctcttgagctcaggagttggagaccagcctgggcaacagggtgagatgccgtctctacaaaaagatttaaaaaattagctgggcacagtgacatgagcctgtagtccctgctactgagaaggctgaggtgggagaatcacttgagtccagtctgcatggagccatgtttgcactaccgaattccagtctgggcgacaggagaccctgtctccaaaaaattaatttaaatgaaatcaaataaaaacttagtttcttagttgcactagtcacattttaagtgctcaacactcacattgctagtggctactgtactgaacagtgcagatacagatctcttccatcatcgtggaaagccctactggacggtgctgggctagagtgttaaccagtttcttccagaggttttctgttctcttttcctttatccccctctgccttctgctctcctccacctgaacacagctcattttgcataggtgatggctaaggtcttcaagccaggcacatctctgccctgcactgccaagtaaaaatgataacaccttgggcaagtgatttaacttctttgacagccagtgttctagaaaatagaaataattgtattacctcgaagggtggttatgaagatgagatgagctaagtaaggtattaaatagagtgtttacagaagtccctaacacacagcaagtgcttaaataagtgtaggtgatcattcattcactccaaaaatatatttttggagtgaacacctcctactctgttccaggcactattctaagagctggagatacaccatgaataaaagagacaaaaaccccaggcttagttgagtttcattctagtgtgggagactattaacaggatgtaaattaagtatgtggtatgctagcgactagtgctaaggagaaaaactaaagccgagagggagacagaccccatgtgtgtttgtggcagggtggggtggcatggtgccttggatgggaggccagggaatgccttgctgagaacataatatttgagtgaagacctgaagaaaatatacaaatctctagagattccctatatgtccatcttgggcaggaaaattcttgcctcctctttaacaatgtgtactacctgagggtgtgttatgttctggagcagagggctctgtggggacacatggatgctccctgccctggagaagtatctctggggtaacaagtcctcagccctttagctccttgaagtctagcagagggaagtgctaaatgccaggtcataactgcaagtctgcaggtgggatccttgagggctggagtggcaaggggaaggtgacaaagaaaaggccttttttttttttttaaatacaggatcttactcccgtagcccaggttggagtgcagtggcacaatcactgctcactgcagcctcgacttcctggtctcaggtgatcctcccacctcagcttccggaatagctgggactacaggcgtgcaccaccacatctggctaattttttgtatttcttgtagagacaggatttcgccatgttgcaggctgctctggaacacctaggctcaagcagttcacccgccttggcctcccaaagtgctgggattacaggcgtgagcctttgtgtccagctgggaggtttttttgtgtagttaatctgtgttctttaccctctcctcttgcctgggatctgaagaggtcaaaagtccctggcaaaggcagaggcttttctgccactgggttcaggcttgacgttagctggacctcagcagcctcccccactcctgctcatcccttgccagctctgtcgggtgctttctactcttaggagtatgtccctgaggccctgcatccagcctattctccccagcacctgttctctgaatcagttcccactccacttcccaaccgctttcccgaaaagcatcctttggtcttccctctctatatgatggttacaataactgttaccatttatggtgtgtcaactgtgtgcaagtagctgtgctaggcccttggcatctgtgatctcatgtaatcttcaaaacagcctcaggtgagagaagtgctggccccattgcatagatggtgggctgtaggacaagatgagaggccagttttgcacatatggaaacaaatgtcttttgttttcgtttttgttttgagacagagtctctgtctcccaggctggagtgcagtggtgcaatcttggctcactgcaacctctgcctcccgggttcaagcgattctcctgcctctgcctccagagtagctggcattacgggtgcacaccaccacacctggctaatttttgtatttttagtagagatggggtttcaccaggttgccagtctggtctcgaactcctgacctcaagtgatctgcctgcctcggcctcccaaagtgctataggattgcaggcatgagccaccgcgcctggccgcaacgagacaatcaagagaagatgctgataaggagttggatatgggagtcaggaatttgggaatgaggactgagcttgagatgtaaatgtgggagtcgtgtgctggcagatattatttcaagccctgagagtggctgaggtcccccacatctattcatatgcctttggtcagtggaatgttttgcaatccacatcactataaatgaatttcctctgtctctgagagaggccgctgaggtagcagagagaaaacagctttgagggcaggcagtccaggcctgtctccccattaactgcttcaccagctaggggacctttgggcaagtcactacaagctttaaagtataaaatactttttgaggccggatgtggtgtatcatgtctgtcatcccagtgctttaggaggccaaggcaggaggatcacttgagcccaggagttcgaggctgcagtgaaccgtgacagcaacactgcactccaacctgggtgacaaagcaagaccctgtctcaacaacaacaacaacaaaagtataaaatactgtaacagacaaaaatgcatgcttgataaatgttattgatcctaagagccttttttttttttttttttgagatggagtcttgctctgtcgcccaggctggagtgcagtggcgcgatctcagctcactgcaacatccgcctcccaggttcacgcagttctcctgcctcagcctcccgagtagctgggactacaggcatccgccacgacgcctggctaattttttgtatttttagtagagacggggtttcactgtgtcagccaggagagtcttgatctcctgaccttgtgatctgcccacctcgtcctctcaaagtgctgggattacaggtgtgagccaccgtgcccggtgagccttttttttttgtttttgttttgagacagagtctcactgtgttgcccaggctggagtgcagtggcacaatctcagctcactgcaacctctgcctcccaggttcaagcaattctcctgcctcagcctcctggcctcagctgggattactggtgcctgccaccacacccggctaatttttttgtatttttagtagagacggggtttcaccatgttggccaggctggtctcgaactcctgacctcaggtgatccacccaccttggcctcccaaagtgctgggattacagacgtgagctaccgcgcccggcctttaaaagcctattttgatgggaggagggggatgctataatgtgaggactttctcccagaaaaggagagagaggcactaatgcagtggggataataattaaaatcgcttaacattttttttgaaagattaggtatgttctgaaaatagtgctgaggtttttgcattaattatctaatgtaatcctgacaacatttgaagtacctatggttattatttctattttatggatgagaaaagtgaggcctagagaggttgagaaacaagcccaaagtcacacagctagtgagtgactgagatagggttggaacttgggtatatctgaatcctgggcttgacctgtagacccctgctcctgtggactaggaaatttaaacaaagaacttcctctttttttttttttttgtatttcattatatggatgtactgagtttatttatctggttccccccctttttttttttgagacagagtcttgctctgtcgctcagacttgagtgcagtggcacgatgttggctcactgcaacctctgcctcccgggttcaagcaattctcctgcctcagcctcccgagtagctgggattacaggcatgcaccaccaagccaggctaatttttgtatttttagtagagatggggtttcaccatgttggccaggctggtctcaaactcctgacctcgtgatccacccaccttggcctcccaaagtgctgggattacaggcatgggccactgtgtccggccacccggttaccttttgatggatgtttagttgttcccttcttgctcttacggcccctgctgtggggaataactttgcatatgcctcttgttgtgtgagtgcaagtacacctgcaggatatattccccgaaggggaattgatgggcaaaggccatgagatttgtcatcgtgagacagaatagaagttgcaccaatttatacttccagcagcattgtgagaatgcttgtgtccctatgcccttgccaaaagtgtactattaacctggtatctacacagacaatggcgtctgtgtggaattaatttgcatttatcttatctgaataagattgtatgggttttttaatgtataactgacatttgcataatctactatgacctgcctgttcatattcaatgctaattttattttgattgggtcattaatcttattgtttacaggagctcttgacatattaacatgtcatacatgacttttttttttttttttttggtggtgggggtggtttttgccaagaaatttctttttttccatctctctctctctctctctttctttctcagggtctcacggtgtcacccaggctggagtgcagtgacatgctcatggctcactgcagcctcaatttcctgggactcaagcgatcctcctgtctcagacttctgagtatgaggctcagactcaaaagattggggcttttacaggtgcacaccaccacacttgactagcctttgtattttttgtagagacgggattttgccatgttgctcagactggtctcaaactctgggttcaagcgatcctccctccttggcctcccaaagtgctgggattacaggtgtgagccactgcgcctggctgcaaatttttttttccaactagttgaatttaccagtctcttttatagcttctaggttttgtgtcatacttaataacatccttcccattccaatattttatttttatttattttttgagagaatgtcaatccacctttattggaggaaaccttgcactgtaactgttttaaataatgtgtgccctgccccaccctgtgcctggtgggctcagaagatcatctccagctgccgggcatactcggtgacctgtttggccagttctgtggagggaatggtagtgtcttctggctcctgctgctggccggcaaaactatattagttgttggggcccgggacccaccctcacttcttggtgtagtcggtcatctttttgggtgtgttgaagaagaggatctggtggcctcggtaaaagggattttctcataggctttcttgatgcacccggccatctcatccctgatagtgtcaagcaggatgtcgatgaagacggtgtagctcttggcgaggatgttacccttggccaggaacactttgttgtagctgccctccattaggtattgctccagggacacagggtttttggtgtagacattggtctggatgtccttggcaggcagccactccagctccatgtggaactcagccacccgcttctgggacagcaggaagaggagattgaggcccaagagctggtgcatgtaggctgactggggaagctgttccttgtaatcaaagtagcagcatttgagctgggtcatgtggcgctggaaggaggggatgtcctcgcataggatgctccactggccccgatcttcagtatgtcacgggccagaatgagctgctgtttggtcagcttggtccctgtggttggcaagaagttgagctccagaagaactagcttgaggcagcccagctcttccctgcacttgctaagattggggcttttacggttccactcgcccttgagttgcttgtacttgccgtcctcagcctgcaggacagggccctaggtcgccaggggcccggagctcaaggcgccggctgcactgttcacctccacccccattccaatattttaaaagattctccttttctggtattgttaaaagttttaaaagtttaaatatttgatccattttgaatttattaatattatggatgaggtatgaagtctgactccagctttttctttccagttgtcacctgacatctctttacagtttattgaattcatctttcccccaccaattttcaaagttacattttaaatctaccaaattcctgtatacttgggtttatacgcctcttggcatagcgagtagttaaaagcacaaattctgaggcccaattgtctggacttgaatgcaggtcacccctaattagctatataacctcagtctcttcttctgtcaaatagactattgagaagatcaagttagttaatctatgtagcacacttagaaactgcctgtatgtgtagcaagcacttagactaagttatttttttaatgtggtaaaaacacataatataaaatgtatcagccgggtgcagtggctcacacctgtaatcccagcactttgggaggccgaggcaggtggatcatttgaggtcaggagtttgaaaccagcatgaccaacatggtgaaaccccatctctactaaaaatacaaaaagtagccagctgtggtgacaggcacctgtaatcccagctactccggaggctgaggcaagaggggaggcagaggttgcagtgagccacgattgtgccactgcactccagcctgggcgacaagagtaagactccatctcaaaaaaaaataaaataaaataaccattttaaagtatacagatcagtagtgcagactaaactattttttatttttattagttctgaactttctagtctcttccataatttggtctccctattcatgtgccagtatcgcactgttttaattatgtagttttattttttccttcctatttttttagaggaagggtctcactctgttgccaaggctggagtgcagtgtcttgatcatagctcactgcaaccttgaactcctggactcacgcaatcctcttgccttggctttctgagtagccaggaccacaggtgcatgacaccatgactggctaatttaaaaaaaaatttttttttttttttttgtagagatggagttttgctatgttgcctaggctggtcttgagctcctggtctcaagagatcctcccgcctcagcctcccaaagtgttggcattacaggcatgagccactgcacctggccaagtaaactttagagattaattagggaacactgatgtatttttaatgccgagtcttcctatctcttggtaggcctgatggggcttatgatgagggaggaggagctggggcaggagagcccgacattcaggtctcactgaggggagatgtgcccaggacacttccactggaactgcttccttgatggtgatgtggagtgagctggaccagtgtgtgcgtgcatgtgtctacccaagctcatggcacatgggggagcggagggggtggggatggctcagcagtgattggaatgcaagagtggggactttggggcctgtatgaaaaagtgttatggcagagtgacacacctacgaaagagtgtggtcagcataggcctcacactgggtgggtttttacaaactgaacacatgcatggaaccaccattcagaataagaactgaacagaagcatcctcaggggagccctgaaatccccctatgcacacccctcaaacctccccttatccctcccagctgctccatccacacctccacgtgacttcttaaatcttcagctttgctgcctcatagctaagggggtcagggaggggaagctggggggtctgtagatatggaatgggggtgcgtacatcaggtccctccctctccctgccctcctgccaccttccagaagcacataaaaaaaatctgactgagggccagcctctttgttatactctgagactgtgctcagagatagaagacaagacccctaggccatgcttctgggaaggcagagggctgcgtgttaagcctggaccgagagtcccagagcccagctccggtcctgacaccatgcactgctgtgtgacttctgggccctggttctcctcatccaccaaaatgagcaggttggcctgagtcgtccttaagagtcctgtatagccttaaaacagcgctccttatctcagcaccctacacactggctgtagcttctcctcactgtccctttcaggaccaaaatactgggtgtatccatctgcaggtaccaatggctttcttctaaggccctgctgcgtcctgcttttaatctctttatttctctatctgctcctggggttaggtttgggccagggagtggattgtttgccctccttagatatcctttctttttttgagacagggttgcccagggtggagtgcagtggtgcgatctcggctcactgcaaactccatctccggggttcaagtgattctcctacctcagcctcccgagtagctgggattacaggcatgcaccactatgcccagctaatttttttttttttttttttttgagatggagtttcactcttgttgcccaggctggagtgcagtggcatgatctcagctcactgcaaccttccggtttcaagcgattctcctgcctcagcctcccaagtagctgggattacaggcacccgccaccatacccggctaatttttgtatttttagtagagacaggatttcaccatgttggccaagctgatctcaaactcctgaccttgtgatccgaccttctctgtctcccaaagtgctgggattacaggcgtgagccacttcacccggcctaatttttgtattttttggtatggatggggtttcaccattttggctaggctggtcttgaactcctgatctcaggtgatccgccagcctcagcctcccaaagtgctgagattacaggcgtgagctgccgcacatggccttagatatcttttcctctaattagtttataatctctgagagttgacccaggttgtaccttcttggactggagccaggtggttatctctgatgctgccagaggaggattagatgttttatctcctgagttggtcacacgcgcacgtgggtctctgagtcagcattgagcattacctgtttatgggtccaaaggagcctccctcccagaccctctctccagcagtgtacagtccatcgtgtggatgggaggaaggcaaggccaaggtaaatactgactcagacaaatacaagcaggtacaagaagtacaaatacatatgtgggggaggagggagcaggggcctgccagccaaagctagtcatctgagaagagggggttgcggacaggtggggctgggagctgagtcagagaaggttgctgggcctcccattagagcctgggagccttgacttgccgtagcctgcggccttgcctcttcctggacagtggccgagggtgccctctgaaatgttaaggagaaatgaatgggcccagatggtggggtgacttggggaggacgcgagatttggagtccaaggggaggcagttttaggctctaactcatcctatacacgctgcggctgtgggggaagggagagaaaggccaagggcacgactcctggctcctgagagtccccagtgccccattaggttggcagctgcagtgatggcgctgacccccccttgtgcacacccctcaagcctcagcattcccttccctgggcctctgaagggtggaaagatgtgagaagagcagggaagaggagaggaaattgggagagggggagagagagggtggtggggagcccagagaagggagctgggggtggagcatggagaggtacctgggccaagtagagagaggctttggccaggctcatctgggtccagcgtggattccctcatgcatgagctgtgtgaatttgggcaagttccctaacttctctgatctcttgttgcctcaacaatgaaatggggacaagacttcctccctggcagactttttgtgagtagtgtgctcttagggaaagcccagggcgcagggtaagtgtcccagttgctaatgattgttatggttattatcacatcaaagccaggagccagtctcagtccaaagatggagaatgcaagaacaggtgaccaagagcactgggacttgtcctagccctcgtgggaccaaattctatacttgtttccatgtggacacaaggtgtccacaggcttctcctggaggcttctcagcacccacctacttttagatcaagaccattattgctgacaggggacctttgtttcctctgtagccccttctgaaatcctatgcctttgcaacccaagaagctgggttaggctgggggcctcctgtgctgccagctggcctgggcagcggggacctgcgtctctgctcagaaactggggtggtgagatgggattagcaggcacgagccaagcctgtgtcctcggtggcaggccaggcagctggttcaccgcttacataaacggggccaggaagctgaacttgtttttgctggcaagagctgcggcaagctgcaagagagttgagaaatatgtgtctccgtgtgcgtgtttttctctggttattgacatttgcaagtttacttgaagagggggaaaaagtagaaaaacaacaaagctgtttggattcctggcacccaaacttaggtcccaactggggaggaaccccactttcccagagctgtgctgcagggtccccagaccaaagggtgtctgggccatggtgggggtcccagtgtccctgggagggggaatcctaggccaccggggcagggagatatgggcttgcttgttgggagttactaggacctaaactctctttcccttgaggaatgggaggcaagggaggttgtgggaattttccctcccctagagctctccagggagaaagaagcatttttctgagggcactgggatgatctggtcatcatccttctcccaaagccatcaactattaaataataaatccatagattcattatgtgttttcaagctgagtattgtttgcttcctgccctctgagagctaatgattgggcgccatgggatgctagaccgcaggagtgggggcctgtgggggatctacaggtcacagtctgaatcctcatttcacagagaaggccagtgggctctgccaggggcggtgacgtgcccatggctgcctgtgagtcatcacaagaccaggaatagaactcaggtcacctgacagcacagagctgtttcctctacaccaaggggcctcctgcttgtggagatgtactttattttattttatttatttatttatttatttatttattttcaagaaggagtctcgcccaggctggagtgcagtggtgcaatctcagctcactgcagccttcgactcactgcagcctctgcctcccggattcaagcgattctcatgcctcagcctcctgagtagctgggattacaggcacacaccaccaagcctggctaatttttgtatttttaatagagacagggtttcaccatgttggccaggctggtctcgaactcctgacctcaagtgatccacccgtctcagcctcccaaagtgctgagattacaggcgtgagccactgcaccctactgagatgtactttatattaaagaacaaatcaaggcagactgtacgtttgtgtcagcccaaccccacacaattaatagtcagtgattaaactgaccagaccagaccagacaccaacactgactgttgaggaggagcttgggggtttgttttcgggaggcaatactgcctccttttgtgatcttagtcccaggtgaggtgcttccttgtcctctctgcagaatcccattctttcttagcctgggctgaagctgctccctccctgtatgtgaccctggccttggcgcagtccttgggtgctcttcctccctcctgcctctgcgctgcttcatgatgcacaggagccaaggaggggcaggggacagtcggttttttctcagggagattggaagagaacagaaacaagaagcaatggaatgctcctgtcctggaggttggtggggcagtggggagaggtggggaagccattgagcctgcacatacttttgacaggcttggctcatgcctgccaaccccatcccaccgcctgggtttctgagcagggacatgggtccccactgcccaggccagctggcagcacaggatggcctccaacctaacccaggctcttgggttgcaaaggcatagcatttcagaaggggccacagaggaaccaaaagtccccctgcctgtggagtcaggcctgatctctttgagggtgctcacaccctccatgttcccctgtaggtcttccttccctccttactgcatttcagatactccagacaccagccctccccagaactctcactgttttttgtttttttgagacacagtcttgctctgggtcccaggctggagtgcagtggcacaatcacagctcacttcagacttgacctcctgggctcaagtgatccttctgccacagcctcccagatagctgggaccgcagacatgtgtcaccatgcccagctaattttagagttttttggtagagatggagttttgccgtgttgcccaggctggtctcagccacctgggcacaaacgatcctcccatctcagcctcccaatgtgctgggatgacaggcgtaagccacgatgcctggtgactctcaattcttttttttttaattattattattattattttggagatagagtttcacttttgtggcccaggctggagtgcaatggtgcaatctcagttcactgcaatctctgcctcctgggttcaagtgattctcctgcctcagcctcctgagtagctgggattacaggtgtgtgccaccacgcccggctaattttgtatttttagtatggggtttctccatgttggtcaggctgctctcaaactcccgacctcaggtgatctgcccgcctcggcctcccacagtgctgggattacaggcgtgagccacggcgcctggtgactcagttcttaatgccttgcatatactgttctctctttatggaatgtaactccctgtggctccacttatcaaacccccactcatttatcaaggccccaataaaatctctcttccccctttagaataattgatccctcttcttagttccctcagtatgttggagacatttatatcaggttggcctgtattacagatagttttaagttctagggctttgtggggtttaaagaagattacgatatggaaatgataggaaggagtgccagtgcattgtagatgctcagtagcttcaatatggagttttttttttcctggattaggaacttctgaacttgcacatcatgggtgcacaaaaattattgaattcttgaagaagggacaggcataggcttgcaatcctggctctgaatgctgagcaattgctcacggacaaatgctccgttgattgtgtgctctttgctaaatttcagtgtgtgcaccagccacgccttcgcccccgcgtgccccgtctcctagggcctactatgcaaggcctgtgtcaggccggggtgggagcatgagaatgactgggcatatctcccaggaccaggaaggactgctctcaggagccccctcctcacctggttcctcatcgtgtctcttccttttggcccttctctttggtagggcctacttagggagggccccagcagattcccagggaacagaaaaacagacagatgggaggaatcaaggctgagcccagggatggtgtcttgtgtccaccagggaatcaggcctacaggggagggctgggctatgggtgcagaattcagtgacagtgacagtgagagaactcagcagtgcaagggcaaagtggcactgtttggcctgaaggtgctcggaagctgcttgtattgaaaaatccaccctcatcccccgacatccctcagtgcccactgcgctctgccgtgccctctccctccttcctagaaatcctaactcacacagacccaggctatgtagcttgtttaattaaatatatatatatatatatatatatgtattcattataagagcaatataggcaacttatagaaaattcaaaaactacagaaagacacagggaagagaaagaaatcacctctaacaccatcatttggagaggagggcagaggtagggagaggacacttctatgaatgttacttgttctgagagtcacccatgaggcttccccactgccacccagctgtcaggggtactgagtcagagatttgggtcaggaggcagagggctgagtgggtgggagggaaggggcggtgctgcccactctgactttagcaagtatgttttcttatagtctttatgagtatttctttgatcattctgcatacagtgcttttaaaagcgtagttaacacagtgttgttcgcaggttctagaggaaatatattttgaagcagggctgtgacaggcaatacttgccaatgggtggtttataattaatcattccctgttttaaaaaatagtgactcagttttaaagattcagaaagccattactcaagttccttggcagaggaagtggccattatgttgctccctgcagctctgcttttgtggaagagggaaaaaaaagtatttttatttggtatttctctgagctgctcagatactttggccattgttagtgagtgcaggagcagaacagcccctgctattgttcaggctggccgctaaacatggcaagagcttcccgctgaactggggtaggggaaatgaccagaaagacatttactggatttggcaaaggcagaagcagaaaagagagcttcctctggctccaggagtctatttcttgcctcagcgggctcctctgccccccagcctggggcctgcccatcacacaacacgagagggcaccacttagaccccttcacctgcaaaccgtgcgcctgggagtttttggtgccgagaccctgtccctgtgggcacccctaacatgccctatattcaacaaacatgcatgaagcacctactaagttctctgatgagtgacgaccaggagcttccagtgttgtcaccatggtcggggaagggacctttatatagttgaggactgtgccatgtgaaaagtgccagtgattggatgagctgcagtggtccttgacccctaccttagaccttcatgcatcctgcacttgtgtctgttgcatgccatgtgaattctgatttctgctaatcagcgaatcagctgaggaagggatattgcaagcattgcactgggagcagttctctttgggcactgtttccatctttgctcctgcaagtttgtcatttgtgcaggaacttgaaatccgtgttaggttttatcttgacagctgctttatccagtggaaaatggaaaagtggaaatattgatgcactgattagaagtgtcgttgcatcttccatacgtaaccgcattcaggcactgatggacttcaagatgtgggctggatgtggtaaactgctgcctccatcaggtgctcattggagttcaacgcactggaccgtgtgttcagttgtgatgtagcaggacaagccacagacaaaacccctcagacaccgagttaaagaaggaagggcttcattcggctgggagcttcagcaagactcatgcctccaacaaccgagctccccgagtgagcaattcctgtcccttttaagggctcacaactccaaaggggtccgcatgagagggttgtgattgattgagcaagcagggggtacgtgactgggggctgcatgcaccggtaattagaatggaatagaacaggacagggattttcacagtgcttttctatgcaatgtctataatctatagataacataaccgattaggtcaggggttgatctttaactatcaggcccagggtgtggcgccgggctgtctgcttgtggatttcatttctgccttttagtttttactacttctttctttggaggcagaaattgggcataagacaatatgaggggtggtctcctcccttagtgaaggaaaaggacacaggtcacacacgccaacaccagcagtttcattcttagggaagttcttgggcaagtgcactgagtcatgagaaagttgatagccaccctctttgatatggcaaaacaatgggaatgaccgcaaacctccctcagtgagagaatgatagggtcacacaacgaaatattacatagcagtgagactgaacgaactacgtgtcagtgaatcagagaaacatataaatgaggccgggccaggttgtcatccctctaatcccaacattttggaggcccaggtaggaggattgcttgaggccaagagtttgagaccagcctgggcaatatagtgaaacctcatctctcaaaaaaaaaaatatacagccagtcatggtagcatgtacctgtagtctcagctacttgggaagctgcggtgggaggatcagttgagcccaggaattagaagttgcagtgaaccatgattgtgccactgtacttcagcctgagtgacagagtgagaccctgtcccaagaaaaagaaaaaaaaaaaaagcagccgggcacagagcctcatgcctgtaatctcagcactttgggaggctaaggcaggaggatggcttgaggccgggagttgaagaccagcctgggcaatatattgagaacttgtctctagtaaaaattaaaaaattagccgggcatggtggtgtgcacctcccagttactcaggaggctaaggtgggaggatcgcttgagcccaggagtttgaggttgcaaaaagctatgattgtgccactgcactccagcctgggcagcagactgagaccctgtatcagacacacacacacacacacacacacacacacacatatacacacaaaggaagttcgagaaaagcaccagactgagaccctgtatcagacacacacacacacacacacacacacacacacatatatacacacaaaggaagttcgagaaaagcaccagctgggcgtggtggctcacgcctgtaatcccagcactttgggaggccgaggcgggtggatcacctgaggtcaggagttcaagaccagcctgactaatatggtgaaaccccatctctactaaaaatacaaaaaaaggaaaaaattagccgggcatggtggtgtgtgcctgtagtcccaactactcgggaggctgagacaggagaattgcttgaacccaggaggttgaggatgcagtgagccgagatcgcgccattgcactccagcctgggtgatagagcgagattctgtctcaaaaaaaaaaaaaaagaaagaaaagagaaaagcatatcacagcagaagactatattcaaaccatttatatgaagctcaaaaatgaagcaaagttaagaaaaatgtagggatgtatgggtagtgaaagttaggttggtgggctttcctgggtattttatgcttcataaattaacttttatgtatgtagcttttacatacattatatatatgaatttgcatgtattcagtattatgtaatacattaaaaacaatgttcgcaatgctaaaaatatattgttgaagattctgtgtgaaagctatactgtagttgtggctttttataaccctttcaagccctctgggcagtagcagtccaccccttattgccctcagtggacttcaccttctagggactcagaattttttttttttttttgagacggagcttcgctctttttgcccaggctggagtgcagtggcgtgatctcggctcactgcaagctccgcctccctggttcaagcaattctcctgcctcagcctcccaagtagctgggattacaggagcctgccaccacgcccagcaaattttttgtatttttagtagagacagggtttcaccatgttggccaggatggtctcgatctcttgacttgtgatccgtctcgcctcggcctcccaaagtgctgggattacaggtgtgaggcccagctgggactcagattttgctgaggaccaggacagtactgtgtgctgtgtcctggccttgcagcagtgaatgtgtctcccgtttctcaagggcaggtctctgggatgcctgactgtgtcttccttgccagtgcctggctgctgcagcctcctcaaatgtttatcaaacacaggacttgcccaccgtgggagaaagtaaggccataggtgtctcaggaacctgcccaaactcgcctggctgcacggtgacaattcaaccagctttcttacccaaggtctgttggtgaccagagaaaaccttagatgaccggctgccatgatggccttatatctgtcccttttctgccagccttgaggtagagggtgccagggaggaggactctggctctaggtgttaaagtgagagggaagtgtgaagggtatctgtatagctagacagggctcaatgccaggcagagctgtctccgcccctttgatgtctatgtctctgtccctggactgtggccagtagccagtgtggactccaacctcaccagctttaggggtgttatctgcctgggagtcactgatccttactccctcctctgacagccaccttggatggggtgaaaggaaggacagcctgccaagtatgagataaaaacgcctcataaacaagaagggatttgcaggccaggcagagagccttgtgctgcttctgagtcccaggagcatgggcgaggaggtgaggtcaggcactcagcagctgctggtcctctctgaaatctttggccagatttattgctactgcttgctaataaatggttatgcatttggttcaaaggaccaagtgtgcttacatgaaaactggctgtgttccctggcctctgtttccttagctggttggactaatttgattggttaataaatgagtccaaggtggttgggctaatttttatcttagattctatgactctataactgctactcaaaaaaagtgtacttgttcctttaatctttaatcttatttttcttgagtagtagaatacacccaatttttttcaaggggtagagaatgcattttttttttaaccttccagtttggtccctagagtaaacacagcattgctgtagtagatgtagggtactggagggagcatggaacagggaaccagaagccctggttcctaccccagctgggcatctgggccagtctcttgattcctctgtgcctcagttaccaactatataacgggcattctgccatgaataccctgcgatttggaaacctcctgtgtacgtgtgcacttgggtgcctggcattcattcctaatggcatccattcgttcacacattcatccagtactcagcagactcctgccatgggccaggcaacgtcccgggcacttggaatataatggagaacaaagcagggtgcctacttctgtggtgcttggagtcttgaggggaagagagacacggaattcgtaattacatggcagcgtgtgggtgacgtattgcagaatgagggcctagtggagctgggggaccggaaacgatgtttaggccgagacctggaataggaggagttgtcgtggggatgatgtaggaagaacgagtgtgaggaggagagcgaggggagttgaggggagggctccacaccttctaaggagtggggagagatgaggcctccaaggacagaagggccctgcaggccacgctgaggagcttggacttcatcttgtggatggtggcaggcccttgaagggttttctaatccagggagtggggtggctggatcatggcttcagaaggctctcccaggcagctggatggtgaagaccaggttggggaggtcaccaggagaatgctgccctaatccaggcagaggtgacggtagcctgggccacttcatcattatcactgaggcctctcgtggcttcctcagaccagaacgaagcccccttcttcagtggctgtgggctcaccaagtgtcttctccctcctccagaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatggtgagttgtgcctcagaggtcccggagatagttcccgtaagaaatgaggctttgtgcattccagacagtccctgtctgagccttcaaactcccaccatttccttggcgcaagaattttggggaaggcccaccaatgtctgccatccagatgctggcaaagactgctgctgggtgggagtgggagcgtctgactggtggggaacattggctttgggagttaggacttttggtgaactggtgaatagcctggggcccggagtcaggcagcctgggtttgaatcctgctccctcacatacagcttaacttctccacccttcagtttcatctttggcaaaataaggttaattttattaccttaccttagagttgttgcaaagggggtgtatgtgaatttgcgtatgtgtgtgtgtgtatatcacacacatatgctgctaaaaagtctgcatagcccatcctaagctctcaaattagctattcttatttttttagaattagcaagttcttagctccctcatacctagataaagacttcctggaaccagtgccctgtgtgtcgagccctatgccaaggcactttcttccttgtatctcttgtaatccttcagcagccttgtcagggaaagcaggcttatcatcatttccatcatcattacattatcatcagtttattttatacatgaggaaactgaagagcagctaggacttgcccaaggccgcacagccaggtctgtgtgactccaaagccctttttttcgatcatcctctctccccttcagacaagttggtcctgaggttcttcccttcccctgtcccggatccgtgtctcagactgaaaggaggactttggtgtcctttaatttcccagctgcgattccattcatgtgtggctgagtgtggccagggtcctgactagctccagggctggggccgaggggcccagccacgtgctcccctcaagggaggctgccctgtctgcgaggtcagtgcgccccaggatccccgcccgcctgctgacacctgcaatgctttcctttcagttccccccgaggagccccagctctcctgcttccggaagagccccctcagcaatgttgtttgtgagtggggtcctcggagcaccccatccctgacgacaaaggctgtgctcttggtgaggaagttgtaagtatcttgggctgagctatgtgcatgttggctccctccttcccgaggccccccagagaggggctggttcaggtgatttcaaaacattatcattaggaattaattccttcaggctgaggaagaggagatgagagggaactgagatttacatttgactgccccccctgagctaggcactgtgcttgtgcttggaaccttgtcctattcacttgaccttggttatcacaacagctatgggaagtgggctttatttttctcacttaacagatggagagactgaggcccagagactgattaacaggtttggttcacttagctagtaagtggctctgctgggaattcaatcccagtctgtctgatttcattcaaagtccgaagattatgggcgttgctctgaaaaacatgcaaatatccctgggagggggtgtagcacagccagaccattatcagtgtctgggcccttgtgggcgtatcaggctatttccatgataaagacacgagagagaaagcggtgatgggcgggggagagggagcttggggccgtggggggagaagtcacgcctgcctgggggctctgcatcatcaccggaagacggcttaacgtgggaagacctgggatgggttcaggcatggatgtagaggaggtggaagatgctgaaaacaaatctgcctctgcagttttgctggtctccatcccagagccacagtctcccttagtccagaggtttacaattgagtttgagctgtcagtcatcagaatatagggcaaggaggtcgcattccaagacccctagtggatgcctgaaatcgcaaatggtgctgaaccctatatatagtatgtttttctatagatatgtacttatgatagtttaatttataaattaggtgcagtaagaggttagcaataactaaaaatagcatagaacagtgataacaatatactgtaataacagttatgtgaatgtggtctctctgtttctcaaaatgtcttattactgtactcacccttcttgtgatgatatgaggttgtgaaatgcctgcatgatgggatgaagtgaggtgaatgatgtaggcattgtgactcagtgttaggctactagggctttctgaccatgtgttagaaggaggatcagctgttttgggtgactctgggtcaccgagccatgatgatggcggtggatgtcaggacgagtgatgggtagcatgcacagcgcaggaatgctgaacaaagtgatgattcatgtcctgggcgggacggtgtgaaatctcgtcacacttctcagaacagtgggcactttaaaatttctgaagtgattatttatggaatttcccatttaatatttttggaccgcagttgaccacaggtagccgaaatcttggaaagcaaaacctcagataaggcaggactactgtatcagaaagccagagcagtgacttcaatagggtggttcagctcccacttgggtctgtttccatagagttactgggctgcctggcagtcatgtttttgttctgtcctctatgatgaaaagtgcggattaccatctgtgaatgatgcagctgccattagcactgtcagctcatgccccaagcctggatagcttcacagcccagcaaaggatacaccttgtttgtacctcaaaggcttgtaccatagataggattagccaggatagagactgtggctggcagcttcccaggccagcctgtggaaagctctgtcatttctgacacttcaactgaaatacttttttttttttttttttgagatggagtttcgctctgtcgcccaggctggagtgcagtggtgggatctcggctcactgcaatctccgcctcccgggctcaagcgattctcctgcctcagcctcctgagtagctgggattacaggcgcacaccaccacgcctggctaatctttgtatttttagtagagatgaggtttcaccatgttagcggggctggtctcgaacttctgacctagggtgatccgcctgtctcggcctcccaaagtgctgggattacaggcgtgagccaccgcgcccggcttgactggaatactttccatgttgacagcgggagtgggagagagtacagtgcttgtcctcccgagcagcctcgtgcctttgcttccatctgctttgaagagtcagcatgaccactgggcgcctttgaagtgaggaaagagcaggggaagtggcttcgagagcctcaggggccccagcccccactgaggccccacccagacctcaggccactgcagggcctggaagagacaggcccctggaaagggattactgggagctctgctttttctcttgtgtgtctgctttcacacccttgcccaactgcagcactgctccctccttcttccacaggcaggggtgagctcagcctctgccttggaccaggcgcagtgctggggcagtgggaggaagcgggccaacaagactgagccccggccctctgaccccacctgggcacacacgtaaagcagtcggtgaccctgccttcgtggctgggtggaagcctgggtggtgttgggggaaggaggaaaggggctttaactcagcctggaaaggttgggtttgtcccatgtgctggattcagcaggagcccagggttcgaacccaagtcagaggtggcagactcgtcaccccagctggagggtgagtggttgacgtggcctcacatgcccacatgtgtcataagagggtgaagcctcaggtttccaggccaggtgggatggtggctgactcacctcgaatgtcttcagttacccagaattcttttctggactcacctgccagaacccctctagcactttttgtgtctctggagtggcatttctgctgggtgtctagtcatctgaggacagatcttttttgttagtgccttgaaggcagggtggggcctctcttgattcatttctatatcccctacagtgccaagagcacaggcccagcgggagaccagagctggccagccgaccattgcctgagtgactagctgagccctccagcctagctcccctcacccctcgtgccaggcgctaggctacatgtttatatatatttgtaaatccagctagtttcctcatctctagattttacatttattgctcaattttttttttttgagatggagtctctgtcgcccaggctggagtgcagtctctgtcactgcaacatctgcctcctgggttcaagtgattcttctgcttcagcctcctgagtaactgggactacaggcatgcgccaccacgccaggctaattttttattttattttttgtatttttagtagagacagggtttcaccatattggctaggctggtctcgaactcctgacctcatgatctgcctgcgttgccctcccaaagtgctagaattacaggcgtgagccaccgcgcccggccttatttctcagtcttaacagaaccagccacgtgtgattgttcatgcctgtaatcccagcactttgggaggctgaggcgggcagatcacctgaggtcagcagttcgagaccagcctgggcaacatggtgaaaccccatctctattaaaaatacaaaaatttgctgggcacgctcaggaggctgaggcaggagaatctcttgaacctgggagggaggcggaggttgcagtgagccgagactgcgccactgcactccagcctgggtgacacagtgagactctatcacaaaaacaaaacaaaacaaaaacttaacccctactaggtaagtagtattaatattcctattttcaaatgagaaaaggagacttagaggcacagggcttataagtctggagctgggattcaaaccccgggattccacttcccccttctgtcccgtcttgagtctgtgcgaaactgacaggcaagccctgcccttgttttgtgtctaacagtcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatctgtacgtaagctctaaccccctctccagcagtttccttctcttttgatttaatactccttatcgacttctcagagtggcagggaaggggtggttgaggggtttggtgagttggtgccttttgggcgttgcttgccgggaggtgtggcaatgataaagcaggcccttgtggagctgtgcatggggagtgaacggggctgggtggggccctgcttgctgggatctcagcctacatgggcttctctacactatatttggtgctgcaaaggagtcatgctcacttttcccacagtgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtaaatttatgttttacttctggtcagagaggcgcccctagatgcttaggcgtagtagaaagggtactagaggccaggcatggtggctcacgcctgtaatcccggccctttgggaggccaaggtgggcgaatcacttgaggtcaggagttcgagaccatcctggccaacatggtgaaataccgtctctactaaaattacaaaaaattagctgggtgtggtggcgcacgcctgtatcccagctattcgggggctgagacaggagaatcccttgaacctgggaggtggaggttgcggtgagcagagatcacaccactgcactccagcctgggcgacagagttagactccatgtcaaaaaaaaaaaaaaatagaaagggtactaaaaggaaaaccataggctctagttcctgcttcacaattggctaccttcgttgctttggataaatgttttaagctttctgagccttggtggtatatcatttattaaatgaaaaggataatgccaggccagtctcctcttcccgggcttgtctgtgaggagagcaatgtgggaagagatttgggctgtagacatgtcaagggttgtggcttgcaggattctatagtgcatgggtggggcagggactttctgcttcagcttccgtgggccctgagggcaaccccctctctagcagagcctctggggttgtgggagcctctagaggcctctgccagctgaagcacagggctggccaaggcaccaacccactggggtgctacctgcccagcaccatcctggatacctccccagagtcaccgtgcccccgccctcaggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacaggtactgcggtgggcactgagaaaggaagggatgtttcaactgtcattgcatcaggtatccattgctatgtgacaagttgcctcaaaactagtggcttaggccaggtgtggtggctcacacctgtaatcccagcactttgggaggctgaggcgggtggattgcctgaggtcagcctggccaacatggtgaaaccctgtctctacgaaaaatacaaaaaattagctggacatggtggcaggtgcctgtaattccagctactcaggaggctgaggcaggagaatctcttgaacccaggaggcggaggttgcagtgagccgaaatcgcgccactgcactccagcctgggtgataagaacgaaactccgtctcaaaacaaacaactagtggcttaaaaacgaccatcatttatcggcttgaaatttcaaaaatacagtcagttaggcagctcttctgctggtcttgcctgaatcaggaatgcagctgccatcagattgggatggtctgagatggcctcagtcacatgtctgacgatggtgctggctggtggccgaggccctgggttctccctgtggcttctcatcctcagctgccagcccagactcagggcaggcgggtggggatcccaccacagctggagggatgcactgcagagaagttagccgtatttaatctagggctttttatttttttcaaatgttaaaggtagtaataattgccattggggattgttgaaattagagcatgaaaaattccagaaagatatgaagaataattatcaccagtacttttactccctagagaaaaccagtgagaacatgttagtatgctgctttcctttttctaggtacatgtatgtgtgtgtgtatttatatatataaatgtaatattccccatgttgtcaattacttttggaaacttattatttagtaactgcctgattaatacatatattttaaaactccatggaaatttgttgttgttgttgttgttttgtttgtttgttttgagacggagtctcactctgtcacccaggctggagtgcagtggcatgatcttggctcactgcaagctccgctttccaggttcatgccattctcctgcctcagcctgccgagcagccgggactacaggcacctgccaccacgcccagctaattttttctattttttagtagagacggggtttcaccgtgttagccaggatggtctcaatctcctgaccttgtgatccacccgcctcagcctcccaaagtgctgggattataggcatgagtcactgtgcccggtcggaaattttttttaacttaaatttttttttttttgaagacaggctttctcctcgttgcccaggatggagtacagcagtgcaatcacagctcacggcaacttctgcctcctgggttcaagcaatcctcccgcctcagcctcctaagtagctgggaccacaggcgtgtgccacaatgctaattttttaaaaatgttttgtagagacagggtttcaccatgctgcccaggctggtctcgaactcctggcctcaagtgatccaccagcctcagactcccaaagtgctgggattactggtgtgagccactgcacctgactaaactttaaatttttttttttagacggaatctcgctctgttgcccaggctggagtgcagtggcatgatattggctcactgcaagctctgcctcttgggttcacgctattctcctgcctcagcctcctgagtagctgggactacaggtgcacaccaccacgcccggctaatttttttttttttttagtagagacggggtttcactgtgttggccaggctggtcttgaactcctgacctcgtgatccacccgcctcgccctcccaaaatgctgggattacaggtgtgagccaccgcgcctggcctaaacttttaaaattttaatcaaattaatacatgcacatggcaaagaagtaataaacagcttataacactgagcagtggtcccttgtcccatgccttccatttctagtcctgctttctaaggaagctgcttgactctttctgtttctagttcctctgttggtgccctccttaactctaaacaacaagcttatatggcttttttttttccctgataaaaccacttgagacattatctatcaacaccctgctatgaaaggttaggatttagcagatctagaatgcaagaatctccctgaccacaacccagagagtggtcagccagcctctgcttaaatgcttccagagacagagagcttactaccccttgcagcaatctgttttattgttcccagtgtttttgttgtagaatggcttcatggctcactttggggtcaaatgtttctagccctgtggcgtagttgaaccaaattaatcattcttaaatacttggcagttaggaaaaaaaaaagaataagatacccatttatttgagtaagtatggataaaaaggaaaaggtagaattgacatcagtcccatcccgacccctgccactttctcccagccctggccccagggagagaaggcttttatctatgggctgcacattcttcccccagattggatggtgtggggtgatggctcttcctcctggctggctttgtactgtggggtccttgtcccttgtctttcctgtcctggggagagccagaggagtatgctggggcttagggtgtaatcctagttggatgcaataatatgaagtgccggcttccatctttgttggcactttccttgttcatcaaggacaggaggcagctttctattgggccctctcctcaaaagcttttttcctgctcagacctggacaaggagtggggcctaactactatatcttacttagggagaccattttaataaatcagtgcatccttcagggtagatcgtattgacctgtccatggttttctttgatttgtgtatactttgagccaaacacactcatttatctgaatgctgagcatcagtatggctttgggggcctttttaaggggggaaaaatcagctctaacatcgtgcagaggaataggaattccaaatataggctgatccctattttaccttttattccaaccacttagttcagatagtcacaagcagcttaaagcttgtgacaagcagcttaaaagcaatcttgcttttttataaagtttcttctaaaaattttcaaattgtaaaatgtacataagatttaccatttatattattattattattttttgagacggagtctcgctctgtcgcccaggctagagtgcagtggcgtgatctcagctcaatgcaacctctgcctcccgggttcaagcaattctcctatctcagcctcccgagtagctgggactacaggcacctgccaccatgactggctaatttttatatttttagtggagatggggtttcaccatattggtcaggctggtcttgaacccctgacctcaggtgattcacccacctcagcctcccaaagtgctgggattacaggcgtgagccaccgcgccctgcccatttatattatttttaagtgcacagctctgtggcattaagtattgttgtgcaaccatcaccactttacttctccaggacttttttcatcttgtaaaactgaaactcagaatctgttaaacagtaactttcctttcacccactccttcccccagctcgtggcaaccaccagtctacttgctttttctgtgagtttgactactctagtacttcatttgcttgcttgcttgcttgcatgcctgcctacctgcctgcctgccttcctttgtctctttctgtctctctctttttctctttttttttgagacggagtctcactctgtcacccacccaggctggagtgcactgtcgtgaccttggctcactgcaacctctgcctcccgggttcaagcaattctccagccttagcctcctgagtagctgagattacaggcgcctgccaccatgcctggctaatttttgtattttttgtagagacaaggtttcaccatgttgcccaggctgcactctaggtacttcaaataagtggaatcagagagtatttgtcctttggtgactgacttatttcacttagcataatgtcctcaaggtttattcatgtggtataacatgtgtcagactttcctccctttttaaggctgaataatattccattgtgtagagataccacattgtgttgattcattcatttgtcaggggacactgggtttgcttccccattttggttgtgcataatgctgctatgaacacgggtgtaaaatatctgtttagattcctgctttcagttcttttgtgtatatactcagaattataattgtggcattatatggtaattctatttttaaattttcatggaaatgccatgccgttttccacagtggctgcaccattttacacttacaccagagtgtataagggttccagtttctccacatccttgccaacatttgttatttttcattttgctgcaatagtcctccttatggatgtgaagtgttatctcactgtggttttgatttgcatttccctaatgattaatgtctttttttttttttttttgagacagagtctcaccctgtcacccagtctggagtgcagtggggcgatcttggctcactgtaacctccacctcctggggttcaagtgattctcgtgcctcagcctcccgagtagttgagattggcatgcaccaccacacccagctaatttttgtatttttagcagagacggggctttgccatgttggcgaggctgctcttgaactcctgacctcaagtgatctgcccatctatgcctcccaaagtactgggattacaggcgtgagccaccacacccaggctgaggatcttttcatgtgcttcttggccattcatatatctttggagaaatatctattcaaatagaaagttctttcttatgtgaacctaactctggcctcactggcccttgctctgttctcagggataaccaatgacaaatttcctagtctgctctctctgaattcttttggagttcccagacctgcatctgcttgggctcctcttcccaggctgttacatgagatggtctgtgaattcttcacctttctggcccccttcccctgaatctggtctcatttgtggatgtccctctttaagttgctgacactctccttctattggaagatggtgtggtgggggctgtctggccagcactgggtacggtctccactttccagcctcaggtggatgtgcttctttggcatagacacagcttctgtgggagctcagatagaacagtcggtttcttctcatgtaaggagcggaagactttgagccctccaccctatgcatgtgtggtttgaggcaggggaagtcttcaaaacccagttgtgaatatatccaagaaagaaacctgctgctcccctctctgctgagggaagagcaagaggaacttggatgattttgacgcaagagggggattcaggttggaaattggcgggcagttctgaaaaataaggggaaggttagagcactaggtgaggtgtgtgttatggaccacggttatttggctgttagggacgcatcagtgtactaaacactgtatcaccgtgtggggtgagcttacccaccccaaggaccttcagctctcaaggcccagacagacaggatgcacctgcctcccagactaggtgtgggagtggtggcctttgggagacacagaggtcctgggaagcacctgggagtcaggttgtatgacactggtaaagttagttcagctctcagagcctcagtcttgtcatcggtaaagtagagatgatagcaccaatcttgttcctttcagagagtttttgtgagtctgatgaaaaaatattctttagaaatgctaaagcatactgcatttgtaaggggatcagcaattacaggacagtgctggttcttgggaggagagtgggaccaggggcatcccagaatcactatcctggatgccatcgtgaactcactgcattggaatctggaggaggaagtagagtgggtggtttgagaaagctttcctggtggttttagtatgtgcttgagggggctggaggagggtgcgtgccccactgtagtatgtctaatacgtaatagatggtgttcacagcacgataaggccgtaagcagactgttctgttggggcagtttagagatagcaggaaaagcttcatggaggaggtgacaattgaattatgtcttgaaggatgtgtaggagggtcccagacagaaaatggggattgtaggcagagtacaaaggcacggagctgtgagcaaggggagggtggcagagagctgcttggtgaggccgacacgtgtgtgggtgggtggtctgagtgggacaggtggaggccggccttggtgggcccctgtaggagtggaagtggaatgccatagagtggggctctggagcctggacttcagcaggtgctgcccccttgaggctggggcctggccccccgcacagactgtagcccaggatagccttttgtatgaagttgggggtcccagggtcactctgtcttagccctgctttggccagcaaggccagcacggtcggcagctttctctcaagcgggagttctgaatttatcctctcctgatgggagttctccctgtcacatcaacattgagtctgggggaatcacaaaatcattttcttcttttttttttttttcagagatggtatctcattctgttgcccaagccggagtgcagtggcataatcatagctcactccagccttgaactcctgcctcagcctctgagtagctaggactataggcatgcatcacgatgcccagctaattttttaaaaaatattttacagagatgaggtcaccctatgttgcacaggccttgagtgatcctcctgcctcagcctcccaaagctctgggatttatagccatgagccactgtgccaggctggagccccttttcaaagagggcgtggggcaaaatgcctgggaaaagcccattaggtataagggggttattccttgcttctcacaaataatccctttaactccctctcctattccccaagaatgggaatcacacctgttggaggaggtgataccaaaggtttgcatttgcacatgagggggtgccctgaagccaggactgggcggtcagtgcctccagctacacgttatcttctcaaactctttggccatccattctggaggagtttgttttgttcctctctgcagcactcccaagtgggacattctggggttaaagagccttggttacacatttccggagagattttgccctgttcacttatccatatggcatccctgaattccctctctgccctgttttctgcagctttctggaacattccactggggccccgcccacttccactgcatcacctgccactttgtgcagagcactggctctggagtcaggcagcattgggtctagttgctgcccttgcccttgactagcacgaccctggggaagtacctcactgagactcagtttgcttatttgtcaaatgggaataataatgcctgcctcaaaaaacccaaaccccagccttgctgggttgtgaggcttcagtgaggtgagaagcaattagcacagagcctggcacatgacaagggtgcaataaatgccagcatgactgcctttcacccgtatctcctgccaagcctgtctctcgagctttggattcatgtcttcaacttggcccagacttctggccagatcctccctcctgtgccaggtgctccgcatgacccaaaccaaacatatcacacccctcacagatctccctgccctgcttgtccaggggacaccccacccacccagctacccagccaggagcttgcacatcgcaccaaatgtctctgccttggtttgggttcttgccacatctcaatagcatctagcagtcagccattctgttgcactccactcttcgtgcccctctccacgaccctcctccctcatcctcgcattgcctatccgcctgacatccttgtgcacaactgggtgattcctaaacgttgggatttcacgggtctgtaaaatttcaaaaacaattctggggaccaattaaagttgctagctttttttttttttttttgaaacggagtttcgctcttgttgcctaggctggagtgcaatggcgtgatctcagctcaccgcaacctccacctcctgagttcaagcaattcccctgcatcagcctcctgagtagctgggattacaggcatgcgccatcatgcccggctaattttgtatttttagtagagacggggtttctccatgttggtcaggctggtcttaactcttgacctcaggtgatccacccacctcggcctcccaaagtgctgggattacaggcatgagccaccgtgcccggctggttgccagcttttaattttgctaagtaaggacataaaatgtaacaagtaagtgataaataactattagcatttaccatcaccataatttcataaaagaaaggatgcttggtcaggcgtggtggctcaggcctataatcccagcactttacgaggctgatgggggaggattgcctgagcccaggagatagagaccagccgggcaccataaggagaccctgtctttacaaaaaaaagttaaaaaaaaattagttgggcatagcagtgcacacctgtagtcctagctaagtgggaggctgaggtggaaggatcacctgagcccagcagttggaggctgcaatgagctatgattgcactactgcactccagcctgggcaacagagggagaccctgtcttaacaacaaaaagactccttaactgccccccacacccgccccccccaaatgaggaagggtgaaacctcaaaatgaggggcgcttttggcacccagacactgtggagatttgtacacacagccttttctgtacttgtctccactaggcttctctccacagaccatcccgggtggcatttgggacccagctggaggtgagtcatttctcctcaggaggctcctcagtgaggtttatttatttgtttctacacgaatagaggagcagtgatgagctgtctgttgggtggtttaaaggctgcgaggaaaggtgtgaagtagggtccccttgctcagcacgcaggagctgcctggcgccactgagcctgtgggtcccacggtctctcctcccctcttcctgtggctttgtggttcattaccactttaaccccagaaacctgagccgccagaggttactgggcattctctgggccacaggctgtgttgggggtcaggactgagagtagaaactttcttcctgaagcatctgtcttgagtatagtatggggagcctttaaaaaaccctaatgacagctgggcgcggtggctcacacctgtaatctcagtactttgggaggctgaggcgggcggatcaccaggtcaggagatcaagaccatcctggctaacacggtgaaaccccgtctctactaaaaatacaaaaaattaggcgggtgtggtggtgggcgcctgtagtcccagctactcaggaggctgaggcaggagaatggcttgaacccaggaggcggagcttgcagtgagctgagtttgcgccacagcactccagcccaggcgacagagcgagactcggtctcaaaaaaaaaaaaagccctaatgactgggtcccatttccatggttctgaggcaacaagcaaggtggagccttcaaggctccagacgaagctgactctggcggggtttggaaaactgctgaactgcacgagcatccatgggcagccatattttctatttagggctgccccatcttcttcttgttttcttcttttttttttagagatgaggtctcactatgttacccaggctggtttcaaactcctggcctcatgggattctccagcctcagtctcccaaagtgctgggattacaggtgtgagtccggcctgcccccatcttctttgtcttctgattttagctttcattctagtgcctccatgccctcaggtcatcctttagataccctgggctataagtgtgtaactgtcctctgctgggctgggaagaacgcaaaggaacaataaactgggtccctcccatgaattctaggttcaattcaggtcgcacttgctgtgcggccttgaacaagtcgctttccctctccgggcctctgtttcccctctgtacaattggaagagtggatgcattcttatacttcctctggtgctgctggtgtgtggtttcccccttactggtgatggcatactccaggaattctggaaaccctccctgacgccgaagcagggtcaccctctccccgcctccttgctagtccttactcctggcccagcgaggctcgtgatttttgtttaaaccattctgtggaattttagaattcttgatggaaaaatgatgagctgacaagaaaatgttttgaaatccagagcattccactcactgcctgttacggttaaggcccaggctttcgcttggatacttagcctcctcttgccttggggtttccgcagaaacactgttcccgtgcagggggagggagccgtgagggtgcctggtccacatccctgctgctgcaatgtgtactaaacccatacaggcaaatgaatatttatttgttatatattttttattgcaaaaaggtgcatagaaggaaattgaaatagtgcttatctctggtgatgtgtatctttccattttcttcttcctgtgtgcaaatatatagtattatgatatatactgtgttacacaataatcataaaaatatatttctttagaaagtttgaatcaaaatacatagaatttttcttgtcttgcattcttcatacagcattatgtcatgtcttcaatgtttttctaaaatatttttggccagacgtggtggcacacgcctgtagtcccagatacttgggaagctgagatgggaggatcactgaagcccagaagttaaagctacagtgagccatcatcatgccactgcactccagcctggcgacggagcgagaccctgtctcaaaaaatatataataattggccaggcacggtagctcatgcctgtaatcctagcactttgggaggccaaagcggatagatcacctgaggtcaggagttcaagaccagcctggccaatatggtgaaaccctgtctctactaaaaatacaaaaattagctgggtgtggtggtgggcgcctataatcccaactacttgggaggctgaggaagaagaatcgcttgaacccagtaggtggaggttgcagtgagccgagattatgccacttcactccagcctgggcaaaagagtgaaactccatctcaaaaaaaaaaaaaaaaatatatatatatatatatatatacacacacacacacacacacacacacatatatatatacacacatacatatatatacacatacatatatatacacatacacatatatatatatacacatacatatatatatataaaataaattttaaaagtttctgcattatgtagttatgtcataatttctacagctagtcccttacggttggatatttggttatttccagcatgctgttttttgttttgttttgttttgttttgttttgttttgttttgtttttgagacggagttttgctcttattgcccatgctggagtgcaatggcatgatctcggctcactgcaacctccgcctcccgggttcaaacgattctcctgcctcagcctcccgagtagctgggattacaggcatgtgccagcacacccagctaattttgtatttttagtagagacagggtttctccatgttggtcagggtggtctcgaactcctaacctcaggtgatctacccatcctcccaaagtgctgggatgacagacgtgagccaccgcgcccagcccatgctgttcttttaaataacattgagatgaactttttttttctgatgctgaagcccctgagacaggactccagggcccatgaatcactaataatgagcctttcttctgtccgcagaatccaggagtcctccagctgagaacgaggtgtccacccccatgcaggtgagctcctgttcttgtaaaagggtcagggctgcagcacctcgtgtttaggagtgtgggctgatgccagaccgaatttggtttaaatccagttctgtcactagtagaaatgtggtcgtggtgagttacctgtgcttttcaaacctctgtgaaagggaatcatagaaattatcttgtcccaggactgtaaggagtggagcagcgctggcctggcgtgcagaactgctctgcgtctagcagctgctatttcatctctgagctttttggacaacgctaatggcttagcttgagattggattctgtttatctgcatccttcccctgtggactcttggtgacataatttgctggaaagaggattacctctgaagctgcttaacaaattccttgagtaatccaatttcctatccaactatatctcctcctgtggcccttaattccctaaatgctaagctgggagtcatagccacttctggagctgtgcggcacagggaaggagcctggggctcttgaaccttatctgtgttccatgtaggaacagctgcaggtgaagcccatacccatggggctagagtgctcccaacacgggttctggggaaactgacaccgactgaggactggccacatcctgctaaactgtgagccttgcatttgctgtttcattggctccttatgttaacattgcaagggagtgcttgtaagggctttttttttttttttttttttttttttttgagacggagtctcgctctgtcgcccaggtgggactgcggactgcagtggcgcaatcttggctcactgcaagctccgtttcccgggttcacgccattctcctgcctcagcctcccgagtagctgggactacaggcgcccgcgaccgcgcctggctaattttttttgtatttttagtagagacggggtttcaccttgttagccaggatggtctcgatctcctgacctcatgatccacccgcctcggcctcccaaagtgctgggattacacgcgtgagccaccgcgcccggccttgtagggcttcttaacgtgagttaagtctgaggccagggccgggcacaggggctcacacctgtaatcccagcactttgggaggctgaggcaggcagatcacctgaggtcaggagttcaagaccatcctgaccaacatggagaaaccctttctctactgaaatacaaaattagctgggtgtggtggcgcatgcctgtaatcccagctatttgataggctgaggcaggagaatcgcttgaacctgggaggcggaggttgcagtgagccgagatcatgccattgcactccagcttgggcaacaagagtgaaactccatttcacaaaaaaacaaacaaaaaaaaagaagtctgtccaaggtgacatagctcgtaagtggtggaaccagcattccagtcatggtagtacctgcatccttgcatcggacctgtaaggacaacagctgcttcagtgtatccactgagcatcttctctgtgcagctttaagcttttggtggagaggcaggtggaaagaaagccccacctttagcaggcatggtgtggatagaaaaaatgcaaataatagtattattgatttttccactgttatgaatgaaatggagaaaggaatgctttgggtggatcagggagggctctgaggaggaggtaactcctgaactggttctgaatgatggtgcaatctgcagaaacaggctgatggtgaggaatgtctcttttaggcacttactactaataaagacgatgataatattctcttcagagattctgcaaatgcgacaagcctcccaggtaaggactgggtattttcatattcccagggtccgagggacagaagatttgtctctgcagaaagtcctttcttatttggacatgtcgtcagaggatcaatcacagatcaatcgcagaaatgttctgtgtgtgtgtgtgtgtgtgtgtgtgtgtgtgtgtgtgttggagagagtcttgctcggttgcccaggctggagtgccgtggcatgatctcggctcaccacaacctctgtctcctgagttcaagcgattctcctgcctcagcctcccaagtagctgggattacaggcgcatgccaccatgcccagctaatttttgtatttttactagagacagggtttcactatgttggccaggctggtcttgaactcctgacgttgtgatccacccacctcggcctcccaaagtgctgacattacaggcatgagccaccgtgcctggccagaaatgttcttttattactttatatgttgaactttgatattgttagctaagatataatgaggagaccgtaagaaaagtgggacaaatcacttcgagatatttgaaaagtgagatatttcacagttggcccacaatacaaatgaatgtgctgcaaacaagattattggagtctgaaatggaatacctgttgagggaaatctttattttgggagcccttgatttcaatgcttttgattccctatccctgcaagaccaggaaagcttaccagtatttgaatcaagaaagatcacaagtcctgtgtttgactaggtatatgggacttatggaatccagactccagaggttcagtagttgagcagctcccctgatgactcttgggcttcgtgaggcagtccttgccctcgttccccatccctgggtggattcctgcctgcactgatgctggctgcctctgctacaacagcccaggtacaaagccctaccatggtgcagtgcacctgtggaggacctgctaaatacctggggctgagctctgcacagttggggactcggagaggattagagccatccctgttctcaaggaggctacagtccaggctctgacaaagagtaaattggtaactgtgacaaagaccagcatgtgagatgggccaaaagggaggcacagataaagcaaagtggaatttagagatttgaaagagtatatcaagctgagcagtcacagaaagctcatggaggaagtgccatttgaaatgggctttgaatggtatgggtgggatgcaagaggttgggtgttcaaaggttgctatgggccgggcgcggtggcttacgcctgtaatcccagcactttgggaggccgaggtaggagaatcacctgaggtcaggagttcaagactagcctggccaacatggtgaaaccccatctctactaaaaatacaaaaattagccaggcgtgatggcaggtgcctataatcccagctacttgggaggctgaggcaagagaatcacttgaacctgggaggcagaggttgcagtgagctgagatcgagccactgcactctagcctgggccacagagtgagattccatgtcaaaaaaacaaaacaacaacaacaaaaacaaaagctgctatggaggaggggaacctccagtcctcttcgtccaccctcactgatgattttttttcttttttttgagacggagtctcgtcaagcgattctcctgcctcagcctcccgagtagctgagattacaggcatgcaccaccacgcctggctaattttgtatttttagtagaaacggggtttctccatgttagtcaggctggactcgaactccccacctcaggtgatctgcctgcctcggtctcccaaagtgctgggattacaggtgtgagccaccgcgcctggccagcattctcaaatttaacatgtctaaaagagaacacctgacgcctccccacctattcaacccagatctgttcttctccatcttccctatctcagtaactggtaccgcatttgctcaggtgcgggggatcgggcaggcttcctccctactcctcatcctgtgtccagtccctcagcaagcgttgtccttgtgctttgagacgtatctaggaattgaccactcctcaccatctccagtgccaacacccagtccagcccctgccgcctctcatccagcagggcttcctgggctgccaactggtctaccaacttctagtcttaacccccaaccaactcttttccaaccagcacttagagtatcccttaaaacacaaatccaagctctctctggctcagtaccatctcccccagagtaaaagtcaaagtcttgacaaagtccccagtttctacgaggagtcccagcaaagccatgtggtcccctatctttagacgttgcctctccattctccctttcctcgctctgccccagccacactgccctccttgctcctccacacatgctctacctcagggcctttgcacttgctgtgtgctctgcctggacacgcttcctctgacattcactttgccagctccttcctattactcaagtctctgctcagatgcacccttctccgggaggcttttcctgataatttttttaaaaaacatttgtttggccgggcgcggtggctcacgcctgtaatcccagcactttgggagccgaggcaggtggatcacgaggtcaggagatcaggaccatcctggctaacacggtgaaaccccgtctctactaaaaatacaaaaaattagccgggtgtggtggcgggtgcctgtagtcccagctcctcgggaggctgaggcaggagaatagggtgaacccgggaggcggaggttgcagtgagccgagacagcgccactgagcaagactccgtctcaaaaaaaaaaaaaattcatttgtctgtctcccttgattggatgtaagatccatttagatacatgataggcactcaaagaatatttgttggatgaaagaaggaacaaatatatggccaggcgccgtggctcatgcctgtaatcccagcactttgggaggccgaggtgggcggatcacctaaggtcaggagttggagaccagcttgggcaacatggcaaaacctcatctctacaaaaaatacaaaaattagccgggcatggtggcatgtgcctattgtcccaggtacttgggaggctgaggtaggagaattgcttgaacccgggaggcggaggctgcagtgagcggagatcacaccactgcactccagcctgggtgacaagagcgagactccatttcaaaaaaaaagaaggaacaaatagaaaagatgatgaaatgttaataaatgagcaagccaagcatactgctttcattacacagctgcatctctcaagagacatgggacatgcttggagaaacttgtctttgcagccagcgcccgctcaccagtctgggctctctgcgctgcctgactctagtaggcatctgaagtgatggctggcaggcagcctcttcgtcagcagtggattgcattttgggtagaagagcctgaatgctgggtccatacaactgtgactgcattcccagcagaaggagatggttttgtttagatgtgccctctgtctagtccagggactctggcagtggtaggaagagcctttctgtgggaagacatggctgcttgcaaagctggtttgttctttccttcattcaaagaaatattttggcgatcctactttgtattcggcactgtgtaagctgctggcagtgttacagtgaaaaagacacatgtggtccctgccttcagggaactcagtctagaggtggaaatggagaaatactgggaggggcacttgctcagcttggagtggggtcaattctcaaaggaaatgacatcacctcatctgagatccaaaggccaagtagggactagaccacaaaagggtgcagcaaaggtagagaaaacagacaggagagaagagggaacgtgtgtggagagccctggaggaaaaagatcatggcttgttggagaactgaatgaagttcatatggctggggcttgagtaccaaatgcagggacaggcaagagatgacacccccatggagaaaactgcttccaaacacttgatttaaagcatccaatcctctctgacattgtcctcaaaggaactgccatcaaggaggtccccaaagccttccgtttgttgtaccctctttgtgccttgtgggagcaggtggaatgtcaccagaaaagccactctgaaagtgagtaggagtctgtggctagccacaggcgctcagaaaccctgagcttgaggtgtctctcttgccaagtggtggaatcctggaatctagagtgggctttgttaagaaacaaacaaacaaacaaacaaaaaacagttaagcttgtcaaatggcctgttggttggcagagctgtttcattttctgggaggggggttggaggggaaggttcctttgaggcttttgacagcaccagctaagtggttttcttctcctcctattcctttttctccatattctcctcttcctcctctatcttcaattttttttttaacctagtgcaagattcttcttcagtaccactgcccacattcctggttgctggagggagcctggccttcggaacgctcctctgcattgccattgttctgaggtgagatgggtcccaggggatggccctgtggtgttctcatatttcttatctagctttcctttgcccattctgaaatttatggtgcatttattcattcatttatccattcatcaaatgaatgcacacaccacaacacacacaacacctactattatgccaagccgtgttttaggtgctgcaggagacaatgctgggcaggacagatacagtctcaggaagaagtcagacacgaagaggtaatcactactgtggtaagagctacaaaaagcatgccatggtgaggagaactgacctggcattaaggaggaagaggaattggtctgagaaagaagagggttctttttttttgagtcagcatctcactctgtcacccaggctggagtgctgtggtgcaatctcgcctcacaggacaacctctgcctcctaggttcaagtgatcctcccacctcagcctctggaatagctgggactgcaggtgcacaccaccctgcctagctaatttttctattttttgttgagatgaggtttcatgttgcccaggctggtctcaaactcccagggtcaagtgatccgcctgccttggcctcccaatgtgttgggattacaggtgtgaactaccatgcccggcccaaagagggttcttaggagagaagcccagcatgtaatatggttgacagcgtgtgcatgcacgtgtctgtgaagggggcgcagcacggttggggcaatatggggcaggaagagtggacaggtaggctggcaccaggtcataaaaggccttgaaagaggtgggaggattttaggccttctcttgaggctaaggagtgtctgttggagtttttttctttttctttttctttctctttcttttcttttcttttttttttttttttgagacagagtcttgctctgtcgcccaggctggagtgcagtggtgcgatctcagctcactgcaaccccaccttctgggttcacaccattctcctgcctcagcctcctgagtagctgggaccacaggtgcccgctaccatgcccggctaatattttgtgtttttagtagagacagggtttcaccgtgtcagccaggatggtctcgatctcctgacctcgtgatccgcctgcctcagcctcccaaagtgctgggattacaggcgtgagccaccgcgcccagcctgtggagttttaagaagaacctgggccaggcgctgtggctcacgcttgtaattccatcactttgggaggctgaggcaggtggatcacctgaggtcaggagttcgagaccagcctggccaaaatgataaaaccctgtctctactaaaaatacaaaaatttgctgggcatggtagtgcttgactgtaatcccagctactcgggaaactgaggcaggagaatcacttgaacctgggaagcggaggttgcagtgagccaagattgcgccactgcaatccagcctgggtgacagaatgagactcatctcaaacaaagaaaaccaaaaagtcactctcaatgcagtttggagactggatggggtgagtgaaaatggatgcagtagcccagggtctgggcaagagataataataaactgttttaggatggtggcaatgggttggagagccatgaatagattcttttttttttttttttgagatggagtttcgcttttgttgcccaggctggagtgcagtggtgcaatctcagctcactgcaacttccgcctcccgggttcaagcgattcttgtgcctcagcctcctgagtagctgggattgcaggtgaatgtcactacgcccggctaattttttgtattttcagtagaaatgggatttcatcatgttggccaggctggtcttgatctcctgacctcagatgatccgcccgcctccgcctcccaaagtgctgggattacaggcgtgagccactgcacccggcctcaagatatattttagaggtagaattgacaaggcttgacaacagattagatgaggaggatgaaggagagggaggagtccgggatgaccctcccatttctggcttcagcagttgggcagatgatactgtcattcactaagactggaaacacctgaggatagacaagtctcagtgaaaagtggtgattccactttgggacccacttgagtttgagatgccccgagaacctcaagcggacacgcttggcaggcaacacagatcgtcaccagcaagtagatggcaataagagtcattgggtgggggttggggatagggctgaaccctgtggggatccaaggtgaaaagttctgtagagaaggaagtgttgggaaaggggctgagaggaaccacaagattctggtgttgtaagaacgagagggagggagtgtgcattagacactgaagaaacacagtaggtgttggaattacaacatgaatatgacctttcctcccttccgagaaccacatactcaaatgatgaaaataccatgtgaaggtattttcatggtagctaacgcctgtaatcccaacactttgggaggccgaggcaggtggatcacttcatgtcaggagttcaagaccagcctgaccaacatggtgaaactccgtctctactaaaaacacaaaaattagctgggcatagtggcacatgcctgtaatctcagctacttgggaggctgaagcaggagaattgcttgaacccaggaggcagaggttgcagtgagccaagattgcaccactgcactccagcctggacaacagagcaagactccgtctcaaaaaaaaaaaaaaaaaaaaaagaaaagaaaagaagaaagaaagtaacattggagaagcaccacacagttaaatccaaggcgcccaagcaggacctccttaggaatattccatgtatcaatccaggaacttaaaggtcacctttaaatgctctgccctagtgttcttttccagccatggttaggaaatactcattcaggctgagttgcaccctggctgctgtctcatcatgcccatttcatcccaatcatcttcgctccatttggtcattggttttgtcattcatttccaagtctgcagaaaagtcagccaatagtgccttcagtgaacaagcaataatgaaatttttcggtgttcacaattttactgcaggaaccggctttttttcataagctgaaaccctaaaagatgtcaggctgggtcttctaggcagtggttaatcgcgatgatctacaagtggaggagacattgcactctgtcctttctacatgtagagagctttctacacgttagctcatcagaccctgccagtagccctgacctagcttgactaccaagtgtggtgtgggttgaaagattagcaagatgactactcaaattgggttcagggttgttttcactttttttctttttctttttctttttctttttttttttttttttgagacggagtctcgctttgtcgcccaggctggagtgcagtggcgcgatcttggctcactgcaacctccgcctcccgggttcacgccattctcccgcctcagcctcccgagtaggtgggactacaggcgcccaccaccacgcctggctaattttttgtatttttttttagtagagacggggtttcaccgtgttagccaggatggtttcgatctcctgacctcgtgatccacccgccttggcctcccaaagtgctgggattacaggcgtgagccaccgtgcccggccttcactttgctttttcaatgaagtagattacaagccgtctgaagggtgcgtgcaagataagattcttaatgagtagaggtagctccttggaggatgcaaagcctgttatattttttggccagtgaggggccatgtcagcatccacgggttcacctcctgcctaccaaaggattccttgcctcaccctaggtataccctcctgtgttctggctctgtgtctacgttagggcttcaacagacttttctcataacccaccacaggccctatagagtagagtagatatgatatacatttgacgggaggaaactgaagctaaaagagatggtgcgataacagctagtaagaataggccaggcgcggtggctcacgcctgtgatcccagcactttgggaggccaaggcaagtggatcacctgaggtcaggagttcgagaccagcctggccaacgtggagaaaccctgtctctactaaaaatacaaaaattagctgggcatggtggtgcacacctgtaatcccagctacttgggaggctgaggtaggagaatcgcttgaacccgggaggcagaggttgcagtgagccgagatcgcgccactgcactccagcctgggcagcagaaggagactccatctcaaaaaaaaaaaaaagatgaagaagaaggccaagaatcaaaccaaaaactcctgctatttctatagggccttaagggtcatctagtcaaactctttcattttataaatgaggaaacagcccccaaaggtaaaatgacttgcccaaggacaagcaagaacacacaccctgagagtccctgcccatggtccccacctgctattggctaagagctgggcccagctggtcccattggcccaccactggcccttaacatgcagcaccatcttggtgtgttgtaatggctaatagaggagcattaggttgggaacagacctggtttgctattctgctgatgatgcttggacactggctggttgctaaacaaccagagtccctgcaggcacagacagggccagtgccctgtgctgagaacatgccaggaatttattttctagcctagtgagtttccattttcttctgtataaggcaaatttgtttggaaagaggccagttatttcaagtgatgaagaagccttctattccccaaatcccctctgtctagcaaagagtataaacttagaaatactgtggggctctgggctgccaaaatggctgaaccatggttaccatgggatggccacatttacagtaggtgaagtgtgagaggttgacttcatcctgccagtgtatactatatttttttgtatggccctaaatctttttccagcaatatcagtgatttttttctttgttttttattactcattctttttttctgaatcatagatgattttttaaaatttaaatatgctatcgaaaaggcttgccatcttacaggggccaattcctcccaccctattctctgtcccccactgattctctgtattttaggttatcaggcactgggaaaatagaattctcctagtagagaattatttttctgcatatttatctagaatgagcttacatcattaagtgaggacttcctatgtgtatgcctatgacttaaacatcatttcgttttgaatgtagtgtatcattccggtattttaaaatcagagcttttgctacctccacagctgggggacgggcagagggactttcatggtgttccgggccatggaggtggctgggtgcagtgggcactgtctgtggcctttggggtaaaaggggtggcaacttggtttctacatatctttctaaaaaagagtgagagttttgagcattttaaaaaacttcttttagctacagaatcttttctttaaatgaaactttttgaagcccaaatatgtaaaatagataaaaggtggaggtcaaggtgcaaaagaaggcagcagagagctcatctgtttcttctttctgcccaccctgtgtcctctccagcccccaggccctgctcacacccatccaggccagctctggacaccctcaggttggctggtttcaaagtcctctttgagtttagtgattttcagaaaagaattcatactcgccttagaatatttcaaaaggaaagctcacctttctttgttacccattcagttactttgaaaaaaaaactgaggacagagattgcttccatattaggtcaatagggacttaaaaaatatatacatacacacatacatatgtatgtgatatgtgattattactggtgatttgctaaataatgacaaatggaaaaaaatatatgtcatccaaagagagccactgttaattttcaaaatgtaaatgtgattgaagtctaacaaacatacagaaaagttcccacatcatgtgtacagcgccatgaagtgtacacacccatgtcattataatgagatgcacgtggcaagtcaagatgccaagacaccaggttgcagcagagaaagaggtttaatcagagggtcaccaaaggaggagatgggaggaaacctctgtagggtccagccgtacggagcttagcgggtgttctccccgtgtgtggagacgagagattgtaataaataaagacacaagacaaagagataaagagaaagcacctgggcctgcgggaccactactatcaagatgcagagaccggtagtggccccgaacgtctgggctcgctgatattttttgcatacaagacgaggaggcagggtaaggaaggtaaatcttctaagtgattgacaaggtgaagcaagtcatgtgattacaggatcgggggcccttcccttttaggtagctgaagcagagagcaggcagcatatgtcagggttttcttctctgcacttataagaaagatcaaagacttttaagactttcactatttcttctactgctatctactatgagcttcgaagaggaaccaggagtgcgggaggagcatgaaagtggacaaggagcatgacccttgaagcacagcaccacagggaggggtttaggcctctggatgactgcgggcaggcctggataatatccagccttccacaagaagctggtggaggacagtgttccctgactcctccaaggaaaggagactcccttttgccggtctgctaagtaacaggtgccttcccagacactggcgttaccgcttgaccaaggagcgctccagcggcccttatgccggcatgacagagggttcacctcttgccttctaggtcacttctcccaatgtcccttcagcacctgaccctatacccgccggttattcctaggttatattagtaatggaacaaagagtaatattaaaagctaatgattaataatgtttataataatgattgataattgttcatgatcatctctgtatctaatttgtattatgactattcttattctattttctttattatactgaaacagtttgtgccttcagtgtcttgcctcggcacctaggtaatcctctgcccacacctcaaatccatctccccaaggaatttggggctagggttgtaaaaatgttggactgggccaaagtgtggagatggttgactggttgcagggtgtagggtgaggtcctgggacaaggagatgaagaagctgtcttctcatgccaatcccgttcctctgtgagggtcttcaaactggttgccggaattaggggtccgtaaaacatcttaagtgatccttaaacaaaagtcttaggatcctaatgtcagaaatcctatctacagaaacaacggggatgcagatggtcagtgtctagggctacgtgactttttgcaataaggaaatgggccaaagtgcagcctgattactgcttcattataactattaatatatttctgtccagaacccagcatgcaatttttgtcaaccctgtggagatggttttacaatcaacacccagatcaagaacacttaatatttagacaaatctcctgagtctttttcctctgcctagtttcttgtttgtttttacacagccatgattattctgtatcctcagctctgcatcctgcctttcacacttagcactataacacaggcattctttcacattagtacaaattcttgtaaatctcagacttttttttttttttttgagacggagtttcattcttattgcccaggctggaatgcaatggtgcgatctcagctcactgcagcctccgcctcctgggttcaagcagttctcctgcctcggtctcctgagtagctgggattacaggcgcctgctaccatgcctggctaatttttgtattttttaatagaggtggggtttcacaatgttggtcaggctggtctcgaactcctgacctcgttatctgcccgcctaggcctcccaaagtgctgggattacaggcgtgagccaccgtgcctggccataaatctcactttcattagctgtagtattaggtggatataccaatttctcttaatcaacctcctattactcctaattggtggcacccaaacattaccaattatttgggtgttattttgcttttatttaattaattaattaatttatttatttattgagacacatcactctgtcacccaggctggagtgcagtggcacaatctcagcacactgcaacctctgcttcctgggttcaagcaattctcctgcgtcagcctcccaagtagctgggattacaggcatgcgccacgacacccggctaattcttttttagtagagacagggttttgccacattggccaggctggtcttgaactcctgacctcaagtaatccacccaccttggcctcccaaagtgctgggattacaggcatgagccaccacacccggccttattttgcttttataaaaaacactgtgttgaacatctttgtgcataaagggtttttttttttttatagctatgttctttcttttcccagaagtagaattcctgggtcagagagtctgaattctttgaaatccagagtgtaatgattctctcctcagtcctttcttacaggagaactccattcaatgactcagcatagctccagtcagcagccctgctgggctctcttcctgtgtggtgtccacatggtgaagccctaaataatattctgcagattgtttatttcatttggataccaagctaaaagccagtggcagatttggagccaactattaattatttatcataacaaggacaggaataacctgtcgatataaaaagaaacccaaggaaaatccccaaatcttgtttttgacattggtttcccctcctctttcccagcccttcctggagtaactgatcttccatggaattgagggaggccaccttgttcccactttggggttaggaggcatgtcagtcacaaagtgggaagcaagagggaggggctgaggcttggggcactggccaccctggcacagttgaagggcccctttaggaaggggacgtgactgtgcttttgaagatccatgtcaccatttcatctttctttgagctgtcaagtgacttttctcagttactgagccctggctttgggcccagagtggagcactgtgaaccaagctgtgatcagaaagatgtctatctccttcctgtgtagcattgactttcctgtcagatgagtcaaattgtgcccagtggtgccgacagttgagtctgtgggaactcaccagcatggtgggagtggaccgagaggcgtagggagaactggggaggtcagcaacattaggagcaagaggaacaggaaggcagttgagggagcagtgggacccttttcctgctattacatggcggttgcaaattatctgcctcctgccagccttactttgaccgagaggcccattttctttccctactaaaagaatgctttctttttttattttctttccttttctttttttttatttttgagacagagtttcactcttgttgcccaggctgaagtgcaatggcacgatctcagctcactgcaacctctgcctcccgtgttcaagcgattctcctgcctcagcctcccaagtatctgggattacaggtgcctgccactacgcctggctaatttttgtatttttagtagagacggggtttcaccacgttggccaggctggtcttgaactcctgacctcaggtgatccgcccgcctcggcctcccaatgtgtggggattacaggcgtgagccactgcgcccagcctatttttcttttttttaagtaaatggatttgggactgatgatgtgtacctaatgaacagcctctgcaatgggacaattaagggactgttaagtgactttttggtgcctcagtttcttcacttgtaaattggaccaacaatacacatctatttccttgggagtgttttggaaactcaccaactcttcagagtatggtgaactccctggtgataaaaacagtcgggtcgggtgtgccggctcatacctgtaatcccagcactttgggaggccgaggcgggcggattgctcgagcccaggaattcaagaccagcctgagcaacatggcaaaaccctgtctctatgagaaatacaaaaatcagtcggatgtagtggcacacacctgtagccccagctactcaggaggctgaggtggaagaatcacctgagcccaaggaggttgaggctgctgtgagctgagatcacgccatagcactccagcctgggtaacagagcaagatcctgtctcaaaacaaacaaatgaacaaaaaacaaaaagacagctgatagttattgctcctttgagccgaaacctgggcgcgccaggccaccagggcagccagctgttggtgttttccactgtgggcttgtcacagggggagctaaaaatctgtgtggtttgtctttgtgtgtttgtgtgaaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaata

SEQ ID NO: 135 - DNA, 59899 bp, Homo sapiens
actggggtggcgcgctacctctgcggagaaggatctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgaggtgaggaggggccgggtgctgggtcgcgtagctggagttagagtgtcggtggtttcggacgggctatctggcactcgaggagacctcccttccccctgagagcagcgcccggaacttgtcagcccagcctggaaatccccacattccttccccttcctgctcccggacctccgaattctacttccacaactttgtcacctcgattatcgcagccctgagtacaaacttcacccaggcgcacgcacgcacccctcttaacgcccgccccgcagaacgcccttcaagaacaaacccccctttttgttaccagatcccacgtttttcccaatccccttttcatctcccctgaaattctattcgctccgcacttgtcttcattctcgaggtggatttcccttccccaaagccgttttttcatcttgaaatcgtaacgtttcagctttgttgaaagttcacaatgcttataaacactattaacgtttctttccttcttttgatcttttctattaataattatcattcctaacgaattccacatctcactgtatcccaaggagaacaaatcagtttttaaaattttacctcctccgacctaaacttttgaagatagtgcaggaagcaagggtctgttcttcagtggatgaacagcattttatttcataatccgaaactgaaaaaaaaaaaaaatcacaggttaaaaataagacgtcaccttttttttttttttttttttttgccttcagaaggaaacgcattttggcttagtttgtgaagtatttcaacaattatactgccttaaaataactagttattagaatgccagggtgaattttctgaaagattgtggtatttgcttttgacagtgctgtaaacaaaccctttaaactgtgtatgactgccagcttcaagttggaacaactcttaatttgaaattacggactcagatcatcagtttagctgtgtgccattatgttaatttcttaaattcatgttaattcctatttggaagtatttttgaactatgaactgaaatattacatttatagaaccaacttgctattaaattgtgctttccaactatttctctttagggataatcttgaacgtttgtttttaatcttgagtgaaagaaaaaaattacaggaaggagaaagtgtcaaaaaggacagactgtagtgggatttttttcttattttaagtatgtattgacaataccagtttaattttctcacaggcaatttagattattataaatactgctgccacctaatttaatataatatagtcttacgtaactaaaaatgttgttctcactcttatttgtgaattgcagtattttcaatttatttaaatttgtttccaaggctttgcacttcagttcagtgttagggcgaaagttaaatacatgtgaagtaggtgttaaaatgtcccctttatagagaaggaaacaggagtctcgctgaaaactagatctgtgtgactccaaatcctgtgctctgaatcattttgtcatgttgacacgtttctcataaaaaccccagtgccacaatttggtttgggaacttaagggcaacccataaatcctctacagtggcagggagggattccccgctccctcctttcagagctgctcattttaatgggagtcagaattctctggccctaatacatttgcagcttggctcctagagaagcatggaatgttctcacagcttctccgtttctttgattgcaaaggcagaatgatcagagttgaggttcctattgtgctttattattttacacagcaaatactaagcaattactacctgctgtacgaactcacaaaggtgcaggagatgtaatcaggaccttcaaagagtttataataattggattgacaaacttatacgaaaaaaactacaaggatgcaaagcagttttaattaaatgcagagtgatgcagaaaatcctgtagatattaaaattagggaatgatcgtttaaggattggagtgagcatttaaggattggaatgagcaaaggatttaccagaagttggccttgaaacctgggtaggatttggataaagggaaaaatgaagacagcccattaataatagcgaatggaggacaaaatgtagaatggagaatatagaacataatataggactagcttgtggaaaggatcagcagtaactaaggtctattaattaaaacaggcaatatatttagtgcttatgttgtgccagttgctgttttgagcactttgcccatattaaggcatttaatcttcataatattatgaagtaggtctaataataataggataaaatcctctttttacacatagggaaacccaggcacaagaaggttaattaatttgcccagctaagtggtagatctaaaggtcatacatagacagcctggcttcagaatctgacctcttaaccatgatacatcctgcgtctccatacagtacgcttgagcgacagcgagtagatagaaaataagatcataccagaaagtctataaaaacccacccttaattgtccaccaggtgcctcaaactatggtagattctgaggatatcaagatatgtgaaacaattactgtgcagtgttctgagtcctgttagggaatgatgtaagagtacactgacagcaaagatgtttgaagtggggggaaattccatataagagatgatacttcaaaagcagtttgtagtgcacagcagagtcaggaaagacattggaataatatatgtagaagcacagactgaaagaacaaggtatgttagaggaagtctagtggtttgctgagtctacagggatggttagtagggagtgatgaaagataagaccgaattataaatggcatggtgtggtcaagcaaaatgaggagcttaagtatttgctttgcagtttggaaactacaagaataatttcagcattattggagtaaaaaagccagattgcttgcaattgcaagcagttctctctagaagtatagtagtaaggtagcttgagggaggagtctgaggaaaggatttttttttttttttagaatagagaaacttgagtattggaaaagatagattggataggcacatcaaagccaaaattttaggttcttaaatagttagaatatttggcattattattcaccctttaaaaagctgttgaggagaagaatgacaggtttaaagttgtgttgtagagagagtgatccaccaacaatgttcagaatgcttggtggggaggaaagagactggaagcaggaacacagttgaaattattgaggtgatcaatgtccaaattaggttagtttgtggtagagagtaaaaagaagagatgggtgggaaagatattatgggagagaagacaggataagatttgtaactgagaaaagctaaaatgtactgcatagatgagagaaacgatggactccattgacttaggcagttgaagaggatgagttgtttgtagatagggaaaaatggtaagtccttgtgactttttaaaaagtgtgtgggcattcatcccattactgggcatatacccaaaggattataaatcatgctgctataaagacatacatgcacacgtatgtttattgcagcactattcacaatagcaaagacttggaaccaattcaaatgtccatcaatgatagactggattaagaaaatgtggcacatatacaccatggaatactatgcagccgtaaaaaaggatgagttcatgtcctttgtagggacatggatgaagctagaaaccatcattctgagcaaactgttgcaaggacagaaaaccaaacaccgcatgttctcactcataggtgagaattgaacaatgagaacgcttggacacagggtggagaacatcacacaccagggcctgtcatggggtagggggaggggggagggatagcattaggagatatacctaatgtaaatgactagttaacgggtgcagcacaccaacatggcacatgtatcatatgtaacctgcatgttgtgcacatgtaccctagaacttaaagtataataaacaaaaaaagtgggtgggcatttatgtgtatatgtgttcatgagcatgtacctatggtgtattgtttttagacctcttaaattgataagactcagagacagaatatctaagaagatgaaatgtaactggaattaaaagaaagatccaagccaaaattcttgaaattattttgtttgaaggtagtagttgaagtcatgtcttcaaagaagttggtatttaaaaagaaaagtcgatgcccagtactttatctttgggtaccttcatagcctggagataaaagctagcagagaattcagtaaaggagacaagaaagaggataaaggaaagaattcaactacattatctggttacatagaaaccaggatataggagaaattcaagaaccagggatggtcaacaatgtgaaaggcttcagaaacacttgtgatatatatagtcaaaatggctacagtctcttcttcttcttttttttttaaactttgcggctatctagtgtatcttagtaagatttaataagaaattagctgattgatcgtgaataagagagctacattggctgaaaaatggctatagtatatagatgattgttttaaagctgtgtgtatacatatccagagcaggagattcattcctttcagcactgtaaatctgttgccctgttacatttggaatgttctgcctccaaagtttcattttcttttaagcaatcagcttcaccctttgctctaaggttgattgatctgctcagtctttttttgtttggatgttctgttttatgtattacccccaaccccaccccctagtgcaaagtgagttaatcagagctatgtttcagatagcatagctctggttagactggcatgctctgggattttgtcattggtaatcttcacttgacaattagagtcaaagatgatgtagagttcatatgtgtgctattttctctatctaggaacccctacccttattttaagactgggcgctcctggcccctgtctgaattgggtattttctgtgctcctgtggcactttgtgcatattctgcatctctaaactttggacttcttaaaggcaagaactatttatatggcttcaattatgtttgtaacggaataaaaattgaataaaagcttgagcttttatttcttaagcaatggtgagaacatggatgttcatcaaagtgctctgtaaaccttttcatttggctaaaatagtctaattttaaaaggccctaaggtcataagcatattctatgtgtttttcaatatgcttataattttgcttttgcatttaggtccttaatctggagagagagtgtatgcttatacatgcatgtgcacgtgcatgagtgtgtgtctttttgtctgatgaaatggggttcttttttttcttttttgcttatggagccagttgtcccaatactatttattgaatagtcctttattttcccagcaaatgagcaaccttttaaaaaatcagatactaaattcttatatacacttgagtgtgttttgttttgtaccattgatttagttgtctattcatttgccaatcagtgctatgtttactttacctttagactgccctttttttttttttctgcgagactttttttttttttgagacagagcctcgcactgttacccaggctggagtacaatggcaagatcttggcttcttagcttgctgcagcctctataagcccaggctcaagtggttgtcccacctcagcttcctgagtagctgggattacaggcatggtccaccatgcccggctgatttttttttttattttttttttattttttatagagatggggttttgccatgttgcttaggctggtcttgaactcctgggctcaagcaatctacctacctcggcctcccaaagtgctgggattacagccgtgagccactgcacccagccttctgttacattttctaattagttattactggtatgtaggagagcttttttttttttttttggagatggagttttgctcttgttgcctgggctggagtgcagtggcgacatcccggctcactgcaacctccgcctactgggttcaagtgattctcctgcctcagcctcccaagtagctgagattacaggtgtgcgccaccactcccggctaattttgtattgttattagagacagggtttctctatgttggtcaggctggtctcgaactcccaacctcaggtgatctgcctatctcggcctcccaaagtgctgggattataggcgtgagccaccgcgccagctggagagctattttttgatgatgttttgtttgactgttatgttaaactctaaatagtcctattattttttgatgatgttttgtttgactactgtgttaaattctcaatagtcctaatagtttgtcatgtgattctcactctttcttgatagatgatcatatcattcacaatttattttccatttttagatcttatttattatatttttgcttaagccctttagagcagtggtgaataactgatgacttcaagcatcttgtctgaatcttgacattaataggaacgcttctaatttttacctttaaacctatagatgcttattataggtttctttcttccttttttttttttttttggaggcagagcctcactctgtcgcccaggctggagtgcagtggtgcattctcggctcactgcaacctctgcctcccgggttcgagcaattcttctgcctcagcctcccaagtagctgggactataggtgcccaccaccacgaccagctaattttcatatttttagtagagacagcgtttcaccatattggccaggctggtctcaaactcctgaccttgtgatccacctgcctcggcctcccaaagtgctgggattacaggcgtaagccaccatgcctggccttgtaggtttcttatagtagtacctgtggcagcaacagcaagagctgcactaataataacagctgttaaccttttattgagtagttacaatgagccaaatgattctaagcactttatgtataatgagttatttaatcatcataacattcctagatgggtaggtggtggtggtaccccatgtttacagataaaggaagtaaaagtgaaggctatttaaaaacttgcctaagatgttaaaatatagggactgaaatttgaacacaagcaatctggttctagagtccctgtatcatctttgttatccttcaccaaggtaaggatggtctctttcagtcttagttttctgacactttgttgttatttttaagttttagatgaacagttgttgaatgttatcagatgcttttcaaacatctgttggaatgaccctgtcattttcctttggtctgttaatatagtaattagcagtatcttttctcattttgaactgtgcttattttaggctaaatacttgttagcattcacactttggttttgttttcaaatctatttagacttttctctaaccatactacaaaaaaatgttaaaggcagtttttcaggcccaaggaaaatgataccagatggaaatacggatctatacaaaggaattaaaagctctagaaatggtaaccacacgagtaaatatgtgccagtctcactctgtcacccaggctggaatgcagtagtgcaaccacaactcactgcagcctcgacctccaaggctcaagcagtcctctcacctcagcctcctgagtagctgggacaacaggcatgcaccaccacagctgtctaactttttattttttgtagaggcgagagtcttactatattgcccaacctgatcttaaacttctgggcttaagtgatcctcctgccttggcctcccagagtgatgggatttcaggtgggagctaccaatgtgaagttttaatatatgcaaaagtaaaatatatgctaaaatagcacaaaggtctggggggagaaatggaagtatactattatatactatgcctgaggtgacataatattacttgaagatagattgtgaaaagttaaagatgtacactataaacctaaagcaaccaataagaaaacaaagaattatagcttattagctaacaaggaaaagagaataaaaaataattaagaaaaataaatgcagaaaagtaaacaggaacaaagaacagtcaagaagaaaacaaatatgaagctgatagctttaaacctaatcatatcacaaattatattaaatgtaaatggtctgaacacccaattggaaagcagagattatcagattggatacaaccacatgctgcctaccccctaaagatgccacttaaatatgaagaaacatacagattaaacaaaaaagaatgggagaggatatgtcatgataacactaatcaaagtaagacagaattggctatagtaatatcaaagtagatttcagagaatgttaccagtggtaaagaagggcatttcctaatgataaaagggtcaatttatcaaaaggatctaccaaataacatagtttcaaaacacaacagggtaaaaactgcaaggagaagtaaatccacagttatattcagggatttcaatatccctttttgaacaatgatagaagtagtagtcagaaaatcagtaaggatatggaagatttgaacactatcaaccaaattcacgtaatgaccatttatgtaacactctaccagcagcagcagtgctttttaagtgcacacagaatattgatttcaagatttataaggctaaagtcatcacgacagtgtggtggtagcatataaataagcaaattgatcagtggaacaaatagagtaggagtcatcctaccttctgttttcataaagtactgttagaacacagccacccctgtttgtttatgtattttctatggttgcttttgtgtcgtaacagtagattggtagctccaatagagaccttatggctcacaaacctagaatatttacctcctacctcatacatgaaaagcttgcccaccctggaattgagagtagccaaatagacccacacctgtgaacaactgatttttaagaaagacgcaaaggcaattcacttgagaaaggataattttttcagcaaatagttttgaaacaattatccgtatatacaaaatgaactcaaatttcagcttgacaccacacataaatattaacttgaaataactgagacctaaatgaccctaaaactataaaacttgtaggaaaaaacctttttgactttatttttattttttatatttttttttttttgagaaggagtctcattttgtcacccaggctggagtgcagtggtgctatctctgctcacttgcagcctcctctgcctcccgggttcaagcagttctcttgcctcagcttcctgtgtagctgggattacagatgtgcaccaccacacccggctaatttttaaaatattttagtagagacagggtttcaccatatacccaggctggtctcgaacttctgaactcaggtgatctacccacttcggcctcccaaagtgatgggattacaagtgtgagctactgcgtcgggccctttatgattttagattaagcaaagacttcttagatacatcaaaaacacaaattgatgaattgaactttattaaaattaaacctcctattcgtcaaaagatactgttaaaagaatgaaaagacaagcatacaagaaaataatgcgtaaatccattttctaataaaggccagaatatcttcttagaactttcaaaacttaatgagaaaacaggaaacccagttgatcaatatgtttgaacagacacatcatcaaagaagatatagccaagcacacacctgccgtagggcctagccattccactcttcacttaccttctattttggggacacacactatgtgttagtttcctaggggctactgtaatagagcatccctttgttacagtatcccttacctgaaatacttagtaacagaagtatattggattttggatttttttttttcagtttgtgttgtatttgcattatatacttaaagttaagcatcccaaatcctaaaatctgaaatccaaaatgccagagctcaaaacgttttggaattagagcatttcagtttttagatttgggatgttcaacctgtaccacaaattgggtggctcaaaacaacaaatttattctctcaaggttttggaggctagaagtccttttgagactttggatagaatcttcctttgcctctcctagcttctggtggtagccatcgtcgttgagattccttagcttacagctgcataactccaatctctgcctgtgtattcacatggtattcttcctggctctgtctctttaaagacaccagtcatattgtactaaaggcctattatactccactataacatccaattaaatctgcccatagagtaacattttgtgctactggggttaagacttcaacatattttttggggggaacagttcagcccataacaaacaaaaagaaaattaatttaattatattgtatttagaacaggggttggcaaactatagcccataagccaaatccagcttgcagccatttttataaataaagttgcatgggaatatacctatgcccacttatttacatattgtgtatggctgcttttgcactttaataacggagttaactaattgcaagagagaacttaaagcccacgaaatctaaaatatttattatctggccctttacagaaaatgtttgctagcctattttagaaggtgttaagtgttgtagaaaaaaaaaaaatcagtaaaggggtataagaaacacagggtggttagggaagatctctatgaggaggtgaatttgagcaaaggctacaaggaattactctctatatattaacttatgaagatgtccactatgtagtgttaagtgaaaaaggttataaaacatttctcacttacatgatcccatctttgtaaaatagaaaagtgtgtatatttatacaatgtaaagttatataatacatgtataaaaaattttgcaagaatatccaccaaaatgttcatggtagttatctcttggtgggattatagtgcactttcacatggcattttttcagtttcttttcattagacatttaaaaaatatttttataaatttaattccttatgtgttattaagttatatcaaaggcttaatgtgtatgaaacaataatggaagattcaactccttgcctaagtttgaagttacttgttgtatttcaaagaggagcactagtacttaagctagaatttaagtgaacaaatcttaaaatggatttttatctctggttacatagaatagttgttagcaggcttaatttagtgctagtagaagaagaaatatgtgattgttaaagaactccgtctgtcataaatgttcctgtcatgtttctgtgacattacatagacgtcagggaagtttgcattaggtgtgggtgagccaataatgtttgcaagcgtatatcaaatcatagcactagggctgggcgcggtggctcatgcctgtaatcccaacactttgggagtctgaggtgggcagatccctttgagctcagcctgggcaacatggcaaaacactatctgtactaaaaataaaaaaattagctaggcatgatggtgccatctctagtcccagctactcgggaggctgaggtgggagaattacctgagcctgggaagttcaagctgcagtgagctgtaattgtgctactgcactgcagcctggtgatgggagtgagacattgtctcaaaaaaaaaaaaaaaaagcactagaatatttgaatactcttatacaagtgtttatgggtttattttattctgaagctcagaacatatctaaagtaggatactttctgcaaacccaaaagcctaagagcagatggggatttttaaagtacacatataataaaattatcaaagccagccttctgaacaagactctcctctctttacagtgaaacccaatggaaaaagcatgacatttagaagtagaagacttagcttcaaatccctactccttcacttactaattttgtgatttgggtaagtaattgatcttgtctgaattttttgtttttttattttacaaagttccaataaataatccctgccctactcacctgattctttaggatattaggagactaaagtgaaataatttatgtgacaacattttgtgtaatgtaaaataatatcctagtgttaattgttatgaactcataattgatactaatggaagagaacagagtggataatttaaaaactaatttaataattagttaattttgtgtaggtattaccaacttctggcagtttattcacagtaacactgtactgtgaaagatatatagaaattttcttcatcttgatccccacgcaacttattaattcaacaagcattattttgccttctatttggcaattttagttcatatactgttctacaattgtaatagtaatgttaccatagtaacaaagtttatattgacattctttttcacatgcaatgtaaatctaaatatattcgtgctttttatttcatccttaggttaagttagaaaatgaaaaaaaaatcacaatccataggtgacaaaaataatttataaagagcctaaccattaaatatttatccattgtaactctactgctttttctctcacttgagaaaacatatggaaatgaaagtaaatgagaatgaacaactatagggataatcttgaatttattctattttaaataaatcatttatgaactttgtttctctaacattaaaagtagcaatacttgttatacatcatctagctcctttcggcacactaccatgttatatcaccatagttgaggaatgattacagcttttggttttcagaaataatctttcctgtatttatggttactagttaggttttggcttcatagaagcttctcaagttacctgcaaatttcaaggaaggttagtgtatgcaatgtatggttataatatatgcatagaaaactctgcaagaggtgaggtaatagtgctattaatataattttaaattaaatattagtatcaacagaaggaaaggagggaaaaaataagcaaactactgtcaattctgtcaatttttttttttatttttttgagatggagtctcgctctgtcacccaggctggagtgcaatggcacgatcttggctcgctgcaacctccgcctcccaggttcaagtgattctcctacctcagcctcctgagtagctgggactataggtgtgcgccaccatgcccggctaatttttgtatttttattagagacggggcttcatcatattggttaggctcgtcttgaactcctgaccttgtcatccgcctgccttggcttcccaaagtgctgggattacaggcatgagccaccgcacccggccataattctgtcaatttttaagcaagccccaagtgaagttaactgtattgcatataatattttatatagtgttactgtgtcttcatctcttagatttggactatgaaatcaagtcccataatagatgtttcttcatcacctctccattacaatcttttaaaaattaggaaagattactttctaaatgtgaaatgtggaatctacctttgcctagttcgctttgcttgtgttccatggtactactcaaacaaatctaattgctttgaagtaatcataaattctttcatggacctcttgttctggagcagctttgttgcaagaatatagtacatttggcttggcacagtggctcacacctgtaattccagcactttgggtggccaaagaaggaggattgcttcagaccaggagtttgggacctgcctgtgcaacatagtgagacccccatctttacagaaaaatttttaaaaaattagctgggcatgctggcaagctgttacatgattagggagtgcataaaatcaagttagtatgtatatttaataaaacaatattgtgttccaagtgcagaactaggaagccatttctcatcaagaagagttaatagttttatttagaagaaaaaaattacacattaagtattttgtctttaataattttagcttttattttaggttcagggagttcatgtacaggttacatgagtatattgtgtgatgctgaggtttggagtacgattgaactgtcacccagttggtgagcatagtacccaatagtttgaaccttaagtatttatttattttatttattttttgagacggagtttcactctgtcgcccagcctggagtgcagtggcgccatctccgttcactgcaacctccgcctcccgggttcaagtgattctcctgcctcagcctcccaagtagctgggattacaggtgcccaccaccacgcccagctactttttgtatttttagtatggacggggtttcaccatgtaggccaggctggtctggaactcctgacctcagatgatccacccacctcggcctccctgagtgctgggattacaggcgtgagccactgcacctagctgacattaagtattttttaatttaaatttattttttgcataagtactaaagattcacatggtcaacattgcaaggctgcagagtatatggtggagcgtctccctaccaccctgatctctcaaataccctgtcacagccagtatttgaacttttatcctcctagagatactgtgcatatataaaaaaacgaatgtgtgttttgttttcttgtatattgttttgcccacaaataatagcaaatgcgttgttctgtaccttaacaatgtaacaatgtattttagataactttatgtttctgtacatatagagcttcctcattttttttaaatggctacaagtatttacatttacatggttttggtataccatcatttaactagtgtcccatcataatcaggttgtttcagccttttactgttaaaaacaatgcagtgaataactttgtacatgtgttgttttattcatatctgtaggataaaataaagtagaatcattagaatcaaatgtgtgtgttttaattttgattgatattgccgaactggctctctgccttgtttgggtagagcttttttctttgtttttaagtgaggtctaatttacaaacaacaaaactgaccatttttaaagtgttcaatgtattgggaagcttatgccaatttacactataacctgtagtgtgtgacgatactttcgttgcttagtctcacaacaccctgttgatactttttgggtttttatatttttgccaacactaatatgtaagaatggtattgggataatttttggtttgtttaccttttgttacatactgcaaaacagaactcataagtgtacagctcagtgaatttatcactgtccagatcaagatacagaacatgctcagcacccagaatgtccccttttatacccttcctcacaaaaaacaactgctctgacctctgtcaccaaacaccgtagacttttgcctctttttgaacttctgtaaaataaatcatgcagagcgtactttcttgccttttttctcttttaaaatttttttgtagagtcagggtctcactattttgtgcaggctggcctcttaactcctggcctcaagcaattcttccccctcagcctcccaaagtgctgatatgacaggtgtgggccactgcacccaacctgtctgatttctttcattctgtattatatatgagattcatccatgatgcatgtatctgttgttatttttcattgctgtgattcaattacttgaatataccataatttatcctagtgttaatagatatttggttgattttatttttcatctattttgaataaaacttctgtaaacattcttgtagatgtctttggaggtattaagcactcgtttcttttggttataccttatctgggcagattttgtttgttttaaggtctaatttataaacaataaaattcaccattttttagttacaacttgataggaaacccatgagtctaacatttctgcgtttcttatcagcaaaaaccctgatggctgccttttttctgaactttgttttgagacggagtctcgctctgtcacctaggctggagtgcagtggtgtgacctcggctcactgcagcctccgcctcccaggttcaagcagttctctgcctcagcctcctgagtagctgggattacaggcggccgccaccacgcctggctaatttttgtatttttattagggacagggtttcaccatgttggtcaggctggtcttgaactcctgacctcatgattcactcgcctcagcctcccaaagtgctgggattataggcgtgagccaccatgcccagccaacttaccttttaaagaatgttggaaggtagactctcagagccgtggagcaaaggacaggcttacttacagtcttcaaagatacagataatgtctccctctagagtaaatggcagacatgcttcctgcatatttttcaagtttagggttacttaagatctgtctttctttcctgtgaagcagcctgttcaggtgtcatctgacttcacaatgccctgtgacagttgggactcaagcagctggcgcaagaaaatgctgatactctgactactgttatgagtaatacagtcctttgcttctgacgcaaaaatgtcatgccttttgccagtatccatgacactgtggtaggctgacttgttagcttgaaagtaaggtaaaatctcagtgcctttgaaacagttgacacagaattcagtgaattttgacaaatgtagtctttttttttttttaaatagaatttcgctttgttgcccaggctggagtgcagtggtgccatctcagctcactgcagcccctgccttccgggttcaaacagctctcctgcctcaagcctcatgagtagctgggactgcaggcatacaccaccacacctggcgtgtgtgtgtgtgtgtgtgtctgtgtgtgtcggggtctcgctctgttgcccatgctggagtccagtggcatgatctgggcttactgcaacctctgtttcacgggttcaaacagttctcctgcctcagcctcccgagtagctggcatcacagacacccgccaccacgccaagctactttttgtatttttaatagagatggggtttcaccatgttggccaggctcgtctcgaactcctgacctcaagtgatctgcccacctcggcctcccaaagtgctgggattacaggcgtgagccatcgcgtcctgccaaatgtatagagtcttatagtcaccaccacaatcaagtcatagagtatttttatcaccccagatttcctttatgcccttttacgtgtgccttctctacctcagccctaggcaaccctggatctgctttctgtcaccttagttttgccgtatcaagaatttctgaggcacatgcctgtaatcccagtgctttgggaggctgaggcaggaggattgctcgagcccaggagtttgagacagcctgggcaacatagtgagacccccatctcttaaaaaaaaaaagaatttcctgtaaatagagttatacaatgtataacctgttgtgtctggcttcgtttattcagtgtaatgcttttgagattcattcatactactgcatgtatcaccagttcatactcttttttttttgtttgctgagtagtattctattatatgtctctaccattgtttgaatgtatgtttatacattcagcagttggtggacatttggattgtttccagtttgggacttatgaatgaagctgctgtgaacatttgagtataagtcttattgtgggcatatgtttttattttggggagtacgctctttggagtggaaataccaagtcttatggtgtgcttttaacttggtaacgaactatcaaattgtttaccagagtgtctgtatcattttgcgttcctatctgagtagttctaatttatatctctcattttgagtgaggttgaaagtatcttttcacatgcttgatttacttgtatttccttttctataaactattcaaatatgtttgcctgttctattaggtgttagaattttttagtgatttgtaggcattctttatatatcgggaaaatttttggccatgctatgaattacaaacatttttttccatttgtcaggtatcttttaaggatacatattatggtgagttttgccatgtagaaatttgtcagtctgaagttcttaatctcacagttatttactaatataagacttcacataagaaagaaacaagatatctcttttaattaaccttaaagtataaattatgttttctagcagtgttttccatagccataacttcagtgggaataaagaaaaataatgtgaagacttaagttttctacattctcataagaattttaccaccttttagaaacacagctacagcatggaaacaagattgtgtcttaaattatgtgtatataagagaaaaaatattaaaagtaatattacatgtgtctgttgcagaaatatccgcgcaagatgttgacgttgcagacttggctagtgcaagccttgtttattttcctcaccactgaatctacaggtaaggttcatgaaataccctatcttctaacttcacaaattaggtttatatatttttatattattatataattaagcttatgtttaattattatgttcatatattctttctaggataatcgagagaataatatcttaaattgattttaataaaaatattcttgataatctgtttttgtataatttgagttgtaacagtcatcttacatgctaagtcagtaatttaagtcagtaatcttaaatgctgtatatcaatactaacaataactttaaaatggggaaggaaagaagtgtgtgggtttttttttttttcttcagtaaatgaataggagaaaatttgttaaatcttgttaaattttacgtcattcatactacatgctcttcaggtattgaagggctgctttcctgtgtctgtaagtccttgtccccaaattacagttacccagatatctaatcattctataggatctggtttttaaccctgtgcatgctgattaccctactgattcttctcttagttgcctgtattacatttaaaatagaatactggctggacatggtggctcacacctgtaatcccagaaccttgggaggcataggcaggaaaataacttgagtccaggaattcagtctgggcaacaaagcaaggccccatctctacaatttttttttttaattagccaagtattagtccattctcacactgctataaagaaatacctgagactgggtaatttataaagaaaaggtttaattgattcacagttctgtaggctgtgcggaagcatggtggcatctgcttctggggaggctttgggaagtttccagtcatggcagaagacaaagggggagtgaggcatctcacatagcgagaacaggaggaagagagagagaaagggaaggtgctacaaacttttaaatgaccagagctcacaataactcattcctcatccaccatctcgaggcagtaccaagtgagaaatccacccctatgatttaatcacctctccaccaggccccacctccaacactggggattatgatacgacatgagatttgggtggggacacagattcaaaccatatcatgcctctagtcccaactactcaggaggctgagccaggagaatcatgagccctggacctcgaggtcacagtgagccatggtcacgccattgcactctatcctgggtaacagagcaagaccctgtctcgtaaaaatatttatgtgtacgtgtgtgtgtgtgtgtgtgtgtgtgtatgtgtgtgtgtgtgtgtgtatgaataatactatcccagctgtcccccttactagctgtaggaccttggtcagtcattttctgtacctcaatttcctgatctatgaaatggtgataataaaggccactacctcctagggttattagtgaggattaaagaagttaatatagaggccaggcatggtggctcatgccagtaatccaagcactttgggaggccgagatgggtggatcatttgaggttaggagttcaagactagcctggccaacatggtaaaaccccgtatctactaaaaatacaaaaattagccaggcggtagtgccgcacgcctgtaatccccactactcaggaggctgaggcaggagaatcgcttgagcctgggaggcggaggttgcagtgagccaagattgcaccactgcactccagtctgggtgacagagtgaaaccctgtttccaaaaaaaaaaatctgagcttggtagcacatgcctgaaagtctcagctacttgggaggctgaggtgggagagtcacttgaacccgggaggcaaaggttgcggtgtgtggagattgtgccactgcactccagcctagggtggcagactgagaccctatctcaaaaaacaaccaaaaataagttaatatagaggaaatatttggacagtgtttggcctacagtaagcattataaaaatgatagttactgcatatttattataaaggttattgttgtctttgaataaaagtttctttatgaaaaaaataaacgtaatataccaaaaccaatctgactacagtggcactcatacttactttgatctgaacatcatttttataaagttacgtaactatgtggtagctgagatatacccttgtttcatgttgagctagtgatcagtgaaaattctcaggtggtttttacatgagttactcttaaactagttctccctcacccaatgtatatttcttattacctaaataggatatatttcctctgttgctaatttcattttatcagttttagcctggtgttctactctttcagcataattttaaatcccaacattttcatccgaagtgttggcagttgtttgtagtcctgtcctctgctaatttgataagcatgtgtgtctgtcttttcccaagttgttgattaaaatgttgaaaataacaggactgcattagctacctgttgctgcctcacaaatactccaaatcttcaaggcttaaaatgataataatacctctcatgatttgtataggacaagactatagataggcaggcacaatcagacgtattcatctttgctgtacaatgtctggggcctcagctgcaatattcagactgggggctggagtcatcttcagactccttcgcttatatgtctgttgttaatggtatctgcaggctgagggctttgctggggccattgtccaaaacaccatacgtggcctctttttatggccctggctttcttacaatgtgtggctgggttctaagggcagatatcccgggagagagaaagaaagctaattggagtctgtattcttttaatgatctagcctctgaagtctcatagcacactccattggctggagtggacacaaggcacccatacagatctgatgtggttgggggaaatgcagtccccacctcttcatgaaaagagtatgcgtgacatcgtaagaaaaacgtgggatgggataaatatgtaggtgtggccattcttaaaatacagtcttctccaaggattgagggcatgcacttcagcatattctacttaagactatcctctaattgacttttttcttaagtcagtttttttatatatgggtaatcaaatataaatttgagtatgaacctataaaagtagcaaaatatcagcaatttcataatgttcattgtaatatcggttatagtatattctttttttttttgctttttttctttttttttgagatggaatctcgtttcgttgcctaggctggagtgcagtggcacaatctcagctcactgcaacctctgccccccaggttcaagcaattctcctgcctcagcctcctgagtagctggaattacaggtgcaggtcaccacgcccgggtaatttttgtatttttagtagagacgggatttcaccatgttggtcaggctggtctagaactcctcatctcaggtgatccatccacctcggcctcccaaagtgctgggattacagacgtgagtcactgcgtccaacccagttatagtgtattctaattcacatttcttcatcttgccctataaacattcaaaataactttatcagatacctttcttaattaaaatactttctttttacaatttaatctcagcctggtagccctgtaaaatgggattaatttgacatgggatggtattattgaagctgtgtctcactttgaaaaacggaacatttgccccttttttttcgagactgaatctcactctgtcgctcaggctggagtgcagtggtgtgatcttggctcactgcaagctccgcctcctgggttcacaccattctcctgcctcagcctcccaagtagctgggactacaggcgcccgccaccacgcccggctaattttttgtatttttagtagagacagggtttcactatgttagccacgatggccttgatctcctgacctcgtgatccacccacctcggcctcccaaagtgctgggattacaggtgtgagccactgcgcccagcccatttgcccatttttaatatttctcttattctgtgtgattaaaaattattcatactgagtctctaattatatctttttagaactctagagtatatttcatatttaacatccctatgattactttagagaaagtataacaagtgattttgccaaagaataaagtgatgtctagggaattgtaaggtctgacccagtatcagagagtaacttagtagagattctccactggatgaaggaccatgctattggaaattgagagtaatatatgcactaagatttacagtaggcatttataaataacagcaagatgatataaacagaccacattataagtttgaaacaaagaaatacacattccagctctgggttttacaggctttgtgagaggtcctgggattccatttggggatacaattttgactgcaaaaactgtttttaattttttctgggctcactgcagccttgacctcttgggctcaagcaatcctcctgcctcagcacacgaccctcacccccaagtagctgggactacaggcgtgtgccaccatgcctggctaatatttatattttttttgtagagatggggttttgccatgttgcccaggctagtaatttttaatctcaaaaacacttcatgggtaactacccaggaaccccacagcaaataggattcattgaggaaagccaccttaaaattgtggacattgaagctagagaaaaagaataaaatcatgtcaaatagttgggacttttatcttggtagtaggtagccactaaataatttaaagtagacaaatgtcctaattattttagaacagtaactgacagtagtatgtaagataaactggaaggaggtcagactgatatagtatcctgtgcttcagcagtcaaagtagcattggaaagaagatgttgatatgcttattaagcatatagaaccaatacagtgcactattgttaagttggaggttagaggaggctaattggagatgttggaagatgactacagagtatctgtcctggatgtctggatgggagtggtgctgttagcagaggcagagaaataagaataaaaaataataagtttgaaaagattatgatacataatagttttggacatgctcatttaaaaatagctatgggatatctcaggtagatatatgtctaatgggctattgaaagcatgggggtttagtgctagagatagggattgagatgtcatcaatgtggagtaggtgataggtaaagcatgtagttgtgtttaattctcttttacccaatctgattctttgtgttttgttttgtttgttttgttttgttttgttttttgagactctgtctcactctgtctcccaagctggagtgcagtggcgtgatctcactgcaacctccacttcctgggttcaggtgattctcatgcctcagcctcccaagcagctgggattacaggtgcccaccatgacacccagctaatttttgtatttttagtagagactgggttttagcatgttggttaggctgattctttgtttttaaataggggatcctatcccatgcatttattttcactctgttgtccagggtggagtgcagtggcttactacatccttgaccccttgggctcaagccatcatcccacttcagcctcccgaatagctgggactataggcgtgcaccaccatgctcggctaattttttttgtttttagtacagatggcatctccctatgttgcccaagctggtttcaaactcctgagctcgagcgatcctcttgcctcggcctcccaaaagtgctgagattatagacgcaaaccatcatacccagggccatgcatttattcttaaaactaaactatttggccatcttgttctattcttcctgttttgtattggtcccttgctgtttcctttgttgtctgagttttgatgtgtggacaatgtatactgtctgtgaccccaactgtactccacaacagcattcaggactgtagaggagaccaccactgcctgttttctggagagtttagtttagacctgggatctaaatggagggacaggatacgttgtggggcaagtatgaatcatgctgcaggcagtctgtgtttcttaaagaaatagtttataccatgggctataaagcatgaatgggtttttcttaattcagctctattatctttataatttgtatatttctttacaaattcaggcattaaattctaaccatattaattttcagttgtgtattgtctttttctgtgtctttagggatattttagtgacggttgagggactctacattgagtgctaccagctagatatcattttgtaccagaaaaattcagtccatttatatattttctattgttcctttttaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggctgtaagttttgtttttgtcttatttcagactttgtcatgactattgaactgcatttttaatgttgtcctttcatctttataaaatgtagtaacttgtggacttagtgacttggacatgtttggtttttaaaaaataagcttagaagtaggaaccacaagtctcctgtctttcctgaaagtcaagcagtttcactttactagagaaatatttgacatgagaccccccccaccacaggaaagtattgttgaattgacataatgatggtaattctcagtatcccttaattgctgagaaaatgcacgtgtaaagcagctacctgaagaaagcgaacaaatactggagtaaatcctttttttttttttggtgacagagtctcgctctgtcacccaggctggagtgcagtggcatcatctcagctcactgccctcccgggttcaagcaatcctcctgcctcagcctcccaagtagctgggactacaggcatgagccaccacgcccggctaatttttcatatttttagtagaaatggggtttcgccatgttggccaggctggtctcaaactcctgacctcaggtgatccacttgcctcgggctcccaaactgctgggattacaggcgtgagccactgtgcctggccttggagtaacaaagtaaacaaaataaacttactatgatccaaaagtgggttatctaatttgtggatcacccagactttactgttttggcatttgcttttcttccaacgagtttgggaaagcaataagaagagaaatataaatgaatcattttggcttctacttagttgcctcttacaaacatatgtatatattacttttaaaaatatacttaatggagaaatcagttgatatttttttccagttataaatgaaagttgattttacatagaaaattaatgtgaaacaaaccagttgatgacagttaggatggatgtatatatattacttcctgaaaagaagtgtaagagttgggatagaaaagaaattgtcatcagcctttcattgtgtccatactttttgcttgggtttgatttttttcatctaatttagatcgcaaatgccttgggtagtatataaattgcataatatttgtggatataaagctttctgaaagatgctaattaatcccttttagtgcctccagaaaaacctaaaaatttgagttgcattgtgaacgaggggaagaaaatgaggtgtgagtgggatggtggaagggaaacacacttggagacaaacttcactttaaaatctgaatggtacgttattttaaatttgtttcatgttagatttattaaagttagtcatttttgctggaatttttattttaccaagtaataatattaaatgctattttaaaacatttaattttttattctgtaacatttcaaatatatgtaaaagtagaggccaggcgcggtggctcatgcctgtaatcccccaggcgcggcggcccatgcctgtaactccagcacttacggaggctgaggtgggcagataacttgaggtcaggagttcgagaccagcctggccaaccagagcaaaaccctgtctctaccaaaactacaaaaattagccaggcatggtggcgggtgcctgtaatcccagtgactcggaggttgaggcaggagaatcacttaaatccaggaggcggaggttgcagtgagcccggattgcaccactacactccagcctgggtaacagagtgagactccatctcaaaaaaaataaataaataaaaaataaaagtagaaagaatagtagaatacccatacatacccatcactcagcttcaacactggtcagctcatgaccagtcttatttcaaaggtactctttgcctatattgtcttgaagagagaatcgcgggcatcatatttcatccaaagatatttcagtatgcgtctctaaaagatgaggacattttaaaaaaaagcataacaacataccactgttacactcagatataaaatattacattttcagttagtgttgatttcccctatgtctcatgaatatgcctatatgtataattttttttacatttgtttcagtcaagattcgaataagctccatactttgtgaatttatgtcttgtctcttaaattataggttctatttgttcttttttcttacatttcagttgttaaactgttatacattgtacattgtttaacatattcccttgtctttttttttttttttttttttttttttttttttttgagatggagtcttgctctgtcacctaggctggagtacagtggcatgatctctgctcactgcaacctccgcttcccaggttcaagcaattctcctgcctcagcctcctgagtagctgggattacaggcatgtgccaccatgcccagctaatttttttctatttttaatagagagggtttcaccatgttggtcaggctggtcttgaactcctgacctcgtgatctggctgcctctgcctcccagagtgcttagatgatagacgtggccaccgcgcctggcccccttgtctttttctttccaaaaaattgcttttagatctacagatttcatcagatttgggtttgattttttttttttccccaaaaaaatattttgtaggagtgatgtgtacttctgtcaggaaagaccagataatgtttcactgtttttcttttttctgatactaagattgagcagtggtttcgggtgttgtcagccttattcctttatttactaagtttcccatttgttttttccaaacagaaaagttgaaagagttttacagtgaacactcttgcataccctagattctacaattaacattttactatctttgctttatcacctatttatctatgcatccttctctccatctctcaatctatctcttttttatgtatttcatagtgagttgcagtcattaatatacctcacccttaatcacttcagtatttcatagtgagttacagtcattaatatacctcattcttaatcacttcagtatttacatgaactagagttcagtattatgtttttaaataaaatttacatatagtgaaaacacaaatcttagtgtatcattcagtgagttttgacaagtacagacacctgtgtaactcaatcagtatcaagacatagaacatgactaacacacctaaaaagttccttcctgctccttcagtcaatcccagcaagtgccccaccccatgagcaactacctgtctgatattcttcaccatagattattttttcctgttacagaatgtctcatataaatgggattatatagtatatactcttctgtgaaaagttttataactcaacagaatgtttccgaaatttaatcatgttgttttcccactagtatttcccttacagctttgagcagtcatcagtgattataatttgtatataaattacaaaactatggtattctgtgttttgttttagctgaaatacttaaagaaaaacttgcctttatcaactgtggtttaccctgaagtacagttcagataggagaagcaagataggtttaatatttttccttaattaccagttttataattagttgattccctagtatcctccaaaggtagaataatgagggcttttctttctcattataaatttatatttaaacatatttgatatgttttaactcattatggattgtcccatctttgatcagtggcagtttactcaaattggctcattcatccttttttttttttttttttgagacagagttttgctcttttgaccaggctgtagtgaagtggcgtgatctcggctcactgcctcccgagtggctgggattataggcacccaccaccccgcccggctcattcatcgtcttgacacaacttccttagcctttgatagctctctgatataacatgcttttacagggtcatcatgtatttcctcacccagacctggaatcaaccttttcccaaaactctctggtttcatttagtgtgaaataatatttacagactacaatctgggtgctacaggaattcatcactactggtttgtcatagtttttagattttttagattttttcagtcgaaagagctaggacatgttttgtggtttgagatataatactatcttttaaaaatacaaattcatactgatattttcagtttaaaattagggctataggtttttacataattatatttacctgacgtctacatcttctttcttatgaactgaaaaacatagttgacaacaacactaacataattattcatttgctttatcctacggttaatacagcagctgcagaataataacaacagtattagcaccaacaaaatgattaccaagaatgattttaagattgtttttctctgtgaaggatgtgtaatagtcagattactgtgttttaatgttacttggaatagttcttttctatgtggttatactacatactcagtacacaagttcatatgtttcattttgcttttaatttttaggaatttttcttaataattatataaaacaatccaaaaagtcaaatctattaatagtattaaggcttgttcagaaaagtctatattctattcctgaatcctctaccttatttccttctccttagaggctaaccatttttgttttggttcaatttggggtttggtttatcctatttttaaaaacagtgttgtatatgaatatttttaattgaggcataatttatataattgtaaataaatatagtaatattacttgaaactttccatggtgatagaaatcagaaagtagttgcctaagtttgactagaaagaggctaagagattttagccctaagactaaaggctaaggggtaatagaaattcttacccctaacctcctgtcaccttctagcatattgtgcttaaagaaatttgtggtacagtaagggttctgttttaggaaaaagaaaaaacagcactgggatcacaaggaaatagataatttttggagaggagtaagtggggatggagcataaaattttaaagcacaatatttttagactacaaatttgaaaataattttatgttttaagatatagatcaaagttaattttaaagaaaggtttatttttaagaaattttgttagtgaccagcagttatattgcaaagtttgctacaacaatctaggtctcatcaaactctttgcaagtaatttttttcactctaattttttcagatgtgtttttaatgactgattcttcaattttttgtatttagggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaaggtagttataaacctgaatttgagagtttatttgacactgtagtcgtttacaaattaaagtagtttttatatttagattttttaagattttaatgtagatttttagattttaattaatgtagtttttagattttacttttttagattttaattaatgtagattttagattttaattaatgtagaaacaagcatttatcttagtgatttttatgaagtcattttatcaataatatcaaatagaatttggaaaaagaaaaatatccataatccaaccacacttaacagctgttttcactttgaatgttttctgttctcaaacatcttacaccattgtaattacagtatgtatgttccatttttattcttttttaaaaatttgatatcataaatatttgtcttttgacatatgaacctgaagagattaacaaatgtaaattaacaaggagaactgaagattctttagaaatctttttttttccattataaggtatatagcatagcataattttcagagaaattagttcatttggtaaggataaattattgtaaaataaaggaaggacaatataaagagtatatttgagtttgtatatgaaattggaaaacataataaaccttaggatttattttatttttcagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccaggtaaattgaaagttaccgtttattcaaatagtccttctttcaaccctctaatcttaaaaagtttcagtcattttctaaatgtctttaagtttctggttatgtgaaatattttgcttgataacctcttctgggttgttatttcaaacaaggggaatcaggaagatatccagatagaaaatacagctttgctaaatacagtagcctttaagtaaaacatgaaaatgatatagggtgataggaaatggcttttttttttttttcttctagagacagggtctccatttgcccaggccgctggctcactgcaattttgaactcgagcttaagtgatcctcctgccttagtctcactacaggtgtgcaccaccacacctggctttttaaaattattattattttttgtggagatggagtctcgccgtgttgcccaggatggtctcaaactcctggccttaagcgattctcctaccttggcctcccaaaatgctgggattacagatgtgagctaccactaccagcctagaaatggcatttttgatgggtgttacaaagaatacaagtaataaagcaaattaagtagaggagcaaaaataaagagattataaggataaggtagctagtgtagggattggtgtgctgcagtccaccaaaatcagcctgtgacttgtttttgtaaataaagttttactggaacacagccacactcatttctttacatattgtctctattctacagtggaagagttgagtagttgcaaaaagagtctctggcccacaagcctaaaatattagtaaatattttatctacctttttatagaaagtttgccaaccactgaggtagaggaagggattgatagggagcttgtaagactgaaaatgatagtatacccaaagatgatgctaccagcaaaagaaatacttggagcttttaaaaaggctatcaccatagcattcagctatccatactcttctctgttttgattccatttatcacaaacagtatgtctttgcttttgttgctctggtcacagtgagcttgttagggaattgggctaatgactttactacttctctccttaccccacttatctaaagtgctcagaatacaatcagaaaaagcaataaaacaaaattggattaatgcttcatgttgtacagagaatatacatacctgaagttcttcaaaatgtggtattaagtatagaatcttaattcagtgctacaaaaaagactgatgtttattttgtatctaatactaaattatcagagtaatatgaccagttatttatctgtatttaatctcctctttttttctgaaagccaagtttaaaagccaggaaaacttttgtttttcttgattgggctggatatcttccttttgcctgtccacatctacgctctacccttctctttgttgtgtcatgctgacctgtatagatttcatctgtgggtttccattctttctagcttccttgtgactgtggttaatggaaggaagggactaggcaggagagaagacagaagaaaagtgaaattggcatgttgattttccctgcttccttccaggaactggctgtctttttttttttttttgagatggagtttagctcttgttgcccaggctggagtgtaatggcatgatcttggcttactgcaacttccacctccctagttcaagcgattcttctgcctcagactcccgagtagctgggattacaggtgtgtgccaccatgcccagctaatttttgtgtttttagtagagatggggtttcaccatgttggccaggttggtctcgaactccagacctcaggtgatccacctacttcagtctcccaaagtgctgggattacaagcgtgagccaccgcacccagccggctgtctttcaacttagggtcactacctgtcaagacagccctctctagctgaccggcttctttcaggttctggtacttcccctcatccctttgggcctagaggtagaaacagctctaagccccagagtactaactgcactgtctaaggattccatatactctgcatgtagtccctttatgaagccctccttgaattattctaaatggagtgtgccatctgtttcctgcagaaatcctaagttatattacaggccctgtggaagaaataaagggaaaaaaggaaagataatagatgtttccatacttctaaaaccaaataactttactgatttggactgctttttaacttacacttatttctctccagaggttgagtttaatgtattagtcttgtgtcaataaaatagtttcaagaggctgaggcaatagaatcacttgaacctgggaggcggaggttgcagtgagctgagatcgcgccattgcaccattgagctccagcctgggcgacagagggagactctgtctcaaaaataaatagtttctaggctgagcgcagtggctcacatctgtaatcctggcactttgggaggccgaggcaagtggattgcttgaggtcaggagttacagaccagcccggccaacatggtgaatcttgttgatactaaaaaagtacagaaattagctgagagtggtggcgggcacctgtaatcccagccactcaggaggctgaggcaggagaatcgcttgaacctgggagaggtagaggttgtgttgagccaagatcgcaccactgcactccaacctgggcaacagagcaaggctgtgcctcaaaaaaaaaagtttctgaattttaacacaatttagaagaccttactaattgaggttttctgttgtttggtttgctttgtttcagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagtaagtacataagtatatgaagaagtaaagctattggaattccagatgtgaactggttctggttttaataatatagcctcattgcttcttagtttgtgatcattttattcaaactgcagtattttaacgttttaatttttaaggacattaagatgtaaaattgaatatggatcattgatagtataagtctatttgatacctaattaaattatcatggaggccagatgcggtggctcacacctgtaatcccagtactttgggaggccgaggtgggcggatcacaaggtcaggagtttgagaccagcctggccaatatggtgaaaccccttctctattaaaaatacaaaaattagccgggcgtggtggtgggcgcctgtagtcccagctactcgggaggctgaggcaggagaatcgcttgaacccaggaggtggaggttgcagtgagccaaggtcacgccactgcacttcagcctgggtgacagaacgagactccgtctcaaaaaaaaaaaaaattcatcatggaatggtgacttagatacatctatcagaaaaccgttaactgttgataagtctagaacattttattcaaggagacttgtccagagatactcctaactagagaatcatatcctgaatcattaaaaccacactgtctagcaaactacaccttagatccccactatcaaaaatatacttgtattataccttttattcattttttttctaatagcacttgataagcccctgggaagcggttgatcctggaattttggttggttagtttttattttccttttttctcctatagataatatatatgatatagaataaaaaaggcacaaaaagagtgtacagtctaaagtaagatcctcactgcaaagcatctgatgttactaagttcaagaaataatcccgtggcatagatttttcattttgagaccttcctatcacagactcatctcttagttatcaatggcagtagctgtggctgaaaaaatcccctaccacctatatccctttacttccagctcttctagaggtttaggtcatgtgacttgagaacatcaaaggcagaaaagtacccttctgccctaagatttctctcataaatgctgagaaagaaatcaattttgctattgctgctgtgggagtcctcagccagattgctttgtcttgaccaggaattcttaaaatgagatacatggggaggagttcatgaaatagtttaaaatgtaggtaaaatattgtggttagtgcctgtgtgcatttttaatggacaagtgtacataatctttgtcaaatcaatgcgtgaatgaagtctctgggttccctttatgttaggaaatatttccagctcataatttttttttaataatttcatgttctttattctgtttgagtgctgcactgtactcatgtgaatttatctattttaacttctgtaccagcagcctttttcccagccttcctggtctgcctgtcctatcctttctgttttgctgtctgtaattgcctcttcatgattaacatatcagtacttaaatttttttttttttttttttggaaatagtgcctcactctattgcccaggctggagtgcagtggcatgaacacggctcgctgcagcctctacctccaaggctgaagcgatcctcatgcctcagcccccaacatagctgggactataggcacgtgtcaccatgcccagcaaatttttgtatttttttgtggagacaaggttttgtcatggtgcccaggctggtcttgaactactgaactgaagtgaaccacatccctcggcctcccaaagtgctgggatcgcaggcacgagccaccacacccagccttactgcttagattttattcaactcctgtcttattctactgactaccatatcttgttattatattcataaaaattttgagaaatcagttaatgccattgatttttttaagacaaactttttacaaaaagcttaacaatgataagtaaaaatgaaatgtcagttgatattacttattgctaaaaaattaaaaattatatgctacatttaatggctattataagttttgaaaaattaatactacaggtatttttaaaaccgaatttaattactggtatttaacaatttatgttttggctgggtatggtggccaaaccccagctacttgggttgctgaggtgggaggatcacctgagcctaggagctgaaggttatagtgcactatagtcatccactgcactccagcctgggcaacagagcgagacactgtctctggaaaaaaaccactatgttttatggattgctttttcagatggttagtgattatcacaacaatactgtgaatttgtttttattacatcccatcactctcaatcatccttatataaagtaataaacttattttagtacatttatcttaatttgttttattattcttgtgaatatttaggagtaagcaatgtgtttaaatagattttccagtttgattttcagcgataagtagtatcaacttatgtttatttcatttttattttttactgttaaaaactttattttaaaaagtttttttctttaaaaaatcatattaactaatttttcaaaatttttataaatataattagaagacctggtatttaatagaataagagaggagttgaataaaatctaagcagtgatgtgttgatcatgaagaggcaattacagatgacaaaacagaagtgaggacaggcagaccaggaaggctgggaaaaggctgctggtacaggagattcaagtagataaatacagtgccagcacacaaacagaataaagaacatgaagttataagaaagagtgatgcctctttagttgttgctcagaatacatttttacctttacaattttgaggttagaaaagagttccagtataattgatcaggctatcaccctgactaaaggaagagccaggtgttttgtgctgggttgggaaaatgctggtataaagaggtagagacaccatgcaattggagggcaagagtattaagaacaaagtaaaagaataatttgcagaattttattttactgttaaaacctttttattttaaggagtttatgtcttttctttaggaccatctaaagcaccaagtttctggtataaaatagatccatcccatactcaaggctacagaactgtacaactcgtgtggaaggtaaaaaatcacatttatattttatctcttataaatctttttttttttttttgaaaccgagtctcgctccattgccaggcaggagtgtagtggcgtgatcttggctcactgcaacctctgcctcccaggttcaagtgattctcctgcctcagcctcctgagtagctgggactacaggtgtgcgccaccacgccccgctaatttttgtatttttagcagagacagggtttcaccacggtggccaggatgatcttgatctcttgacctcatgttctgcctgcctcggcctcccaaagtactgggattacaggcatgagccaccgcgcccagcccttataaatacattttgtatggtattatgaatggaggtcttttaaatagataaatttttattcattttaatagcaaagcatttgattactatttttactaaatagaaaggtaatgctttatatgtattaatattatatagaagtcaggttcataaactacaaataataccttataggtatttaagtacagttctgtgaaagtataagttctataagaagaggaatgttgtttttgtactttggaattttccagagtaactcagaaaataataaaagtttgtgataatcaaaatgtatgctggtaagtgcatgagtagatcatactaaaaaagaaggtagaaaaatactcaagcataaaataaataatttagacctacatagccacagtgcagaattgatacagaaccaaaagctaacggaatgatgctacttacccttttttagttgaggtcatgcttttactcttcatttagtatgtactagttttattttagaaccaaatttaaaatggagattgtgaatcctttccagttaaatatttagagatttgacataatggcatgatttgtgaatatgaagaaaaactgattttttattcaagatttatgagattatttttaaaaataaactattttattacagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaaggtttgtatctgtgagatggagcctgactcttgggtggaaaaatggtggttaggtatggacagggctcccataaaaaacacaagttatctaagactgtctcctcagtatcagggataatcacttgtttattttttaattttttaaattttataaataatgattttctttttttcagagactgggtctcgccaggttgctcaggctggtctcgaactcctgagctcaagcgatctcccctggcctcccaaagtgctgggattaacaggcatatgccaccaaacccagctagtgatcgcatttttaggaatcagtcagcagacaaatttcatcaggatgcaagaacatttccatcactacatgctcacttaaacttcacagtaagctacttcattcatttaagcatattctgattacttacctggtttttaaaatattatttcaagattttgagaactttgtatacatatgactgaaacgtttatctgtagctttattcgtagctttcaaagaagaaaaattgcaattacaaaccgaaagcatttgaagaatttagggaaagcaaatttttttttttctttttgagacagtcttgctctgtcgcctaggctggagtgcaatggcacgatctcagcctctgcctcctggcttcaagcgattcttgtgcaccagcctcccaagtagctggaattaaaggcacgcaccacaatgcctggctaattttgtatttttagtagagacggggtttcaccgtgttggccaggctggtttcgaactcctgatgtcaagtgatccacctgccttggcctcgtaaaatgttggaattacaggaatgagccacagtgcccagcggggaagcaaaatctaagtttaaaaattgactactttacctgtaagttataataaagtgcttttaggcaaggaagtatatgctacaaaaattgataaatcacatgttttggaaatgactgtaaaatatggaaatttcaaatttgttaatatttattatttcaatattcaaactttgttttaaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagaggtatacctggctagaaacatctaaattgatatcctttttctaactctttaggcagctttttcttttgcttatagtgttttggtccgttgaaacgacttccaatttatcatagcctcactacttactagatgtgtgactttcagcaagtcatacttaacctctctgaattacagtctctttatgaacagagtggggttaatactttcttctttttgtaccccaatatgattttatcgtcaagggaaaactcctaaaactatagagtatagagaaatataagagtccaacctttgctgctgattagttatatgttctctgtacctcatccttcacatgagaaaatagtttcctagagcatctggatgacttgtgtaatgtcttagaaccatcagatagaggaagcagaactagaactcagatttccttatgtctttcaattggaagtagtaacaaaggacagaagtaatgaatcgtagcgctccagtctgtgtgttatggtgctgcttaagtggttataaagtgatacaacaactttgaagagaaaaaaactcagtttatagtcttttgttgataattaataattagaattcagctgtgaataatatggttaattagagaaaagccctaagcagagagattcctgccataaagtttttgagctttagtcataatacaggctgtttggacttacatgttattagtgtacagttttaataagcttggttatctagtttactgactttatcaaattaaaaacatggtggagcttaggaagtcctgaaacaggctggaaataactatagaaacttcttaaaaaaaaataaatacagggtctcactctgttgcctaggctagagtatggtggcatgatcatggctgactgcagccttcaactcccaggctgaagtgacccttctgcctcatcctctggagtatctgggactacaggcacatgctgccacactcagctaattttatttttttgtagagagggaatctcactgtgttgcaaaggctgatctccaacacctggcctcaagcgattcttttacctcaaactcccaaagtgctggtattacaggcgtgaaccactgctcagagccaatagaaactttttaaagcagcagccgatgcggtggctcacgcctgtaattccagcactttgggaggctgaggcgggcaaatcacctgaggtcgggagttcgagaccagcctgaccaatgtggataaactccgtctctactaaaacaaaatcagctaggcgtggtggcacatgcctgtaatcccagccatttgggaggctgaggctggagaatctcttgaacccgggaggcggaggttgcagtgagccaagatcatgccattgcactccagcctgaacaacaagaacgaaactccatctcaaaaaaaatagaagctagcataagttgtggagacattaagtttgggtaggtagtcgtatgttgctcagtaaccctgaaagcatcacattagagtagaatataaaaattgttcattttttggtaatattgaatcattaagaaaaggtaaaatctgtttaagaaggtaaaggagcatgtaacttcatgagtaatagttaaggaatatacattcttattgaaggtataaatttcaataaaacattttctaatatgtacagataatatactgtataaataagaaaaattttagtggtgcatgctaaaaaagataaaaataaaggaagtttgttttggtttttgtttttttgagacagagtctcactctgtcgcccaggctggagtgcagtggtgcgatctcggctcactgcaagctccgcctcctgggttcaagtgattctcctgccacagcctcccaagcatctgggactacaggtgcccaccaccatgcccagctaatttttgtattttcagtaaaggggggtttcaccatgttggccatgctggtctcaaactcctaacctcaagtgatcctcccaccttaacctcccaaagtgctgggattacagacgtgagccacagcgcctggccgaggaaattttttaagatacccttttttccaactcgcaaactaggaccgttagtgctttcccctaggtcttactgctttagtcgtcttgctccttaggctgttctctcttgtaggtaagacatacaaaaattgtcagactctataaaatccagagtaatttgagatcattgttttataaattctaaatgtaaataccatcattgttcttaacaatgtattttttatccactgcattggcaatacttttacagacagttttacctgattaagcttgaatccagtacacaaaagacaatgcttacttagaaaactgcagttttaaaagaaaattaagtggtcatgaaattataatgtaaaaataaattacggtattaacttgactttttcattatggaaaaacatgcttaatctgctattcttgctttagggaacttagcagagagcaaatgctatttgataacagttactccagtatatgctgatggaccaggaagccctgaatccataaaggcataccttaaacaagctcgtaagtccaaactcacttctttgaaaaaaaaagtttagggctttgtattaacagaaacattttatcgcttttaaataaagatgtatctcattatgttcaaatgattttatgacaaggaaattttactagattgtaaatgattttcagttagcaaatgtgttcactctgttacagcaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactggtaataaaactgtatcagttattaagaatcagttattttttccttaagcttttaagtactaatttaagtctgttcttcttatacatcttatagtatattggcctcaggagacacctgagaatttgccttatggttactttcatggatttattgaaaaagtattgtgttgtgctttagaacataaaattatgtcagaacattataaaagttgttttccaacaaaaatacttcgcttcttttttaacactttcacaatgccaaatataggccaaataagcaaaagcattgaatagttgaatgaagcacagttcttatttcttccagctgtgaatgtggattcttcccacacagaatatacattgtcctctttgactagtgacacattgtacatggtacgaatggcagcatacacagatgaaggtgggaaggatggtccagaattcacttttactaccccaaagtttggtaagaaataatgaagtttggttttttttctttctcaaacttaggttagaaatgaacttagtttatgtgctaaaattgtgttaaaaagtacatctttggattcatgatgatttttatattatctggctttggttggtggtttctttatagaaagtgttattcctcacctttttggtattttattaactgcttctgactatattcagctgtactaaaaatcctaaaagaatttgtgtatctttccatgtgggttcatttttttcactggtttgggtgtgttctttccttctctatcctcatttctttcttttattgagagattacttgaaggactagtccactttacagtcttcacttccgtacctcccactcagtatttaacatactgaaattaggggtcctaccccacccctgcactgaaacctctctggtgtcactcagaagacctcttgatcatcatatgtactgcatgctttttagttttcatcttttttctactttttttttttggaggcagggtcttactctgttgcccaggctacagtggagtgcaatggcatgaacatggcacactgcagccttgacctcctgggctcaagtgatcctcctacctcagtttctcaagtagctgggaccagtgccaccacatccagctaattttttttatagagatggctggtctcaaactcctgggctcaagtgatccttctgccttggcctcctaaagtgctgggattatagacataagccactgcctccagccttttctgcatttgactctgttggccttccatccttgaaactccctcctcccttgggttttctaaccatactttttctgctagcacagtctcctgagtctccttgttctttggtgttttcttcttcttctcctttttttgctttttttttttttttttttttttttgagacagagtctcgctctgtcacccaggctggagtgcagtggtgcgatctcagctcactgcaacctccacctcccaggttcaagtgattctcctacctcagcctcccacgtagctggggtagaggtgcccactaccatgcctggctaattttttgtatttttgtagagacggggtttcaccatgttggctgggatggtctcgacctcctgacctcaggtgatccacctgcctcggcctcccaaagtgctgggattacaggcatgagccaccgcacccggcctcttgaccctgttttcttacttgcctattcaaactctgtccatggctttagccatcttctctttccttcccaaatacattttccctccctcgttctatgccaaagccataaatttaaatgtgattacaataaatgtatttgtatatttttctctcacataagctgagtgtcaagtcctgttgattgtgcgtaccctttcatcatcattttcttcaactgcaagctcctcatgctaacttctcttttcttagtgcattgcccccagtgaggtcttcacctcatcatctggctcttctgtatcttccctaaagcaaacttaaccaacattctttcttgctccccctacattttgaatcattatagaaaattaccttattttaccataattgtaacccccacccccaagtgccagcctagttaatgataagtagtaaattccatgtgccttgttggttgaatgcttgctgaatgagggaataaatgaatgagtgactacataaaataaatgataaaagttcctgagctttgctgttagggtcagtaatgaatatagtttctgggataaggttggtcccatgtggtggtatgttaataggtatgttatttaaaataaaactttataccataatcttgagaaaaattaaaaaataaacttaaaaatgtatattttatgtatttctgtggagaccagccatctctacagagctttgtatatatgtatgtgtgtgtgtacacacacacataaaagcccatatgtatattttttgtttgtttgtttttgagacagagtcttgctctgtctcccaggctggagtgcagtggtgcagtcatagctcactgcaacctcaaattcctgggctcaagcaatcctcctgcctcagcctcccaagtaactaagactgctggtaggcaccaccatgcctggctagttaaaacaatttttttggtagagatgggatctcgctgtgttgcccaggctggttttgaactcctggcctcagtcctcctgccttagcctcccagagtgccggattacaggtatgagccaccatgctcagcctaaaatttttttattacataggtgttcattatagggaatttagactgtacagtaaaatgtagagaggaagaaaaattagtcctagtcccttaccccaaaataacatatttgtgtatccttttagtgtcttctttgtatatatttttttcctaaaattaaattatacttagtattattttataacctaccttttttcaattctctatctgtagtctcatggatccattatggcttcttcacatggcttgagtcttgccaacgaggaccttacagcttagttgaagaaattttgcataagtaaatcagaaaaaggagaacctgtggactatgtagacagtaaatagagtaggaatttaaatataccagtagtggataattttaccttcaaaggttttatgaagaagaaaatacttgagccttgagttagtatgtggacaaataggaagaaggtggcatcttagagagcagcatgagcaaaggcacaggcttgaaaacataaaagcagatgtttaataaagcaaagtttctgcctaaattagatttggcattttatatatatatacacacatacatacccatatcaatatatatatacacacatatatcaatatatacacacataaatatatatacatacacccatatatatatatatatgatgcttagcatttaagagttaatatttgccaacccatagtttattctcaagcatttaactgatttcttgatttctactgagcttcataggatgttagttacttacaaagggatatgtgtggtggaaggataaaattaagtgaatagtatatggctgcaatattactttcatacattttttactgtaaaagactaagtaaaattcaaaattaatcaggacagtcatttaaaaaatctccaatgttaattatcccaattagtgattaatttgatgaacaagtcctcttttaaatgcagatgaggatttgtgtggtatttagggatcttaggcttgtttactttttagtttattcctactcgtgccactcctcatgcccattgagcagctcctaaagttcttagccctgtaccagctatatcctccttttgaaaaatggtaaataactcttaaaacttctgagagttgcatttttattttttagaaggttaaatgtgtagttcaattatgtttttatagcttttccattttacccagtatttatatttgttctgacataatttctctgttatacagtattagaactcagagataaacttttactaagattctaccaaatgcagatcataaatgttacaaatggttatgtttgaaagctctaacccagtagattacccgatacactgatcatttttatcccccaaccaacatatattttatgctatgcggccaggttaatgtataagacataaatggttgggatgtgatttaccaaagagagaagagggtaaaaatcatcaagtctgaagagaccttgaaaaataattaggattgtattttatcttttcaacagtaagtctggttgggaagttgtattatgtcttcttagttcatatgtcaacattatttcccatcacacctctttttttttttttttttttttttttaagctcaaggagaaattgaagccatagtcgtgcctgtttgcttagcattcctattgacaactcttctgggagtgctgttctgctttaataagcgagacctgtaagtaactttattcatatttttgcattttcccccagctttattgagctgaatttacatgcaataaaatttatccattttaagtgtacagtttgatgaatttttgtaattacatacagatgtataactaccaccataatcacaatatagaacattttcatcacttttataaagcttccttgttctcctttgtaatctgtcttcttctcagcccaaccccaggcagtcattgatctgcttttctgtaactgtagttttgccttttctagaatttttatttatctatctattttgagacagagtttcactcttgttgcccaggatggagtgcagtggtgcgatctcagttcactacaacctctgcctccctggttcagactcctgcctcagccttcaaagtagctaggattacaggcgcccaccaccacacccagctaattttttgtatttttagtagagatggggtatcaccatgttggccaggctggtctcgaactcctgacctcaggggatccaccctcagcctcccaaagtgctgggattacaggtgtgagccacggccaagaattttatataaatagaatcacatagcgtgtagtcttttgcgtatgtcttttacataatatttttgagattcatccatgatgttgcatatacttctccctttttttttttttgagatggagtctcactctgttcccttactggagtacagtggcatgatcttggctcactgcaacctctacctcctgagttcaggtgattctcctgcctcagcctcttgagtaactgggattacaggcacttgccaccatgcccagctaatttttgtatttacagttgagacggagtttcatcatgttggccaggctggtctcgaactccggacctcaagtgatccacccaccttggcttcccaaaagtgctgggattacaggcatgagtcaccacacctggcctacctttttcctttttattgctgaacagtattctgtagtatggatatatcaaaacttagactgatctgttatggaagtttaggttgtttctaatttttagctattataaataatgttgctatgaatattcacatacaaaactgtgcgagcatatgttttcctttatcttgaacaaataataggagtgagagtgctgggtcatatggtaagtatatgttcaactttataagaaactgccaaactttttcagagtggctacaccatcttggattgcctccagcagtgttccatattatcaccaacacttagtgctgtcagacttctttcattctagtgggtgtgtagtactatatcgttttaattttcatttctccgatgactagtaatggatcttttcatgtgtcacttacatattttcttttgtgatgtgtctattgaaatcttttacccattttcaaattgggttattttgtttataattgagctataagagtgctttatatgttctggttacaacattgttaaatacgttttgcaaacttttgtcccagtctgtgctttgtttttttgtcttaactgtggctttagaaaagcagaagttttacgcctgtaatcccaccactttgggaggtcaaggcgggcggctcacaaggtcaggagattgaggccatcctggctaacacagtggctaacatctctactaaaaatacaaaaacttagccgggcatggtggcacacgtcagtaatcccagctactcgggaggctgaggcaggagaattgcttgaacccaggaggcatgggttgcagtgagccaagatcacatcactgcactccaacctgggtgacagagtgtctgaaaaaaaaaaaaaaaaaaaaaaaaaaaagcataagttttttattttgatgaagttcattttatcagttttttttctgtggttcctgagttttgtgtcctgccaaacacagtatcaaaatattttctcatgttttcttccataagttcaatagtttcagctcttagtctatgatccatttcaggttatttttgtgcatggtgtgaggtcagggtcaaggttcattttgttccttcagatgtctaattccattgtcatttattttgaaaagagtgtcttttccccattgaattgctttggtacctttgccaaaagcaattgtctttataagtctgtatctatttccatactctcacttctgtttcataaatgtatatatgtccgttcttatgccaataccacattgccttgatgagtatagctctatagtaaattttgaaaataggtagaattcttccagtgtgttctttttttaaagaagttattttggctaggttctttgccttttcatatacattttaattcagcttgtcaacttttttaaaactatagttttgattgggattttattgaatctataggtcagatttaattgaatctataggagagaactgcagtctttttttttttttttttttgatttaattcctcagctaaaacagcggaagaggtgatttattatatggttgttacactcggccacaaataaacacagaaatagtccagaatgtcacaggtccagggcagaggaccaacatgggcattttgtttttgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgccgaggtttccaaaaaaatggcgctaaggccgagagagaactgcagtcttaacgctactgagtctttcaatccgtgaacctggtttatttctttatttatttgggttttgtttaatttacttttgcagtgttttgtagttttcagtagacaggccttgcataactttttttgaattcatgacaaaagtattttttgttattataaatgaaatgtttaaaaatattttctaattcttagtatatagaaatgcaattgattttttaaaatatattcatcatgtatactgagactttgataaattcatttattagtagctttttggatccttaggattttctagatacacaatcatgcttcttgggagtaattatagttgttctaatctttatgcttttagttctttttattgtcttaatgcactggctaagacctctagtacatatagtacatctagaccatataagagcattgctttgttcctaattttagaggtgaaagtatttagtctttcaccatcacatgtgatgttagctgtaggttgaagtttttgctttgtggggtttttttgttttgagactgagttctactcttgttgcccaggctggagtgcagtggcacaatcttggctcactgcaacccccaccttctgggttcaagcaattctcctgcctcagccacccgagtagctgggattacaggcatgcaccaccatgcctggctaatttttttgtatttttagtttagtagagatgggggtttcaccatgttggccaggctggtcttgaactcctgacctcaggtaatccacccacctcagcctcccaaagtgttgggattacaggtgtgagccaccgcgcccagccgctttgtgtttttttttcccctttactactacttgcaggggggaagttcttatttctgttttgccttgctagcaatttttatcatgaatgggtgtcacaatttggtcaaatgctttttctgaatctattgagatgatcatatggtttttctccttccttccatgaatatggtgcattttattgatttttcatataacatctttgcattccttggattttgctgcattcagtttaatactgtttgcatctgtgttcatgagtgaagttagtctgtctttatgtgccttatctgtctggttttaaaatcaggataatactggcctcataaaatgaatgggaacatgttacctcctctgttttctgaaagagtttgtatagtattaatacaattgtttccttttgcccagagttttgtgggaaggtttttaattaaaaattcaatttctttataaatatagctttctttttcttcaatctgttttggtaatttgtgtctttcaaggattcattcattggtttgtctaggttgtcagctttactactttttatattacttccaaatgttataggtatttcctacaggagagtcagtctggtaggctctcactctttgaagcaccattctcagtcacttttttaaatttgatttttatatttgaacttttttggtatcagtgggaacattaatttgttatctggattcttttaattggaataccacaacatgtggcctgggtaaagattttaagtggttttaattgcagaattttgagagtttaaaaaaaaatttgaacactgattagatttagctttgttaattcattatgaatacattataatccttatgcattttcaacagtatttttctattggttataagaaaaataatttttgtttggggtagagtaggtattttttgttcatttaggtaattggtttggtttgtaagagtctttgatgaacatgtttagaaatagggactatttattgtttattatgtgtggttttacataggccatttttcttttctcttcagaattaaaaaacacatctggcctaatgttccagatccttcaaagagtcatattgcccagtggtcacctcacactcctccaagggtaagagaaaatgcttctgagttgtttataatatacagacatgttagtaggtatattgagtatctacagttagtaggtatattgagtatctacaaatgtaccaaaagataagatattcaagctgaatcaaaaagtaaatgaagataaaacagtacataactgaaaattttaatcaaaatttaatatgtatgacatattttaggggttttatcaccatcatagtatatttgttctgatattttaaattgtttagtacacattacagatgtttggttgaacttgcaaactgaaaacttgaggtgctgaaactgctatgtgatggtaactacctcaagcattttgggttgagtattaaaaccaagttcaacagtttatcattttagcactgatgaaatgatctctgggaacctactctaaactctgaattttaaatatgccccaaaggggaactcatttatatttattatcctccggtagtccttaaattttatattaacagattaaaatgtattatgtatttttatattctacaaaatctctgtcattcaggtttgattttccttaatgttttctagttttctgtccagttaatcctaggctgcctagtctaggcatgaaatattaaatactacttgtagaccattagcttatcaaaatgtaacaccaacaatattgatttagactacttagactcattttatagtatctgcattttgggtagttgacagtgacttagtgacataatacaggttatttctgtaccactgagagttactgggaagtttcagagatgcattagctctgtggctttaactaatacttgccatatacaattttttctcttccttagcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatagaaaagttctgtctccatcaagggaggaaaatgtacctttcaactcaaaattcaatatttgtttttaaatatagctattttccccaaccgctaaagattttcaacagatacgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacacacaaaaataaaagccaaaaaaaaaccaaaa

SEQ ID NO: 136 - DNA, 21115 bp, Homo sapiens
ccgggccgcgcttcctctcgccaggcctgcgagcttcctcccagcggagccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagaggtgagtgcctggccgtcccggagtgtcccctggagggaagagggtggaggtcgcgcgtctagtctctgttgctgccactgtcgcgtccactcccattcccctcttctcccacttctcccttctctcctttactcccttgcacgggttcgaattctcccaggagccactgtcagaacccaaattggaagggagtgcatgagggaggtactgccctgcagctccacggactcgtcttctcgggtcatcccgagtccccccctctgtggagctcagagtaggaggtggctggagtctggaggaagaggatccgtatgggccaggtccctagagagagtgctggactcccctgcccttccctgtacagggcctccccgcaggtgccctggcttgcttggttctgacccctccctcattaccccaccatgaccctgcgggctgcaagcaagcccagggcccagccacctcgggtgagcagttagaagcccaggtcctaggactgagcctgtcacccttggcctctcagaagaccaggcctaagccaagggatctttgggtgggaaactgggcaggccttctgcccggggggaggtaacggagcattagcaccatgcccccaccttctggcaccctgggcagcccattctcctaggctctttgtggcccagaccaggtgtcaggaaggggtgtgtccagccagcagattttttggagcttaactaccagttcacttccccgcccattttgtacacccgggaaccgaggctcaaagggagaagttgctaccccaggcctctagtggagttaggctggctgtcctttcatccccagctatacagggctggatggctgtgggtggaaggaaaccaggcaggcaccttcacccactggggacacaggcccccagcccggccccagagggaccttgttggttgagcacgtgcttccctgcagagggctggagggagtgaaagggcttccggctccagctgtggctgggtcagctagcaggagatgtggggaatgtgtggtgtatggccatctgtgtggtgtggcaggaaggtccggtcctggccccggctctgagttgaaacaacctggtggtcagtcctgacccagcactcgccacacctatggcccagctggcacaggagcagccaagttcaggatataaatggggtcacatgggaaccgtggaagctctgtctccactggcagcaggctacagactggggacatgggagcattgtgagagtggggacacccagggggcctgtttcaagctcctagtaccctggcggttccagtgtctttcttggttgtggccacagcaggaacagggcaaggacagcaggggtgaggttgaggcctggcaggatcctctggcccaggagagcaggcattgccctggtgggtgctgagcagtgtctgggctcccttggagctgctggcagttttgtcctgctgggtccctgctcacgatttagggtttttttgttttttcacttttttttctggctgtcctgacatgcacagtggaggggacccagatgtcctgggcctgtgagactcccctcacatggccccacacccagccctaacttcctttccagcctgagggactggggctggagcctgacatggttagctccctcccaccccagtcagcctttttaatttttattttattttattttatttttttaccaactgtgagctgtgaaggtgtgatccagggtcccagggcctttgaagaaaggagtctggcttctggctggcacgtgtgcagggatgtgcttttcattggtgagcttggtgccctccaccctctcagaagcagctgctcttctctctgcattgggtcaggggcaaggaaaaagcagaaaatgttcccattcaccaccgcaggggggccagaccccaaaaggctgagccacacagagtggccctcggcaagggttggaaatttcggggacagaatgcagcttcctccaaacaagtataggtaggggttgagacccaggatccacagtgtgacatggctgccccccaaagggggcagacccacctgggtgcggttctgggctccatcttttgaaggattttaaaaccttgacaggtcatcttcaaagagccagggatgttgactgagtctgggaaagagaaagtagggacagattctcatatgtctgagggactgtcccaaatgagaaaggcatcccatggcagaaattgtcccagacacgtgggccagagctagggagcaggtgggtcccagggaagtgaatctgagctcattatagggaaaccatgaatgtactcattttcttgatttagaaaataacaaaacagcgctacaggaaatttagaaaatgaaacaaaaatcacccactatttcttcagcaggcagtgactgtgttagcattttggagttcactgccagtcttttccccatccttttccttcattgtcgttgtcactggagtgtgtgtgccgtgacaccttttttcatttaatactgcgtctgtgggcattttctcatggtgctacgcggtctaagtaacgttgcttctaaaaagctacagaacattctaggctggcctgctgcagcgccatcacccatacactggagcgtgtgcatttttcccctctgttgctgttgtggttgtcgttactatgagtcccaaaagcagccagggtgttggagggcacaagcaacttggcacccaactgaatgtgggttccaggcccagacatgccacttaggcccagggtagagggaccttagacaggtcactgacctgctgagcctcgttgatataaataacaggatggtaacacctacttcagaggaaggtgtaaggacagtgtcaactaactaaccaagggactctaaagtgcctggcacagccctttcttcactccctctgtgagtaggattggcattgttgaaggagtgcccactgctggctgcctcaacctgtggggaaggtgcctgagccacgggccaatgttgactgaccactcacctggcaaagaggtggtctccgcctgaggagcccctgtgaaaccccctggccctgaggttctagaatactatggccagtgcccttgcctgccttcccttctccccattaccatatgattggctggcctaggacatggggctggccctgggaagatgggctgctggttagggtccgggacctgactccacccattccccttccggtctcccagcatcagagctaaatagacaaggcctcttctctctctctctctctcttttttttttttgtgtgtgtgtgtgtgtgtgtgtgtgtgtgagatggagttttgctcttgttgcccagtctggagtgcaatggcgcgatcttggctcaccacaacctccggctcccggtttaagcgattctcctgcctcagccttccaagttgggattagaggcatgtgccatcacgcctggctaattttgtatttttagtagcgatggggtttctccgtgttggtcaggctggtctcaaactcctgacctcaggtgatccacccacctcggcctcctgaagtgctgggattataggcgtgagccactgcgcctcttctgtaagagcctggctgcctcctgcctcccagctctggctaggtcagcccagcttggcattttcccagaggaaatagaggcctgcttagcctgagacttagacaaggaacccaggcatcctgagccccagcccaagaacagccatgccagcctcatcttcgcaccctgttccagtagccaaggaagggaaagaagctgggagattaagggtagggggattctggagcctcccagagcttcccaggagggagttggacacatcgggaaactcatgttagcctccccctcctcagcaggtgttccccaggtctaacctgagtgtgtatcactgtgacacacctgcttcctcttgttctacttttgtggagaccagggtaactgggagtgccctcctacagccaccccgtgggcagtagcaggacaccagtctcctcctggcaaccctgggcctaagagactgtagccccagatgaccctagggtggcccaggactaacctaaggaaggggtcctcccccaggtggcccattcagtgcagaggtcccttgggcacacgacttcagactccagctgccaaactttggcctgtggagtatctcctcctccctggtcttagtgtaagggaagtgggcatgacaactgccctcctgtcccacagcttgggatgggatgaggtcacagggtggggtccgccccaagatgctggcctggcctggctcagatgagagccctttgggtgtttctcagtttcccccgcccttggttggggacaggatgggtggaggagcaggccacccccaacgcccggcagggagcactgcctcccttccccctctcctctgggtcccttcatccaagggctggaaatagaatccgctaagtaatgattaaagtcaaattcagacctaaaaataaagagctggtgaaggaagagctggtgctccctgcatggctgaggggagaagtgagcagggagaggctggctttgggtggctgagcccctgctcctcgggatcagaagtactccaccagttgggggggtgctcttttatctgccatgatgtggcccattaagtgtagacggcaccactcagggcagactggcaggacccattagaaaaaaaatcccatttttcccatggggaaactgaggcccagaaaggagaagtggtttgtcaagcgactatttgagagctcccctcagcaggcccccagggactggagggccctgtgcagcccagcctgccctttctgcctgctcagtttctcttcctggttttgaggtgctaagatgaagtcagcttctcatcacacactagctgtgcacacaccctccaaccgcagcttccctccacccctccttctgtggtctgggcccagagtcgaaggaacaagtagaagagaggctgcttggtgcccccctggctgtcctgatcatggcatggttgtaagcctcgtgggcaggcgaaaacctgggcatcatctgccccccttggaccctggctgctgcttctcagcccagcctgacacctggtcctcatgcagactcgcgcatctatctatctgcagcttgtgctgtccgtgctgcagggagacaggagggaaggatgaagagcaaaccctgagagcgcctctgctggcgggtagaggagacgaggagtcagtgaggggaggcctgtggttctcacttcctggcagagctggtaggagctctgaagctggggctctgcgtgggctggggcagcctggagggcctcctggaggggaaggtcctgtgaaagttgagaagtgtttgaagaagaagcgtggtaggaggagaggtccttgtttgaagcttctgccctctctagggctgctggctcttttctgtgtgtccctcgacaggctcttggcctctctgagaggctggggtatgcagacaagcaagaagtgggcacagaagtacctctgcttcccagagcagaacagccaagctctgggcagacctcccctcggtgccccccacctgtccattttcagggtgtcgtctgtcctgcacaaggaaaggtgggaagaaaggtcccctaaccaaggttcagacaactctgagctcaagtacccacacagctagttcctcctctgtcagagatcaccagtccttgccctatggggtgtttgaaggattaagtaactaatgcagtgccccaaacccggttgggtcagtcagctgtaattcccgtgttctcattctgcagcccatcctgctggaggagtgtactggtaacacccccatctcccttaagtagtagcaagtctgtcctttgtgttgatccccacagctttaccttctgagctgtgtgttctgcagatcctggttctgaagtggggagaccagaaatctgggggccgaagttttagacagcttatgggcctccagccgtcagtctccccacctagaatgtggccaggagacttccgggtgagggacaagaacatgactttgaagggtccattgaaggctagtgctgagaggctatatgcaaatgcaggcaaatgaagatgcaaagaccacatcctgtgctaagggggtgggggagcagaggcctgggttagggccctggggaggcccagagtccccattgcccagcgcacataggtaattaggctcctgagcggtaattagaaacctttctgggccaggaatggcagcctcaagccgcagcggtgcctggggagtaggctccccattagcctgctctaaccccagcccccacctctcccaaaccactagacgggatttccggtcccactgaaccattgggggcaggggaaaaaaagccagtgtgttgctataatttggtatttatccattaaatccgcccttctccttaggtcagggtgctgacgggagccccgggatgggggtagggcagcgtgccctggagccagagcaggcattcttctgttccttcgtaaccgccccgggaggtgtaggcatctccaagaccctggcgcccaattctgctgctgctcaccctgagacacctgtgcagtgggggtgctgagggaccaccagcgcaggctgcgggggtcagtggaagccctcgggcacccttccttgcctgatgtgtggtggggaatgtcacagtgcctcagcctggtgtcctctgcagaaccagaggtggagctgattttattgctgccaaacttgcccaactgctggtgggtgccccgccctcctcaggtgcactgccctttggaggggcgggcccaaatctgaaacttaattctgcctgtatctgtactatgacctgtaggccctgctcggaggttccctgggcccccatcctgaaccttcttcagtcttcattaactcgctctgtaccacagtttgcagtcttaatcctggtttacttcaaggcgcccctctctcagtcactttcccctaaaatccttctagctcctgctcccctcacccatcttcctggaagccttcccgggtggcccctgtctcacaatctattgaggcactgaacataccaggccatggctgaccatccagtaaccaggaggacaggagccgggtctgcattttgtggtggttcccagcatccagccctggcttgtgcacagaggagaggtgtgtgagtggtgaccttgggtccccaaaggcaggacctcttgagtcctttccttctccacccggatatcctggcctaccaagcatggctctgggcacacaggaaggcttctaaaacactggctcaaagaatgagaaggcaaggtggaccttgctgttgcctgttttgcctccagtggctgtccccatcccccagagcatccagctaggtcctgtggcagcaccagaatctccgggggccagggccctgagttcccccaggtcttttgtgcacttcccttttcagtgggtatttttagctgggcgtaaacagttactgaaggctcccacgccccattaggcagcagagttttggcaagggggaagggcaagggagccccttgacctcccctggccctcagcacgtgcctggccttgggggtctacagctgcttccagggtaggaaaagggcagcctgggagtttctgggctcccagttctttctccccactccttgtcagcctgggctcacaagaaaggctgcctgaggctgcagccactgacctcagcgcttgggcacaatgccagcctgttcccgggaccccagcacaagggctgctgggagccgggtttagggcaggaagtcagagtgaagcactggtcctgccacatcccaagccccttgtcccctagccctgcgggaatggggtgacagctgctgtccctttggggttaactatagtcctattggttatgagacctcggtgtggtacagccagcctggcgtcccctttttttcattcgttcattcattcattcattcagcactcatttactgagcagccgctttgggcccagcccatgcagacgtgagtcagaccctcactttccccctgcagagctcccagtccaccctaaaccacaggccacaaccagtgaggttctcactggagcacggggatgtgtgagaggccttggaggcctcggcagccaacacagctggggacccaaggaattctccagagagaggtgatttacaaaaagtttcttatttccagttttaagggggaaggtaatagatgcatgtggctttaaaaaaataataataatttttttaaaagcccaaaaggacaaaatagcaaatgaacagtaaaaagtaagtttctcttgaacttgatctcactttcccttctcatcctagaggcaacctctgttaccagtttcctctgtctttccaaagataatcgaggcatatttgagtttagggaggtgttgcattaatacctctttaaaaacacaacttgtagtattccatagagaacctgcacctggctttttttttcacagccttttattttgagtatttgaaacctaccaaaaagttgaagtaatagtataatgaatattcatatatccttcatgcagatttgccagttcttaacattttgccacatttactctatctcttcttttatctacatagacatatgtgtgtatgtattttttgctgatttgagtgttagttgtaggcattgcatctttcaccctaagaactttagcgtgtatctcttatataatcacaatgtcatgatcacacttaagaaaattgacattaattccatattatctactatgtccatttcccctctccccaagtgatttttatagctgtccccccgaccaccccttgatatagaattcaattcaagatcatttattgaatcttgtcatgtttctctagtgtcctgttcaatctagaacattctccagccctttttttgttttgctcttttatgacattgacatgaagagtccgggccagttgttctggatttgtctgattgcttctccctggttggagtcaggtggaacagctctggcaggaacgcccccccgggcaatgcagagtcctcctccaggaggcacttagtgtccatgcgtcaccttgctggtgatgcttcactggatcacttggttccggggttgtccgcacgtctccctgtagtgcaggtgctccttcctgtttccaattagcctgtgggatgggacttggaagctgtgtctgttctgctcccctggcaactttttcttcaatgacttgagctggtgttttgccattttccatactctatcatggggagtgttcagtatcggcatctagagatctcccctggccccatcacagctagagctatgctgtcccctttcagggacatcttgtaatttatccacccagcccccaactgatggacataaaggctgtctccccatcatctcctgctactacagacagcactgcagggactgtcctgctgtgtttttttaaggcatgggtactccagaagcagttgctcagctgcacccccaaggttgagtggaagtccctcggtaaaggaggaggagagagtgtgaagggaatggcaaggcggggagggagacagggcacaggtgtcctggcaacagcagatgggaaacaggtctggctaaggtaccagaagccaacaagtcccagaaaggtcaagtgactttcccaaggtcacacagcaagttgatggcagagctgggtacaggactcagagcatctgacacccaggacgatgttcctgcactgttccatagagtagcccgactcttaagtttaaataaccccaggaaggaccccctctctgtgcctgacccccgctgggttgtagaggcctaagtttgcagtagctcctcccagccactctggctgtcagcctctgacctgcagtgggagggtctcaccttctggagatgttttaaggaggggaccccggcctaggcactagctgggaagccactgagccatcttgtctgcggccactgacgtcagtgcttgggcacaatgccagcctgttcccgggaccccagcacaagggctactgggagccgggtttggggcaggaagtcagcgtgaagcactggtcctgccacatcccaagccccttgtcccctagctctgtgggggtggggtgacagctgctatcgctttggggttaactatagtccctttggggttaactatagtcccattggttatgggacctcagtgtgatgtagccaggctggattcccccttttgtttgttcatttattcattcattcaggggtctcatgaccccaccagggaggagccgtccaagagagttagcagctcccacttgcaagatgtctgtggcaaggcaggcactgttctggtgctgagagctcaactccagtcctcacagcagcccccagagccaaggagtatcaccagtccattgcacagatggggaagctgggttctagagtcacagccagcagagtaaaggtgatgagtttagccctcttccctgtttccagaccctctgaggccttcagagcccagctccttgaggcagcccaccccgaccgctcctaggcttacccttccctgagcaccgcccctgtgcccctcatagctgcttctgcctcctccctcctccctcctctcccttgcccctaggctagtgtggtccccatggcaactcctggggcctgtccggcagggaggcacggggctatggggagggctggctcagcagctcaggagtttgacacctgagggggacagaatgctcactcaaggtgtggccctagggacccccgccttgcccctgtgggcctcacttggggttctcatctgcaaaatggggataataatagcttctctgtctcagagttgttagaggatgtgatgagccataacgtgccaaggacagggcctggcacagaataagtgctcagaaaacagggcctgttattatttttattattataatcaaggcagtggggaggcggcggtggcagtagctgtaggccaggaagggagtgtttgcaaactgacagctggaagggtgactaacagcgcagcagcctccgcgcccccctgtggtggcagggagtttggggaggaagggggaggcatggggatgtggaatgctagcagggcccctattcagaaggacctaaaggttgggggcccagccagccctagtgggaccctaattcaagctctgtcacccctaactagctatgtgacttcaggcaaattgttcaaccagttgagcctcagtttccgcttctgtgaaatgggggtaagagggttagaagagctcacaatcctccttccctccccgccacccccacccccacagcttacagtccacaggaggcaggggcaaggggtcctcaccacccccaccctcacagcttacagtccacaggaggcaggggcaaggggtccccgccacccccaccctcacagcttacagtccacaggaggcaggggcaaggggtccccgccacccccacccccacagcttacagtccacaggaggcaggggtaaggggtccccgccacccccacccccacagcttacagtccacaggaggcaggggcaaggggtccccgccacccccaccctcacagcttacagtccacaggaggcaggggcaagggatggttcctgtacttagtggtgactgagtcatgtggatggaggcaggtttcaggctcatcctccttgggcctcagtgtccctgcctaaacagcaggattgatggcctggcctctggggatagaaagggccctgtattctgggaggaacggaagctctttcatccaggggatggggcaggggcgcaccagacatttccaagttcagggtttcattccagcccctcctcagccagcttgcaggagatacctgtcctccccttcagggtaagcaagacttagaagggttgagtcactcaccccaagtcgcacagtcaacagagccaggtattaagcccaggcctgactatagagccaggtgtgcggcctggaagtgttggttctccctggccgtctcctccccagctccttctgctctccatgatcacatgcccccctgctgaggccccatcgcccttggagtcaaaccctggttcctcacattggcagtggaagtccccctgctgcctggcagagtttatgccaggcccacttgaaaccatcccctacagtgtcccctgagcagcggtgctcaaggtggactctggaagtgtgtggggtcctagagccccagatgggcagggtctgccttcccgcttccctcaccatcggcttccacctgggccagtttctcatactatgccagtcccctgcctgacacctttgctcagactgctgcatcaacctggggtgccttccctggcccgccctctgcctgtgtaagccctgcaatcttcagggctcagccccagagctccctcctccagggagcctgtctgagctctgcagtccgtgcctacttcacacccccagcactttgcactaaaatgtcttctcccgcgccactgcactccagcctgggcaacagagcaagactccgtcgcaataataacaataataataaaataaaatgtctccttccactggggtaggtagcaatatttgtgactgtcagcctagcccccagacctcatccactgtatcaaagagcccagcaaagaggctcatggaggagtttctcttctaacacactgtgaccacgaagatgccactggccctttctcaccctcagtttcctcacccgtagaaaggaaacagtagttccagcccctctgcttcctgagacaggtccaagggggctctgggctgggattacaaagtatgtgtgtgcagacgggtgggttgctgctctcagggaatggggttggctagggtagcttttttggggagtcaactttattgaagtaaatatacggttgacccttgaacaacacaggggttgagggcatcaacctcctccctgcagtcaaaaaatcatatattaacttttgactcctcaaaaacttaactactaatagcctattgttgtcagaaagccttgtagataaagttgattgacactcattttgtttgttatatatattatatactgtattcttacaataaagtaagctagtgaaaataaaataagaaaatcatatggccgggtgcagtggctcacacctgtaatctcagcacattgggaggctggggcaggcggatcacttgaggccaggagttcaagaccagcatggccaatatggtgaaaccctgtatctactaaaaatacaaaaattggtctgctgtgttggcgcacgcctatgatcccagctactcaggtggtcaaggcatgagaatcacttgaacctgggaggcggaggtagttgcagtaagccgtgagtcaccccaccactgcgttccagcctgggcgacagagtcttgctgtctcaaaaaaaaaaagaaagaaaatcataaggaagaggaaatatatctactattctttaagtcgaaggggatcattatgaaggtcttcatccttcacattgagtaggctgaggaggaagaggaagagttggtcttgccgtcacagaggtggcagaggtggaggcggaggaggtggaaaggaaggcagaaaaggcaggcacactcagtgtaacttactgaaaaacatccagccacgtgtggtggcgcatgcctgtggtaatcgctacttaggaggctgaggcaggaggattggctgaacccaggggtttgaggctgctgtgagctatgatcacgtcactgcactcctgcctgggcaacagagtgagaccctttctcaaaaaaaaaaaaaaaagaaaagaaaaagaaaaaatccatgtgtaactggacctgcgcagttcagacccgagttgttcaagtgtgcactatacaccaaaaagtgtgccgatcgcaatggtacagctcagtgaattgtcacagagtggacccacttcatgattgggctcagacagtctgaaaaccaaccccagaggtccccttgcattccttccagtctccctgtcccaagagcagctatcctgacagcatggattagtttggccagattttgaactttattcaaatggaattacataatatgtactttcctgtgtctggcttcttggttaacattttatttatttatttatttattcattcatttagaggcagggtctcactctgtcgcccaggctggagtgcagtggtgtgaccttggctcactgtagccttgacctccccaggctcaagcgatcctcccacctcagcctcctgagtagctgggagtacaagcacgcagtaccacccccggctaatttttgtatctttagtagagaccgggtttcgccatgttgccgagactggtcttgaactcctcctgggtttaagccatctgtctgcctcagcttcccaaagtgctgagattacaggtgtgagccactgtgcctagccatcattatgttttgaaatttatcgggattggccaggcacggtgactggcacctgtaatcccagcattttgggaggccgaggtgggtggatcacctgaggtcaggagttcgagaccagcctggccaacatggtgaaaccccatctctactgaaaatacaaaaattagctggttgtggtggtgcatgcctgtaatcccagctactcaggaggtggaggttgcaatgagccgagattgtgctactgcactccagcctgggtgacagagccagactccatctcaaaaaaagaaaagaaaagaaattcatcagtgttatttaatggttggagtttgtgttggagtttatttaatggttggtgtttactgctgtacgtagtcccttttgtgaatatgccactgtttatccattttcctctggatcggcatctgggcagctcccagtttgaggtttattacaaagcatgccacttgtagccctcctgtgcctgtctaggcagacacatgtcctgtgtcctctcggtgtgtacctagaagtggggttggtatatgtttagagatgctacctgggcgggattttgcaggtgaaggacccaaggacccacagagcataagggactttctcagatcacatagccccttctcagagctgctccggggcccctttccccacagaacagtagctggaaccaggcctggggctgacggtcaggtgtccattgtcccactagccccctttgctcctttctatcagtcctggaaggccccctgtggccttagggttggtggctccctctgcccctgggggtcctcagccctcatgctcctctacccagtaccgtcagcctgccaggactggagagaatggcccatgtgtcaaatcccagcgcaggacactcttggcacctgttcatgcccagtgaggagccagatctcagcagttggggggcatttcttcacacccctcctcagtcttcatgctcttccccacagctctaatggtaccaagtgacaggttggctttactgtgactcggggacgccagagctcctgagaagatgtcagcaatacaggtaccacaggggtgagggtctgggacatgcaagcattcccaccagccccagcggggtgcttagcagaggagagaggatgcagcttagatcaacccactcccctttttcccagcactcagtcaggtacaggcctggggaagtgggggagtctcaacaggaagggacccagggctcgttctccgggcagagcacctcacccaggctcacagaggccagctcagaggctgtgaccacgagggtgcgccagcaggtggctggagggggcccaggctgcacccgcccacgtgtcacctgccttgcaggccgcctggccatccggtacagaatgtattgccaagtacaacttccacggcactgccgagcaggacctgcccttctgcaaaggagacgtgctcaccattgtggccgtcaccaaggtaatcaggtgacgcccaccccaccatcccactgctgggccttccctctgcagggggaggtgggcctgagagcatgtctgggctgccctctccccaggaccccaactggtacaaagccaaaaacaaggtgggccgtgagggcatcatcccagccaactacgtccagaagcgggagggcgtgaaggcgggtaccaaactcagcctcatgccgtgagtaccacgaggaggggttggggagggaaggggccttggtcctcctgaaggagcatcaggagcaagcagggaggccagagtgaggggcttgggtgttggggagggcctcaggaggaggtgcagggtgcgggtgcgggacctcacagagcagggctgggggcagaggcaggagggtggcaaagaagggacagggagcagaagaagagggcctcaaatgcctgactgagcgagtgcgagccacgggtgccaagcagagggaaccccttcagaaaggggagccagggtcagtacctttgggccaccatgacctccagccctgctgctccccagttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggaggtgagctggggggtacagagccttgctcccaccctcacacaccctaaacccatctggggccctggcttctagctccagccccactgcttctgcgtggtgaccagccatgtggggcaacttctgtgagcccttgtttcctcacaccttggtggagcagctgctgcgtgccaggactcacctctgaccccacagtgccaccatgaggaggggagccttatcctcattttatagaccaggagttgaaggttcagagcagttaggggacccacctgaggtcccacagatataatttggtgccaggactagaatctgagtctgtctgatcccagagctaactttcctccagccactcacagacctgcatgctcagaagcgtgtgcagaaacatgagccatgcgccttgatcgccagggcccctgaggctctcgcacctgcacggacatgcccacaggtccctgcagcttcccaggccagctctgccagccctggccaggccacacctggcatccggtagccacaggaagcctcccgtgtccctctgtattcactcttatctccctcccctactggcctggcttggcctgtggcaggtgagggtggggtcctgggcactcctggctagaggctggtttcaggactgagccatgggttgccctctgcatcagatacccatggggcccagagtggtagcagcagctgagtgtccagcaaccgcatgtagggtggcatgggaaatgggccatacgtcataatctgggacttccctaacccctgccctaccagaaatggggagccctccccactcagtgactccaggctaggcggggctggcctctgccgccctctggtggtcaggcctggacggtgcatatggggcaccttgggctgtctctgagcaccctgccccccacaccctgcagcactacacctcagacgcagatggactctgtacgcgcctcattaaaccaaaggtcatggagggcacagtggcggcccaggatgagttctaccgcagtgagtgcaccccaccccagacctcttgcccacccacctcctcccacgcaggcttcctggcactgccccatccaggaacctccagagaaccccagtgcctgatagtccagtcagcctctgtcatcccagccatgtccctagtggcctccaggccctcactggcccctccccacaggcggctgggccctgaacatgaaggagctgaagctgctgcagaccatcgggaagggggagttcggaggtgagctgggccgggccccctgggggggttctgagggactccgaacttgggaacaagaccacctctctgcccccagacgtgatgctgggcgattaccgagggaacaaagtcgccgtcaagtgcattaagaacgacgccactgcccaggccttcctggctgaagcctcagtcatgacgtgagtgggggcggggtaggggggaggttggcctaggttaggagtgaggcaccagcttcccctttctgaccactctcgtcctgccccaggcaactgcggcatagcaacctggtgcagctcctgggcgtgatcgtggaggagaagggcgggctctacatcgtcactgagtacatggccaaggtgggcacctgccgagacccggcactcaggccttccaactgccccgaaacccccactgtgctctagggcccctgctccctcagtcccccgaccccaagtgagcttttaggtcaccagggctgggcttttgtcctggtttaccattcattgactgtaacattggacaaatcatgtcacctccaagcctcagcatcacatctgggaaatggagataataacaacttagagatttgtgagagtcaagggataaggcatgaataacacagagcagtgtccggcatggatgttctggcccctccccactccttccctgtctcacacctccctggagtgtcaacacccacccggccccagcgtgctgtgtgagagggctgcagggcacgtctgacctcggcctggtctgtccttcctgcccccaggggagccttgtggactacctgcggtctaggggtcggtcagtgctgggcggagactgtctcctcaagttctcgctgtgagtgaagcagcctcttggatgggtagggtttgaggggtaccctgccctgctatgggagccccagtctgaggggacatgtggctggcctacccccagagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaaggtggggctggcctcccctggggcctacagaggtgggcaggagtcctgggtcactccccaccctggagtcccaggatctgacgctgcttcttccatccacatggcagaaattctccactaagtctgacgtgtggagtttcggaatccttctctgggaaatctactcctttgggcgagtgccttatccaagaattgtgagtatgggtactgggatcagggtggctcttggagcaccggaggggttggcaggggcgtgagcctccttgggccctgcctccccaatcaaggcctagaagcctcaggcctgccctggggagctcacaggccactctccgggcctgggtctgcggcaaagctgatgggcatccctgagaggctgctgggtaggtgtcctctctgaggccagggcctggactgactcctgcctccccctggccacagcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgag

SEQ ID NO: 137 - DNA, 144259 bp, Homo sapiens
attctccgcggcgcggcggcgagtgctggctgcggtaccctcccgctcgcttgtccgtctgcgcgcccgcgatgtgaccagccgactgggggcgggctggcggctctgcctgcggcagcgcatcggtttttctcctggcaggtccctaattgagccgtgattcccttggagccagagacacccaccaggggctcggagcgccgcgctccggggctggaggcagctgcagcgctcgggtccgcgcggccgggtgcagtagcctcagtcccagccgccgcctcgctgagtcgtgtgccctggcgaatgcccggcgcccggcacagctgagccaaggcgactggtgcagagcggcggcgcctggtcctgcacttgccgctgctgccgggctgtgccggggcggcggcgctgcgcgccggagtttgcagaggctgcctccgagcgccgtccgccaggaagactccctgcctcctgagtcccagtaagttgactgtagtttctgaagttggagggagccgtgggaaggagaggttcgtttttatcttcttgtgggaagccgagggtggcacctcttgttaacagagttccagctcgaggagggagtgcggggtgccaagaaggggacaaggcagctggaaggtctggagtccagggctggctgacctcagcatctcacgaatgtgccagttggaaatatgctgggagaggacaggtactcctagggcatttcgactgctgcgtgctaattattcattccaagctccttgactctgtgtttacgttggggtgaaggggctgggcagggtcttgtcacctccatcctaattcctctggggagtgtggccagcactgcgatggatctttgggcgagccatttctttcaggcctgcaggcttcccgcgcatcccgctttactcttcccctaggcagaagttgccaaccttttcataattggagcctagtcctttagggaaaaaacaacttatatgtcgacccggtgttttatgccctaaggcaaataaaacgagctctgggcgtgtgaattcatacactttaagaatgtaggcaagtctcaagaaataggattcagataatgacacttggatttcaccctgattgtcctgcacctcttatgtaagcctcccggctggataactttatctctgcagtggctgcagctgtggccctccattccatttgtttaaagtccaattgaacagtatttactgaaaatgctgacatgatatagcggcctgaagtctgaaacagagtgcactcttcaaattggagtgtcttctcctaatagggagcatgggaggaacaacccactatatttttcaaggcagctccaggaattagacccataaatcatgttttaaaatagcatgcattgtgcagagagcatgcagaggaccgctttttgaacacatcccctttgttttagaaaaagtggaaattgttcatgccagacaattgttgagtctaaaagttaagtgtactgatgggcctaattatcttaataaacaaagagcatgatttataggtagctgcagtgccctactttgaaggatagaaatctttaacctttctttctcagctgttcccgagagattccttttaagcagagctatggattatcatcattgatgtttaatacctgagttggttaaacttgtaaaaggaatagtactttgaagtaccatgcagtactgctgtgtgactgttacacagcgaatattataaataagaggaatatttggagtattgggtatagatgtcattagtttaacaaaataggtcatattaagactttcctgctaaatatatatacacatacataaatgtttaatttggacttgaaattattgtttaaaccaaagctcaggggtatgttttaatgtaagatttatttacataatctttgaagagagaagtgcatttatttatggtatttcagcatgcagaacaagatgaactagttataggcaccttatttaaagtgtaaagggtttttttttaggaatactaagaaaatacacaaaatgttatttcagaagttgaaaagttagtcacatcaacacattgcggtttgtgagagcatccagtgcttatctctagaagagattacatccaagcatggaatctcaaacagattgacccattaagccctattgcagcctggttaggaggacaggctatggagccaggctgccagctctggtaccatctgtttgaatctaggcaagtaacccaaagtctgtgcctcagtgtcttcatctgtacaatggggatgacagtagtagtacctaccccactgaacagtagtgagaattaaatgagttcatagacatagagctgttgggccagtatctggcatattaagcttgttctgggaaaaattttcattgttatgaaaggaaatgcatctttggactctatggacattgaattgctgctatggacattgaattgctgctgatgaatattaacagaagcagttcatgtgtataataggagagaaggtataaacatttattgtgcactgtctagcgatacagacaccaactggtatttaacactgtcttgctcaattccccaccacagtcctttgaggtaagtggcttcatctctactttagagatgagaaaatgggagctcagtgagatcaaatagtagaaattggagctggcatttaacccacgtctgtctgtgttgaaactgtgttctttttgaccctgctgcctcaacttgcaaatgaagtagttgcattattatcctcaatttatacatgaagaaatctaagcttaaggattaaagtatgcaaagtgcttaacagcacccacaacagaaatgatcataattattgttaaataacttgcccatgcttccatacctcctaatgtgtggtagaggtgccaggtctttcaatttgaagtggattctgttgctttattatttttctattcatgcattcagagagtcaaaaaagaaaaattggtgtgatgttagagtttacactggagggtggtggtctccatttggtttcctgcctgcacgtgtagctgcagcaatctacacagtcaaggaaaccaccacggcagcagtaatcaatccacaaacagcgtcatccctggatatgcattcagtcccagctggagaactcccttgggcagagagaggccttgcactttgcctcatattaaactgcatgttcagaaaaagaaataatttatacttaccattaaataagcatgcttccttcaagccttagtaccccatgtcatgggaagcagattccggggtgctgtgtgagcagtacttcctttaaggtttccatagcttgttagacttctcagctgggttccagaggtggggaatgattgagaggtcatggcatttttgtggctgtgttaggttatcacccaaatactagatagtgttctcgccttttgtaagtcttatttctagagattaaaatctaattgccgtatagggcacatagaccacagactgctcacagtctgatttaatttaaatcacagactgatttaatgtttaatgaaatctcttagctaatgtatgctaacactgaatggtgcttcaatataaatgctcaaagttggctttaaaaaaaaaatcaaaactcttcgagagttctactcttcctgtaggctgcctccatgtgcctggggacacaataccatagttgcaaagtgcccaaaagagcccctgccattgactgagtcatctcacatctctgaattatcttctgtttcaacttgaaccctccttttcagagaacagatattcccttttgcttacttaatagttaatttcaagtgttcccctgctctgggttggttattctatagtaaaagtctcccctgatcacttttgtgacttgaatgaggttcatgatttattattaactaactcctcagaatatacatatagttgtttcatttctcatctatgttatctgttatctatttagtggcttatctgtgtcacttttaaatctctgaataattttcttctgacatccatcaaaagatacatgtaaaagaaatgcaaactaattttaatatggatataaatgaatgaagaccattgacagtcatatgtactgttttgaattttcttcactttgggcttgaggagttgggagctgatagttccagagctcctgcctcatgcattgtgagaggcacattgggaggttatacaagttatacacgcaagcagttcatgtgcagccccgcagagacagcccctgagggctcgctcattgctgagttcaagggcaggggttaagtatgaggggaaaacagctctgtacataatttatatgaccacatttctagtccttactggttatctttctggataagaattggaatgaatagcttaaagggagcacttactgtgtgttggctgccatgttaagaactgcccttcatcctcactgtgaccttgtgtggtagtactttattatcctcttttgtggaagtgacaactgaggcctagaaaagtcagggcacttgtccacggtgacactagtgagcttcagagtaaagagtggagcccagaactgtgcaaggaggcccgtgatacttatagaacgttctgctgccactgatttttgagcctttgtgatagctaaactctattgcatggatttatatattacataatatagatggactatattatgcttttcagaagaatcctatactatcttgcttggtccccaggtgaaggaatggtgggaagacacatgcctaccttcttagccactgccaggagcaggaattgacagcacaggaaatatcatctccattatctttgtagaagaagagcttaagcttagttcacgcaatgagctcaaaaaagaaaaccacatgtctgctttgtgaaataggaagcataaagccttcaactggtagtagagcacagtggggaggcatgttaactttatctgtgtttagtgtcacatacttgcatcattctcactaaaaaaaaaggagaagtgtggagacctgacattttcttgggtgatttaaaagaaaaataagtttatttaaatctaaagaagtatcagcagtgaactgtcatgggagaaccacattactacagcagtgtcatctgtcatcccatgagactatggttttcaaaggaaacgaacacttatgtctaaccagtaaggcttaaacgtgttatcttatagtaagaacattgcatcaaatcgtccatgtctgtatcatagcctttctaactccagtcaaaatggagggtaaaaggacaattttaaaaccatctcgtaatattttcaaaacccttcccctgagccctgccccctctattttttctcgatttcatactggtgccaatatttgttcaataagttaattcatatcatcccctggagtttgaattataaaggaattattgtgattataatattttggcatatcctgttgatctctcatttgcccccatccttgatgttataggactgtatgatttttttaacctgagaagtgattaaaaacgttttaaaaatttagtctcctaaatgtagactgtttattgcagaagacagggaaattggcctgactgggggcatttgctaaaaatgcagagctcctgaaatcctgtgaaccttatggagtaagcaagtaaaaaaaaaaatacggaagaagaagtagttttaaaattgctcactaggcctggtgcggtgactcacgcctgtaatctgagcactttgggaggctgaggagggtggatcacttgaggtcaggggttcgagaccagcctggccaacatggtgaaacccagtttctactaaaaatacaaaaattagctgggcatggtggtgtgcacctgtaatccaagctactcggaaggctgaggcaggagaatcacctgaacccgggaggcaaaggttgaagtgagccaggaagatcacaccactgcaccccggcctgggcaacagagtaagactttgtctcagaataaataaataaaaataaaattggtcactaacagctttgtacttccctctcccatttcacagatgtccagctgacccaatccctaggtaccgtatcatgtattcatttgcaagtaatcaggttctcttgattttctaaaagtaccaaaaggtgtgactaaatcagcattactgtcatctgccatctccgtgttgagagagccccagggttgcatatgtaagcttttatgtgaatttattctctgaggaatgaagggtgatcagataagttctcaggcatctcgtctcactgtatttgtgactccatcattactattaaagttgcttccccctacgccatcctttcaccccaaaccatacccattccttcatcatgcccattgtggtggaacatgatgaaactattgggaaacttaagtgttgagggagctcatgttctaagtcaaaggaaaaaacacataacacaatactttttttcttttcattaaaaaaaagccagtccctaacatagctatacacaagaacaccacaccttctgcattcagcagttgggaattgcaaccagagtggccttattaattttttcctggcaccttctaaggagggctgtgagcctctaattcacatgtaatcaatcactagcagcttgtctgtgttttcagtcaaatttagtgactgaagggtcactaaatatcacaagggtggtatttattcatttatacattcaccagatatatattaatatgataccaggcacattgttagatgataagacctcaaataccagaaaatccctctctctgccctcaagaatctcagattcatgagggaaggagacactgagcagcagttggaaccagtgcttaaaggatgcttggctccgtcaggggtgcctgactccaaggggatgacttttcctaacgcagccgggcttgatggagtctggaagagccagtaggagggtaccaggaggctaagggtgggagtgggcagggagaaattattctgagagagggaacagggaatatggtgaaacaaaggtaccggagaggcgggttgtggaacagctggtcattccatgtggctggtgcacattgagggtggggagtgagactggagatggagagcggaggctggagccacttttggagggtcttgtgggccatatttagttttgtagatgaatttgagtacttttttagaatgatcactctgggtatattacacagaatggatggggtaagggacagacaaagtaagctgtgcaaaaaaagcttttgaatactggtgtggatttaaagtctaaactcccactgataagcgtggggacattaaggggagaagcaaggagaggatggtgaatttaaggatgactcccaggtgtctggcttgggaattgaatccataaggctgccattggagatgataatgaatacagaggatggagcagtttgcaggagaagatgacaggttgtggatttatgcactgtgaggcaccagagggacattcaggacctgagatgcaattggcagttgtacagcctgtggttctggaattcaaaacggaggccgaactggaaatgcaggtttgcaagtcttccgtgtatttgaaattgttgttgaggttgtgatctgcctgtgagaacgtgtggactgaaaaaaaaaaaaaaaaggacgaaggccaaggtggctgtcagaagaaaaagagatggcatagtaagattaagcaagagaagtttttgacaagtgcttggacacaaagtggcagaagccagaggcaaagcagaatgagatgcttgattgaatgggaactgagtgacaaaagaaatgaaattgaaataaaaagagagcaaagggacaggtctgactgttaacttgcttccatctacacagataatggtggcttttactcctagagtttccggttctggtcaataaatattaagacctaccatgtggaaggtgggtgggaaaggggatggggggaagaaataaaataacaaggcatgaatttcgatctcaagaagcgcatggaattttcatttcttatttttttctggatctcaagaagcttatagaattatcatttcttatttttcttttccatttgtttttctccttcattgacagcaggacacaggcttcatgggagaatggaaagaatgaaagaatcattttgttggtgcatgaagtgcctcagttccccatagcgggcatatctcattttatccacaaaataaacacactgaaagagaaggtgataaatgatccattatttgacggattgtaaaaactaagcttttatcatggccataatgttattagagggtttggacctttgagccaatgcttatgtaattattaatgagactttcggctcactggattatttgatgtatgctgagtaaaatatcctataattttcacttgtcttataaaaacaggacacattatattatagactaactggagtatttggagatgatggaaataattaccgtatgttttagttaaatattatgcctttcagtcctcaaacgtttgtcctttaattttgacctaaaggtagaatcactcccgttatacatatgaggaaactgagatacagggttcagatgggtgggtggagataacacagctagtaagtggtagagcttctaggatccaaaatgaggtgtcctgggttcgtaccactccatcatgttgctgtatctttgtgaatagctactaaagaagaattagggggtgttatgtttaagagattttctttattagtctgctcaaagcaccaacagtagaagctgtatcagctacaatttctatatttgatgggccacaggttatttatgcaaatatatgtgattaagttagattgggggaaaatctgcttttttttttttttttcccacaaaatgaacatgttttgcattcattatctcaagagcactaaaaaagaatctgagtataaatataaggattcaatattttaacttataaaattattgtagataaacttatttgtgatacagtgggaatttatttttcagcaattgcaatggctgttgtctgtaagaggcattccgtgtgtacacgtacctgtgtgtgcatgtataaaaaataaaatttagcctaattaattttaaactattggttttccttttgtaatatttttgaattctccagatacattaaatgatattgcttgctttgtcttgccaaagcagctattatgttactcatttaatgccaaagtgttaaagcatttgtcttcggtaagcaatgtaaaatgatgtaggatgagcctaagggatttagtttaatgttacaacttgtattttggctcctgatagtctaaattttttatttacctaattttgctactattgaagcagatattagctgttaatatacagtaatattagaatcatgaaaagtacatagaatgttgtggctggtggaaaaactttatgatgctgcatttttttctttcacaaaaaatatctaggaggcttactaaattgcaatttccagatgaaagcaatttctagcaagtagcaaaatgctggtgctaatgcttatccctaaatctcaatttcaagcttcatggtgcctattttacattttagctttggtaggaaaagttgaatccaaaggggcttatgcctttgtgacatttggtggattgctcttttgttattggtgctgatttttaaaaataacaatacatttataaattttaaaaagttttaaaaaacgttaggcagctatcttagttctgaattatcactacacatggtgcattgtagtagccttagtccaatgtagttgaaaaattacaatataggcatgtgaaaatttaaataacaatacaaagtaatatggtattttatatttgatttttattgcactttataataatatgtgaggaaactcaaatgaggtaaaatgaagattaatttggtcatttcatgcctcatgtatcccaatttcatccaaatgcaaatatgataatccagggcatagagttagtgttctgttcaggtgatttgacactactgtatttattaatcacttccaagatgaacaattaaactgcatttcgtactcatctttctatgagtatatattttaatattatgtactaggagttttcattttctaaaaagtaattaaattttctttgtcttatttttcttattcttattgaattttattcagacatttttatgttagtgtatacttgacatgatagaacatgtctaaattagtaatctaatttgaataccataattatgtgtacagttagagcttgattgaatggagagcttttgcacatcctgtatgttctttctgttagtggatttaggaattacatgcttaatactaaagagtccaaagcctgtttatgtttatcagtaggcgcacagagcaaaatataaatatttttgccaatagaattggaaaagatatgcttccttttttaagtgttaggaattaacacgtaactgtctgtggtagttttctcttatacgaacagattgataagaaatatagacatggctgaaaactagaatggtgtcattgtattgcctaaattgttggtgttgaggttagaagtccactcctttgttttgctaaataagaaataaagatgctttaaaatattgatcataagtcctgataaatatttgtacatatttagtgttacgaatatttttcttttgctttattatgtagtggtcactttgcccaaaatgtacatcttgacctttagtatggaatgctcagtatgtccgaggtagaattgaaaccaaaacatctggagtcttattaaaaggatacaatatggataacagctttttagtcttggggctgagatatttggaagaggattgctaaatactgtggtcattgagaaaaataacactgatgtactaaacttacacttaatttaatggtttcgctaccaccattcttaacctttccaactggctgagttatttgctaatagtggcatgtcacatcctgaattatagatctttccttttaataaatattcaatagcattttcaaaatcgttctcctagatacaattcataatgaacagcgcagcgctggcaacaagcatgcttctttcagcctgttttatagccacaggctatttggcatttggacacttctcttatgtatttccacagctccacatttcctaaaaactgtcagccttatattagaattagcttttgcttctccacagttacatggagaatgaaaagaatatctctccttttctctccctgtaatatgccaaggactgtggtcagagaatcatcatttgctagtcgtatgctttttctttcttgatgttctcattagcttcagaagccatagcatgaaaggcattttgaaatgcgtccgccatcggtttggtttgatccatgttaaactttttctgtctagaactgtggttcttaaccccctagaggacatttggcaatgtctgaagacatttttggttggcacagctggggatggggatgctactggcatctggtgggtagaggccagggatgctgctatacattccacaatgcacaaaatagccctccccagggaagaattttctacctcaaaatgtctagagtgctaagcttgagaaaccctgatttagaaggtaggggatgtctgtttaatttgtattatattttttacgcaaacgaaaagtgatagttctggtgaagaaatcattgcatataatgtaatcatttattgaacacctactaggctctgagaatacaatgaagactatgacatggttcttgcctcaggggtataccctgtctttgccaaaatgattagtaaataaaatcaaactggttgatgtgatgtatgctgtgattagaggtatgcatggcatgttaagataaaaataatttagatttcatttgctaaatataagagaatatctggaagggattgttctctgactaaatgtaatatcagtcatttgtgggtaaagaatttctaatttttccttgacaattaggagtaagttttatttattgtctttttaaatttcaactggcattactgtgaaatgtcaggaaagaagggaaggtgttgacataaaaagtgttacttcaggaatttaggaaatgagtttttcatcatcttcatcgagttctagtttacatgccataaaagtctccaatttcaactgaacaattcactgatttttagtaaacgtacagagctagggaactgtcaccacaattcagctttaggacttttctatcaccccaaaaagctcccttgtgcctgtgtgcagttctcattcctgctgccagccccaggaagccaccaatctttctattgcttgctttcttttctgtctcactttctgtccttatatatttgccttttagcaaatctctggacatttcatttgagatattaatatttaccaataaaaatgtagtttctatcttctttttcaagatcagcatcaccttattttttttatattgcctgtaccatacacatgctacagtgcaggttcagggactcttagttatcggaactctcagactaataaagtgaaacatgcagcaaagaagtaaagcacatgtgtaagagtggaatgtgtgcctgtttctcagctttgtccctgtttcaatggtggtcaccccctctactacttttgtaactctgtctacaaaaataatgttatagaaagcattgaaaagctgaagtcagataaatactctcaagatgtggggaaactacaaaaggattaaatctggagaacatgcctgtttgggagctgtattctggtcaaccatttcttagccaaaccctttggggccaaatgtctttcagaattcagcttttagaaaggtaatacagtgtattcattgtatattaatgtaatacccccatgggatccaggcaacacacagtaatttttgtagcaaagtagatgaatattcacatttagttagagaaaaactaaccacatgtcagttcaggtcagtttggggaacaaactcatttcgtagcaaaataacaaactctgttttcagaaatttttgcatttcaaaattgtgggtaaaggtttgtgagactgcctcagtgtatcccaggatattgcatttcaaactattgcatttcatcttctttctagctccccaccctccaatcctctctgccatatacacacttcatttaacttagccatggatatatttgtctttctttttcacgttaacttcccatcagacttgacaaaatgccaaattagctgttcacttttggtggatgaaggccaggtacagatgtgttatggccagctaggtttgtggtttgtggttcacctctctgctgaaggcctggattgtagccatgttcatctgcaccagccccggggcccaagaagaataacatggttttgttgggtcaaaaagatacccatggagaaaaatccaaaggtagcaatggcagctgccatcccaggtagccccagactcatgctcagaagccctcacacccatcatgaaatcctgggccatgagactagactgctatagaaagagtgtcaaaccagggaggagaatccactagagtaaattttctttaaggaaagatatttagagttcaagaaagataaagacatgaagaaaactatgtggggttctgtagtggacccacacagctcagaagtaggacgccagtccaaaccaagacattaaagacttgttgcaaattattgaattttgcataatcatcttatgtaatttgcctaatggtccttagcaagcccattagtcttttaaccataaatttcacgtctgttttaatttccagatttccattggtagtacttagaaaactataactgcaggccagtgggtcttaactggtttcctgtggcactcttgagttgctatagacccatcgtgaatgtaaatgaatattttgatggatgtgtacaatttgctttcttacaaataaaatgcatactcttatagcaatattacttaagcagaatatactatagataatgggacccatttacaagcaaggggatccaatttctgcaaattataggaaagagcagagtgtagtgttgcaccagcatcagataaaacatttataggaacattcaagaatgttgtcttctaaggactcaagagcatcatcaaggcagtactaagttttcaaagagcaacgtaatgcttaaggtctacccatgggagtgaggtggtaattctggatgcttttgtagacactcagaagcgtgtaccagggactacattactactgtttattacttctttttttttttttttaaagttcttaattgattcaactgtgccaccaaaatctctgtctgaaggtgaaccatcagtatgaaattgaatcattgccatttggttgtgaaattacgaacctcgcctttcctacccacagacttctttcataggtgtcttggtgtacccccacctcctcctccagcctctgccaataactttctcacaagtcttacagcctctttgcagatatcattttctcttttacctcccagctttcaagagctaaacttgtcctgccttggtactgcacctgcctcctcttaccaagtgtcttcctgagtttgcacacattccttcttgttagtacatttcctgttgttaagaagctgacaacctcaccttattgctgccgcaccccattccacatttaatgacatcctccacccctacccctccccagctctggtgatgctttttagagggtggttctccatgttggctgtgattaacatcacctggggaagtttcacgtttactataacttatttccagggcccacccccagtaattttggttaaagtgccctgggggtggggccccaaccttggtagtttttaaatgctttccctggggatgcagccagcactgagaaccactggtgcatagggtgtaatacctgtctgttgtaggtaatgagagcaattgtggaaggggtagcagggagttttgaaaaaggatgaaaagagattaaaaaacaaacaactcttcctcatccctctgtttgctttcagcttcagctgaagagaatgagttctgctaagtggcacctatgcccacctggctggtgtgacttcttccccttaggcctgtgttctcatcagtaaattcctgacagccttgtgcccccagcaggccagaaaccattccaggcaaggcctttacttatctcatcatgaggcagcctaccaggggcctgattttcctttcttaactgggcatcctactttgcaacctcgtatttccatttttcctttttgtaaggctctgtaaaccaaagccatgcaccctccccgctcatctgctgtcagctcacttgaaactcaccagcccaaaggacacacacagcagaaccaattaaagttctcaagtagagattgttcacttcacttttcacttgcaagaaagatggatggcagagtctttgctggaaaactattgtgtagaacataattttgctgaattaaagaggggaggccactaccaaaattgagctgtcatctttttgtagttttcttttattcttaatacatctatgggcctctaaaatccctttttatatattatcaagtccaggagttgggcagagattcatttgggtagccttttttataaagtgatctttgtgaagtctcttctcaagactttctgggggtcagaatgcatgttcattttccagagggccatacgcaaggaccattggctgttccccacggctctacagtttctaaaggagctgagaacacttacaacatgagtgccttacagtactctctggacctcattgctttattattaaggaattatttcttccaaatatagtagttttatttttattagtaagtaggaaaatttaagtgaggtgattttggtgttaataacaaggattcagagctgttttaaggaaatccaatgtgaaatttacgtgaatatccagttgtacaaaaaaattaagacaaaacgcttcacttaacaaacttcttcataagaattatttaaatgccagccttctttaatggagtccgtttacagaaattctgtttattcattcattttccctgagcacagatattgcacaaagcaaataccaccctgctgttgtcctgttgcatggtaagaaatgcagcttttgtatttatcagccttacacatatagtgtgagaaccttgccaaggctggcagtggtgcaggccaataattaattaagggggcatgcagcatacatttattgagtacctagtatgtagcaggcacagggataggtagtacatatagaagcaaacaggctatctacccttacttcctagtggaaagagacaatcacataaccaagggattatcagtagtagacatttggttttagcagagagtaaaatatatatacatcgttaggagtgactgggaggctagggagggtccccctgaggaagagacatttaagctgaaatgtgaccaaaacaaccagggtttgcatgaattgagaccaccctggacagagtatatgcaggcagttgaaggaggccagaagggcagagagttgaggttgggtgcctgtactcaggatcgggaagcagcatggccaggtttatatttaggaagataactctggtagcagcacaaagggtgaattggaatccaagacagcaatgctgggaactcaaaaccaggatacttggtgagaatagaacaggcagcatgctgacttgatgctgaaatgctgggctcctcttttgtcctctgtcctctgtccaaacccagattggacctcacagccccatgagtacactagacctaatgaacttgttaaaatgcttttttaaaatgccaacttgtgtacctggtcctcatctaatgacgtggattggcatcgaagacttcattaaaacttcaaatgacctgatgcagggagttcatggaccaatctttgagaaatattgtgtctaaagactgtactttcactttaatattccatttaattctcaaaacaaccctgtaagaaaaacgtatttttcctagcttccagattaagaaacatgcccagtgtgattaagcatctggctcaaggtcacacagctggtgcatgttatggctggcaaagcaatgtgcttcttttcatagagagtcctgcctgtgtgaaaatggtaagaacaaccctgcaaaattcagaacacctttgagggttgtttcatgagtgaacatggtcaatctctcagatacaggactcaatatatcccatcttgggatagaaccagagtgttcatttttgctagcttttctcttttctgaagaagtttaatttttttttccctcaaagctagaattttaagttctaggggaaaatatatatatattgcaaagaagagcttggatcttaatattggtgtttctgggcctctttttcccataaaagaagttgaaaggtttaaggggtagcataattttatcacccatagacctagaaacccaaccattaggcctcacagaaaattgtcatgctttcagttgccatgaatcatttatttcttaagtggctcttgaaccaagagttgcaaaaatgatgttgaagatgtggaggagggttgctgagtgaaaagcacactgataattagaaatcttgcttaaaagctggcttgaaaacacatttgcttcaataaattacctgcctgcccccatctgaatgtgtgaggaaggttctagcttaatttgctcatgtggatagggtattgaacatatttatctgaaagacttaatatcataataagtttagcctggcctgacttttaggacgatgtccctcctggggtataggtagagaggaagaagatgaaaaacaaaaaaagacaagaaaacattttcctatggtggccccctgctccaccacacgctctcagctggggagaaccgcagtgagccctaccgcagcatcctctagaatgtcagcccacaccccacagcagactgcagggtgttaactgcctgtctctggcatgaacccagtttgaatgagatgccaggaagtgatggaggggctatacctccccctgaagcctggccattacgtcctgcagaattgaccagggcaaggcaggccgtttggtttacagaccacaccatgattgtcacagtgtagattgctgctttgattattttggaatgttggatgaacactccttcctgaggttattttcatcagcaacgatcaaattcagttgctactgcgtgtggctgatcgtccagagagggtgatttcttgtcacaggtttccctagggggatattgtgctgcttggtcttggtggtcagtctcacatcatttatggtgtaaggtgggctcagggccacatctgggggtatggcatacaagacatgatcatgttgtaaaggcaacgtgtctacccccttgtctgtgcctacatttgtgtctaagtgaaagaggaacctcagagacaatcttgaaaggaagacagttaactgcaattttaagaatgatggatttgcatgagggagaggctttagctttgtgataaaatgcgaaagcatttatgtgttgattacatagactgttcgtaaagtctggaaacatctatgttctagaacatattatgtgaagtaaaatgaacataccattaattatacatgggtcttcattggtttctagactttcggaccaccctcagactttttaaaattaatcatgttagattatctccccaattctagctgcatcctggattcatgtctcacccactgaaggtagatgccttacctggggcagattcaggtaaggcatacagtcagttctgttctctgtgcagctggttgtgatggtgccaagaaggctgtatgctgtcagcataccatttgctctgttttgttgttgtttttagtatatgtcttcacttattaaacatttattaaggagcaagtatttttaagtgcagtaatatgtatcgtacattaaggcctcacaattgctactttgtaggaaagaaaatctagttgaagtggtggtgtgacttgcctatatcatgcagctaagaaggttttgagttgagatttaaagagagatctgatacaaggcgtgttttgtgctttctctgtcaattctcatataatttctcctgttaaagctcactaccacaagaaatcggcattagttttgagatcagttagggattaaaagtgatttattaaatcagacccatgtccttatgacataggtaaagtggtatataccatgaacttgagaaacaattttcattattttttctatatgaggtggagaaaagcatactgctcaatgaagaacttaattttaaaagttgtaatgctgtttcatttgttgaattagttccatgacgagggatacaattttggatcaagctaatgttgctgaatctgtagagggacatcaacatttgatggttagttgacatttagaaaccccttcattctgacatgtagattctatggatttgtcatatttaacagagatcaaattatattcagaataaatgtatttcttcactgcctcattataggaaatgatattgtcattttaatattcacaaatggattttattttttgagacagagtcttgctttgtcacctgcactggactgcagtggagtgaacacagctcactgcagccttgacctcccacgctcaagcaatcctcccgcctcagcgcctcaagtagcctggaactataggtgcacaccaccatgcccagctaatttttcttttttttcttttcctttttttttttttttttttttttgcagagatgtggttttgccatgttgctcaggctggtcttgaactcctgagatcaagccatccaccttccttagcctcccaaagtgttggggttacaggtgtgagccattgcacccagcctggatttacttttattcagacagatgcctaaactaatattatccaagttttgtttctttttttttttttttgagacaaggtcttgctgtgttgctgaggctggagtgcagtgatgcagtcatagcttactacagggttgaactcctaggctcaagcaattctcccgcctcacccttccaaaagattttaggtgtgagccactgcacctggacagggtgtttttttttcttcttcttcttcttcttctttcttcatcctgtgacttaggatgcattttttaaatcccattgataaaactggtccttggactgcttgttgaagctttcatggagtttagcatttaccaagtcctactgtgaattgtttatttatatatgtatgtaatcatgtaccacataccaacatttttgtcagtgatggatcacatataaaaccgtggtcccataagattataaaatcatattgttactgtatcttttctatgttgtagtataatggccttacagtattcagtacagtaacatgctgtacaggtttgtagcctaggagcaataggctaccccatatagcctaggtatgtagtacactataccatctaggtttgtgtaagtacattgtatgatgttcgcatgatgaaattgcccagtgatgcatttctcaggatgtatccccgtcattaagtgaaacatgattctctactagatcataggagaaaagaattgtgtttagtgcatcttttggagaatcccttaggtgcctgatacaaaatgaatttttgctatatgaaactctaattcggcatgtgcaaataaccagcttgtcagtgtgccccaatatgcttccctcttccacatcttacatcttcctgtagtctttgccttactgtctcccattcaatagaggaggccaataaaacaggaaatcactcttgatgcctcttccttcaaggtctgtatgctctatctattaaatattgaatctgcttttgatttcaaatccttcggccattctcttagtttagacccttatcatctggatgacatatgttcctgtattagctagtctccattctgccagacttggctaggactatattatcaatattttccaccctcctgccagggagaattttctaacatgccaatctgctcaggtcattctttaaaatccttcattgatttttctgaacattgtctccaggtaagagatctaactccttaatgtggcatagagtcttttgcgatcagacccctggtggtcagtcagcctcatttcttgcattctgctgtgtgatctgtgttctagttatataactcagagttcctcacgtgtggcccgaggctttcataaaccactccctagagttcgtcagctgacttccctcttcaggtgtcctattctctgagaagctgatcctgattggccaaccacctcaacctaatctggtttcaatgtccctcatttgcattcccatgtgctctattacatccctttcaaaatgcctttcacactgctgtaattgctggttagtggtctctctttctcccactggactatgagcttcttgaaggccgatgtcacatcttaatatttatttcctcagtgtctagcattggatctagtctgtaggaaccaatcacttatttgtggtgttgggcaagttacatatcctatctttttaattgtcctcatctaagtaacagaatgtctcatagggttttgtgagaaataaaagagctaatatatagaaagcatcagaacagagtctggcacagaataagagctccatagatgtgttcttgttttatagtccaccccagggacatagaatactcactgaatatttgtagaatgctatcgattgataaagccaagagggagttccacaaattacctgggagagagagtagaaaaattgtgggacatgtcatggctgtattcctgtacaccaggaaaattaggtaattgtttgagattgttttaattatataaaaataccatttacattagcagcagaaactactcatggccctttgtgaagagaattatagaactattgaaatgcataaaagagctaagagtaagtggaaagatatatgcagagtttatggattgagagactcaatataggatcatctttgattttttaaattaatctataattttaatgcaatttcaatcaacatcttccttcacagatttgttttgttttttaaatgagcatgctgggagaccattctttatggactctcacgtttctgcatgtcatgcaagcagaggcactaacaacccttttgttctaaactgtcttttcaaggatgtttgtaatgtagctgtagaagataaagctgtagaagctaaagatagtgtttccctccagagcaaagggtaggtttgtttactgtacaatccaataaagataatgtctcccagcagggcaaggctccattatgaacagttcatgttccctaaactcagggttctttttttttttttcctttttgagacggagtctcgctctgtcgcccaggctggagtgcagtggtgcgatctcagctcactgcaagctccacctcctgggttcacgccattcttctgcctcagcctccctagtagctgggactacaggcacccaccaccacacctggctaattttttgtatttttagtagagacggggtttcactgtgttagccaggatggcctcgatctcctgacctcgtgatcctcccacctcagcccccaaagtgctgggattacaggcgtgagccactgcgcctggcccatcagggttctttaagtatgatacaaacccactgcatgcacagcgtctgcctgagtccctccacagtgccccctgtatttggacaccaagtagaagtgactgaacatgaaacttaatgctgttaactatcccataaataattaagtcctttgtctcagaccgaggagttttgtatcttcttccagcatctgtaaaaatgtgcaggccaacttgttaacttgtaagttgggtgaaatctcagatctttcacagttcttaaaagcattgtgataaatctccacttgtaaaaatcatttagcatattaaattacagcagtgaacaataagaatgtagtacaatgctttctcaaaaagctaaaaacaaatagatcagctattattgacaagaaagaaactgtcctttgctgatttgccttttttccttaaggatgataaatgaacctcttcaatttatctaaatcctttcactttgatattttccataacaactttcctttgctcttattagagtttagcatttctatatctttccactggcatgttaagctagcttcttttctgaaggtgggtggtggggttagtttgcttgtctgttcaaatatttgtttgctagtattaaataggcaaggcagatttatttgggctctttttttgtgacttagtactttcccactattttctagatctccttacccagctctctctgattacaccaaaagatattatagtcattttgctgtttgtctattttgtattatagtcattttgctatttgtattatagtcattttgctatttgtattatagtcattttgcaatttgtcctaaccccagccgtaaccctaaccccctaactataacaaggataaacacatcatggtgttaaatgcagtagagaaaaaaataagagaggtgaaaaaaatccgcagttaataatgattatggaatgcttattttagtgccaggaactattcttttgaagggtaatggactttgggggattaaagatcataaaaatagcattgataaccagttgtaattctaatgaactactgctgaaacacagtgttccacttgtgtctagtacatttctttcataaacatgtaaattactcaggctgcttcaaatccttttaggaaggagttgggaggtaaataatacataattaaagaagcacacccagacccaaagctctcttgagataatagatattaaggagttatttttggggaaaaaaatgaggtaattagacagtacaaaagtattttaaaattagagtaaatgttggttctgagaaatcttcagctttaaatcagtattttttccccccactgatctttgatatgtatttaggaggggcccaatgacatctcagatctcttccctttcctaaaactgtcaaaaatctttaaatcatagtggacaacatacaaaatggcttatttgggtctctggccccagcgcagggtgcctgaccagcccaggtgactgactgcagtgtagccttgcagccgagggtttgttctcctgcagccacagagccacatgcatgcgcttatccccgaaacattagctgggcttgttctgtaactttgtgcaagtcaagtcctactcagtgtgccctgtaacttgtttcttttactcagttattattgagattacagtatgttgcatctagctgtggttcattttcattgctgaatacagttctgttgtatgaatattcctcaattgacttatccactctcctgttgatagacatttgggttttatcattctgttctgttattaacacaatgcaaagaatatgcaagaatttctttaaaatgggtcagcaaactttttctgtaaatggcgaggtactaaatattttaggcgttacaagggcacatgtagtcactgttgctgctgatgcttctaaaattctttttttttttttttttttgagacagagtctcatctgttgcccaggctaaagtgcaatggtgtgatctcggctcactgcaacctccacctcctgggttcaagcgattctcctgcctcagcctccagaatagctgggattacaggcacatgccaccaagcccagctaatttttgtatttttagtagacacggggtttcaccatgttggtcaggctggtctccatctcctgacctcgggatccgcccgccttggcctcccaaagtgctgggattaccggcatgagccaccacgcctggccgcttctacagctctttaaaaatgtaaaagtaattcttagcttgtgggccatggagtaggggtcagcaaactgacccctgctctcagatatataccttagaatagaagtacttatcatcagtcatggacatgtacattttaaaaggcaatgagaaacttttttcaatgtggttatatcagtttactttctcacaagcagtacatgagagtaccccaatgcacctcctccacaccataacctgacgttatactttttaatttgcttgtctagtagatatgaaataatatcttattatgggcctcaatttgcatttccctggctgccaatgaggtggaacatcttttcctacaattatgaacaatttgtactttttctcatgagagatatttgtttgtatcttttgcctgttttttgtttgggctgtttatgtttttcttatcaatacgtaggcatttttatatattccagagactattccacttctatatgtttcaaatattttttcttttatgtcctgttattgcatccttttatgcacacacacacacacgcgcgcgcacacacacacacatttcttgccttcttccctaacagtgagagtaagaactactcatgtttgccctgaactgctttaatgtattcctgtctgaggatgaaaaaatgaactagatagatgacttctttttacagtactctcagtaataaattgatttagagtaaatattcattattaaataaggcaaaattctattatgaaatagcctgtaaaaacaagccagattggccgggcgcggtggctcacgcctgtaatcccagcactttgggaggccgaggcgggcggatcacgaggtcaggagatcgagaccatcctggctaacatggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaacaagccagattaaaagcgtaactacttgctagaagaattagaattgtgtatgaaaaagatcctaaaccaaaaaaacataattgaccaaaatgcatgctataacattaagcattcaaagacttcaaatactgacagtgtacttaggtttacctgactgtattaacgattcagttttgcatatgaaagacttactctgaccaaacaaaactcaaatttattcaacattatttttaggtctcaggcacctggagatggtagcctgtgctatacctcagctgtgtaaggatgtgtcatgtgtccttttcacataaagggaaaataagtcctcacaaaatcctatatattcctctattcctctctgttggtaaatttacttctgtggacataggtagggtaatgtactattttctttcctaagcacatttcacggtaggccagtgggctgttttggacttgcatgttgagtacaggatggactcttgttattctaggaatgggcttggttgatcacagaacacaatgcaccttttcatgattttaatgcctgagttatttaattttttgtgctacttgtcacttcactgtttagttttctttctagggtgctttttgctggattggctgtgagtcaagctggttgatgaagcttcattttgctaaatctccagaatggcttgttaatccttattttacatttcactgactactgtaccatgcagtttccttctgttcaacgaaggaagagaaaatggctatatgaagcaataatgtgatgaatttagagtctagccggaggaatcgccatttgcttctaattggcacatggagcataaaatcagagccctgatttttctaagaactattccaagtaaaggcccaacaaccatcttaactcagagctactcctagattgttttaaagtgcgttcatcaatttgaagagtatttgtatttatacatttcttgcccttcattgtatcttatttgactctgatactttctctcaaatttcttaacagtaacctttcatgttgaactgtaaaaaaagaaaacggacttcatcttaatgtatttcacatagatttccattacttttcactgtgtttttgccactctgtacattttgcttataataaagggttggttaaaggaaaatagatgtaatttttggcacttgtctgctctaatatcgtgactgacactcataatgtacatccagttctcttaaatcccataaaaagccattgggaagaaaatttttgagataatataaatataatcttacgtaagacctgtgtagccacttcttatagacagcttaggaaagaaagaagccttcaaataattaccaaagtaggaagaaaactaaaaacctctcgtattaagggtaataattgcaaaatgacacccacatagaaaaagtcccttcctttcattttcttgaaatatattgaaacaaaaagttaactaacatcatttgggtaccttttgagaactttaaaatatattattttaaaattgattttcttaagggttaaatacatggttttgaagtttttcttaaagtattttgaaagtatttaaattgattttatgtaaacttttgctactattggatgcagccttttcagcatagcaaatgcaatgtccttacttaatgaggtttctaatttttaacctcaaaatgaaatgaaaaatttgttctatttccaggaacatggagtagacatacttttccctgttcttcccactaagtacaactaaaattcctagacattgttcataaaacaaacgtaagaagactctgaaaggtagaggaaagatggcagaatatctatagacctcaaaacccaagcaacacacaatagtgagttacctggcttttcttctttttgagtcgtatttcccagagctcacatattcccttttttttttttctaagatggagtctcgctctgttgcccatgctggagtgcagtggtgccatcttggctcactacaacctccacctcccaggttcaagtgattctcctgcctcggcctcccaagtagctgggattacaggcatgcaccaccacgcctggctaatttttatattttcagtagagatggggtttcaccatgttggccaggctgatcttgaactcctgacctcaagtgatctacccgcctcagcctcccaaagtgctgggatcataggtgtaagccaccacacctgactgagatcccatatattcctgatgaagaaggcagcaagtggaaaacaccaacaggcacatacaaaaacaaataagtaaaagatgaaaatctgttttctgaaaccagaggactagaaaaggtagagcctagcaaaatggaaaacttttagataataactgttgtactctagccaagccccacagaaaaaaaaatgtggcctcaccctaccagcaaaagctgatagggaagcctaaacttccacccttgccagctctaaattgagagctggggtgtcccaaggcaccccagccctcgccactgggtagtgtcacagaaaactgagtagggagccaaggcttttatttctgctgcgtagtaacaagagcctccacctcaaccccatgtaagtagaaaccatatgcggaacctgggtttctaccctccccaactcctaacagtaatgaggagcccttttcctctccaactggggtggtgttagtggacatcatgtgggaaccagaaacactgtttctcccagccaggaagtattgttggaggcccgatggagagccaaaactcccactcctaactagcagtaagaatgcatccccctcaggtatcaggggaggtgtagtagggaacctgattctaccccagtaatcaggatgaaccagcaataataacacagtctccccattcccttctgggagtggtaacagaggaaggcaactaaaatagaaagtttaagtaagatccaaagtctcataacataatacccaaaatgtccaggtttcaatgaaaaaaaaaatcacttgtgataccaaaaaccaggaagatctcacactgaatgaagaaaaaaaaaagcagtcaacagaggccagcaccaaaatgacagggatgttagaattgtctgctaaggattttaaaacagccatcataaaaatgcatcactgaggaattctaaacatgctggatgcaaatgaaaaaatagaaacctcaggaaataaataagaaatataatgaagaacctagggggcatcttagaacagaaaaatacagtaacccaaataaaaatctcagtggatgggctggacaacagaatgcaggggacaggggaaagaatcagtaaagagagaaccatcaaaattattttgtctcaacactagagagaaaatagaatagagagcctcaaggacctgtggaactacacttgacatttaccatttgtgtcattagagacccataagaagcataggaagagggaggggctggaaaagtacttgagcaatcatagctgaagacttgccacatttaacagaagactgaaacctacagatacaaggagttgagtgtagtaggccaaataatggctcccccgccaatgatgttcatgtcttgattcccagaactagggaatcaggttccttttttctttttattttttaatgtagtaaaagggattttgcagaggtaattaatttcaggatttttttttcttttctttttttttttttttttttttgagacagagtctcactctgttgcccaggctggagcacagtggcacagtctcggctcactgcaacctctgcctgctaggttcaagtaattctcatgcctcagcctcccgagtagctgggactacaggtgtgtgccaccatgcctggctgatttttgtatttttagtagagatggggtttcgctgtgttggccaggctggtcttgaactcctgacctcaggtgttctgcctgcctcggcctcccaaagtgctgggattacaggcgtgagccaccatacccggccaaggattttgagatacagcaatatcactcctcagcatttaatcccagagaaataaagtcacattctcacaaaaacctgtgtattaatgcttatagcaaccttatttgtaatagtcaaaactggaaataacccaaatatcctttaatggatgagtggctgaacaaaccggtacatccatatcgtggaatactactccacaataaaacaaaggagctattgatatatgcagcagctagtgtgcatctccagagagccatgctgtgtgaataagcccaatcccaaatggctacatgtaacatgactccatttatataacattctttaaatgataaagtcgtacaaatagagatgagattcacgattgctaggagttaaggatgtggtagggacaggagggaagtgggtggggctacagaagggcaacatgagtaatacttggtgatggaaatgttctatatcttccttctatcagtgtgtttaccttagttgtaatgttgtaatatagtgttgcaagaagttaccagtgagggaaactgagcagtgggtacatgagatccctctttattataagtaactgcttgtgaatctataactatctaaaattttaaaatttaatttaaaaaataacttttaaaaatttcttgtagctacatcaatttgaaaacacaatgctatatcatatataaagaactttgcatgtccaagttcagaaagatgttagtacgaagttgcctcttctaaagtctgtttttttttttaatttgtttggagattgggaaggaaggcaagggattctgttttatcaatcatatatgttaaaaaatagataatatttgttaactcctaaacaccgtgtgaggtcagcattattgtaaagaagaacactgagacgcagggaggtggaatgatttgccctgatgagtagtgaggccacatttggactggacagtctggtcccaaagcctgcatcctttcttactgactatactctttggcctatctgcataggctattagtatccaagtatctttccgcagcaggacactcacctcagaagttttaagcacttttcctaggtcacagagtcatagctgtgagactgaaattcaagacttttcctatcaaaatcccatcctactcccacctgggagaagccatattccaaatggccctcagacctgatcctcaagcatattttgtttgctcacttagtgctgggcagtagattattctttttaaatttacattagcagtatatatttaaacattgtgagatatgtaaaaatccaggcttctagcttctcaggaaaaataagaaaatctgccaacactgggtgtacattctcaaattctctcaaaggagttagatataggatgtttagggactgcctcttacagcctctttagatgaggttgtttgcctcagtccttaccactacttacccagagaccacaaccaaccatcagctggtttttattgtgcaacactgttgtttttcttacagtagaggaaatgcctctacccacctagctaccaaatcatggcttttatgttttaccttttatcttaataatttgggtggttgtattcttcctgattataaactacttaaagttctatttctgaaaatctccattattagtggatttgcagttgttaaacttaagacccccatagaattgaaggtgctgaaatcactagtccatctacgaaggctagtcactaaaacgaaataggcatacatgaactagaatatatctccttcaatacttcttaaattagaaaattatgagtattgcgcagtcactgtgttcgtcattacaattgctttaacattcctttgtaaagactttctagtagttttgcggagattcaatgaggtgcttataaattgattttgtgccaggtgcagtggctcatgcctgtaatcccagcactttgggaggccttgatgggaggatcacttgagcccaggagtttgagacaagcctgggcaagatggcaaaactcaacctctacaaaaaattttaaaaattatccgggcatgggggtatgtgcctttagtcccagctactcaggaggctgaggtgggagaatcacttgaatctgggaggttgaggctatagtgagccatggtcgtgccactgtactccagcctgagcaacagagcgagaccctgtctcaaaaaaataaataaataaatgaaataaattgattttgcttcatggcatgcgatacgcataataataataataataagtatttcttctgtgtctggctttctactgaagtattttcagttctacaattcaaggcccctccacccctattggtctttctcttaaggggcccaactctgagtgtctctcctgagtctcatatgctcagtctgaaatagttgaccaagtaggaaatggaagtaaagaatttcacggaaggggaatttgccatgagggaagggttaataagttattcctgttgatcgcctttgtaatgcctagcacattctcgttacagagtagacatccagaagtgaaatgattatgtttgatgctgaactcctaagtaattcaatattgtctgaggataatagtcctgcaaattatattacagtcagaagtgtttttgtttttgtttttttccagtcgaggagtagatgactggaggctgccttgtttgcgtgagtggtgttgggatgaccttccaggctgggcatgtgattcctgaagaagtggctacttgtttggctcctatatcaatgcagaaattagtgtttgagctgataggaagtaagggggggaaatcaaggagtggaaaggctgcttgggatggaatctgtagactctttctgtctgacctctggttgctaatctatgttattgttactggaaggggaggcctgcaaaggttgagtcctggcaaggatatcaccagagcaggagatcagtgacttcttagcttataattccactgtaggtgaaactctagcatttgcaggcaagatggaagataaggaagtgggtgaaggggtgaaaaatgaaataaatattgaataaagcgcctgtactctggaaccagattgtgcgtttttagtttctgcctcactctgtcatactattgtgtaagcttgagcaaataagttatctctgaatgcttcagtttcctcatgtgtaaaatgggaataataatagtatttacctcatcgtgtaaacagccagtaagtagcagcatctctgcactggacaatttttcttttgtcaattgctctttttattcggtacctacagtgtcatctaaatagcctgtcccttagtgtatggagtcaggagactaagaagaaatttagggaaaataaggaaggataaaggaataataagcaaggatgaaggattgcctgcatttgagacccttgtcaatgtgtgttttctccaaagaaaatgtgtctcttttccaaagaaacatagatgtgtctctttggagaacttgtttccaaccttagatgatttttcagattcagtctgtgtgctaaactcaaatcttctcattttctaagtacatctgttcatgacttataatatgttaggaaggtattttgccctggtgaagaaggacttagttcttattcctacttaactaagggatagagaagaaaaaccttcaaattacaatgaaattgattgacctcaattctttttagatatttgtctacaaaatgtctttagtaataggttttaatacttttgcagttgattttactaaacagattaaaaatttaagcccacttaacctcaataaacaagtatatgaagtcacatacaactaagtacttcaaacccagaaactctggcactgaaggagataaagtagcagacaccttctgtgtattttcctacttctgtacctcaagacatttgctgtgtacatttataacaatggccatgtcggaaataatatttttgggtttatggatttttattgatctatttcatttacgtgggtttgatcccaaatgatgggatgatgttctcttatgaagaccatgccttgagggaaaggagagtgcttttaagtaagcctgttcccttctggctctctttgatagggtggtctctcccagggtttatttaggaaatgatggaacacaggtcagtctgtccttgtctctaaccaatctaaacattttgctttcagcaaaatttacatattattttcaaacctttactccacatcttgcattattgatttgattaatctctgctgtttttaaggcatatcttcttcaagacagcatttttcttttatatccaacaaattcctttcagatttctaaatgcgaaaaaaaaacttagttgtggacaaaagtacagccattctctttacacctgaagaaattaatgttttttcgataaaagtcaccatatgttaggagggtgacaattggtattcaaatgtgagtgaggaaaagaataaagactgaggcaaacaaatattaccattattgcagtgttccctgcaatctgtgggttgttatttatttacagttttgttcctgtaggcccacagaagagaaatgcaaggaggagtactcctgaagtagaagaggctgtagaaggttggaatagagagcaacaaatcccaggtcaggatgtggaagggcttacaaatcacttaggctgtctgggtcccaaactttctcagctgtaaaatgaagcagttgaacttaatggttctctagttggtgcctcttagactttaatgtacatcctgttaaatgtgcagattctgactcagtagatctggagtgaggcccagggtttgcctttctaacgagctcctggggggtgccaatgctgctggtctgcagatcacacactgtttagcaagctctgcacgatttctaagctcaagcttccattaactctacgattctatgaacgtgcagtcagctgacattttagaaaagacaggaaggtttcatgaaacatgcctaccatggtattaaccattctcattcttcataatcatcttcatcaaaaactctttaagtgcctaattatgcataacagcttcccatgctttacaaaagtatatttggtctttgccttatcagacttgacaacctaagacagagaaatatgtatagagacagtaataaatattgaggcagtaataaatattgagtaataaatgttcatccagatatagaacacattaaaattttttaaaaagtatgtacttagcatgggccctaggatatttattttcttacagcttgtcttcctttcaaaatctgagaaaccaaagaagttgccctataatttttacatgaaagtaagagatttctctttctgttttgcagataggggttggaaatgggaaggtcagtttctgaggctacttttaatgttgttgtttgctttgttttggcctcactgacttaaaaagaaatattttatcagccctgaatgcctaaccctaattaccatatgcaggtgccttggcttgactttgtgcttctcagcactgtgtgtgtacataggcttattaaattagcgtcagctcctcctacccaaggacctcaggcccatctagtcaccctcacatcatccttgggaagcaaaggaggcagagctagacattgttatctctgaatcatgggctgttaggtgataccaagaaggaaactggtatgtccaaagccttgtgataattcacatgggaagctttggatttgattctgtttcttctgtacacatttgcatttgctgaactgacctaaggacttgatctgccttggtgtgggaaaggatcagataagaagtcattgctggcattttctcttgaaagcagaacaggttctgttcccggaggccaggtcaccaaccaacagagattgtgttcaggtacctgtagtgataagccagtttgttataactgtatcacaggttagcagagtgatgtcaggatggctcatttcattgattattgtaacttagcaagagctacaagaattatcacagatctagaaaatggtcacatctaagcaagggtctctgtatcagatatttaccaacagtgagattagagacccttgtttacaccttctcaactcaagtaggcacatataatatttagtagtgactatgtgtatgctcagagatgcgggaaagcggagggagctgtgtgtgccacgctcttgggcttcagctgtgtgttatcttgtgtgtgtgcgtgaggagctgctgtggaatcaggtgcacttgggtttgaaacttggctccaccactcactggctgtgtcacttcacatttctaggcctcagtttccccatctgtaggatcagtgtaacaatagtatgaatccttgtgagcattaagtaagatgaggatatatggaatgtatagcatggtgtctgcaaatagtacttgattattagtaatcatagtaaaactcatacacgacagcatctgaaattacttgtctttaaagaagttagagattcttaattatttcacatgcaagtgtttgtacaggaggtagtgtctgggttcatgaaaatgtcacactcattttattatgaataaagcttttaaggaggcaaagcctccattaactagactcaacctcatctttcatgctaatgtcatacacaactgttttctcttttttataaaattataaagaggcaagtcagtctactcatactagaagatacaaaaccctgactattatatagcaggaagctaaacttctaaaaagccacaaatggcaatactatacattttgcattagggtcttggaatagatctatatggacacatggaattacacaggctgaattgaggacactaagtatctggttgccttctctctggcaaacgagagtggagataggtacctggttgcaggaagtaaggagatgctctttgcctacagacagtgagggaaggctaaccagcatttggaggggcagcgttctttgggaaattgaattttaagcctgctaaccatatcataagactgcaaggcctggcagaacaagagcatgaggcagctggatagaaacccaagaaaccaaaatgagcgacttaaagtggagctgtttgaaggggaaacagagccccagggaatttcctaacctcagaatgctattcactcacccttttttatagggtgtctgtggcttctggttgcctgcaaattgagccagcatggtgcagatgtgacagtggtttaaggctgtttttccccaaatttagtgtgaatcacctgggggtcttattagaatgcagagtctgattcagtagatctgaggtagggtctgagattctgccattttcagcaagtccccagatactgcagaaactgctggtctgggaccatactttaagtagcaagtgtctaatccactctctcctcaaccatttcatcctctgatcaccaccttctgtcttctatcccctgtgccttaactccaaccatttgtggcccaccagtactcaccatccagtgatcctgctaattttccttgtctgtcaccccctccagttctcctttcctagttatctagcttagattccatgatcttgtgttataattattcttttgcatccaccctcaggttctttgctgctccctcttccctcatgatcctcactggcaaaaccccaaccctgcgtaacacagctctctccccacgccacatcttcacctacactggtgagtgcggctgaaggaacacacatcactgtgctcacaggtcccactttcgtctcagtgggtccctgtgccgctattctgtccattgttctgcttttctggatcatcttcttgtgtcctgtcctcaaacctcaaatacctccctctccatcctcattctcagctaataatcttgctgcctttcctggatctgcccacatgtctgcacgtgtgcccacacctggccagtgctcccctcagtgggtgtggaagcaccaggcatgctgtagctctctgaggggtgcccaaggtgggcacatggaggggccagtggaaccagccccctctgacctgcctcccccccaccttcaggtctgtgctcagctaacattttctcagtgctgcctttcctgactccccaactcaaagcagcgcccactccccaggcagtccctacctccacagtgcctctgtggttttcttcagtgattgtcacagctatgctgctagatggtgggtttgttccccacctccactagaaagatacataggacagggaatttcatcttggtcaatatcgaaacccccacctagaatagtggctgacatatggacattctccttaaagaaagtatttggatagatactagcatgggagatgtgattgtgtttggacagaatcagaaaaagccaactaggaagaactgcatatccacacatgtatttaaaaagccactcccggtctttttgaatagacaaggctaaggaagatccctgttcagggatacttttggacctgaatatgctgaatttactagagattgttgagcccaccaggccctttggggatcaggaggggaaaggaccaacatcaaattccatctgagaatcctgtcgcttgtctcatttgatgctctcagggaggttggtagtgtgagtcaggatttaaccacccgacactgctctgcactccgtagcattgtcatactcacttgggacactagcagagctgtaaccagttctattttacaaatctgcaggctaaatatgcctaattcgctgtggtttgaggaaaagagatatatcatggctatgcctaggactccatgtgggccaatcctgatgaaaacaaccacaggacaagttggcagtggaaatgtcctaagatggcacagaatgaagttgattgccatgaaaatatgttgtgctggtcattctcaaggagtcaggcgttcagtctactgaaagtgaaggaaaggcatatctagcaatacttcttattttattttgaggagttctgcttttaataacattgtcagcatgcactaaatcattgtctctcaaggttttgagcagctgtgatgcagagggaaaagcacagggtgttttgtgcgtattggatgagataactgacctcatgcagggctgagaatacaacaggtgctttttacatgcacccactccctcatctatgccctttccaatggtccccatccacactactgtttttctgcatgatatgaaagttaagatataaatatgagagtatgtgagtatgtgtttgtgtttaagagatgccctcactctgtcgcccaggctggagtgtagtggcacaacatagatcactgcagcctcaaaatcctgggctcaagcaatcctctcacctcagcctcctaagtagctgggattataggtgtgagccactatgctcaaattattgtgttttaataagtcatcattcattttagaccagtgattttcaacatggggatgattttgctcctaaggggatatttgttgaagtctggagacatttttgtttattacaactcagggcaggaaatgctagcccctcaaaacaaagaattctccagccccaaatgtcagcaaggccagggttgaaagccctgttttagagcatgtattttacattggtgtttatagttatttcctcattggactctaaataaatgaaggagagaattgagaaggatgtgactggctgaggacacagtgggacaggaggttggaacaagttgggggacccacctatcaggtgccaggattcactgactctttacaagcacactacagtttccagcttaaaaacaagtgctttattagatatactcactagcagaaccccaaccctgcataacccagctctctccccacgccacatcttcacctacgctggtgagtgtagctgaaggagcacacatctcagtgggcccctgtgccgctggtctgttctctcttctatactggttaagcctctaaagcagatagggtggcagaagcacggaggactcaggagggcagtgagcatgatgagatgacactggacaggctgggcactgtgatggggaaattgtcacaatgccaggggcttgggttttgtcacaagggctgtggagaacaagcacggatggggccctccagagccaaactatcctgttcttttctgtactgtattcacaacctgttcatactcctcttatcccttgcgtctctctgtattgtgctacttacttgtaacttgggctcctgaactgggccttgtcatctttgcctttgtgtgccccttgtatatagcacagagatttatcagtaagtgtttattaaacagatttggtggtgttttagacaccactagcagcctctcaaaataattgtttctccacttttgaacaagtactattcccaaatacttgttcccaatgcaattgtttagagcttgaaatgcatcctcctggttttataaatgataggttttcagactggtggggaaatttcccagcacccacagtgttgttgagccataatgcttagtagcccaggatgtgggatttcccagcaaaaggccaagagaagagagtttccattgcctttcttcgttgtgtgtggactcttggcaagtgggttctttaccattctactgcctctcttggcatggaaccttctctcaccttctactgcacttttctcttggtactcatattcaggcggctcttagaccacatgggttaagagtctgggtgttcatgtcttgctggccactgtggagtctgacactggagctcatggaggaattaccaccttgcttattgtcagcttgactatttggtctttcaaatgttactttgcttttcatttcttctaagaaatagctctttcttttctcttttaaactttaccaaaaaagaaaagaaatagctctttcttttctcttttaaactttaccaaaaaagaaaagaggggagaggaggcaccagtttcccccagtggatatttctcctgagaaaattcagtctcgttatcaggttcattctttaactacccatgctttttacttccacttagcatattttcagatgtctacttagatgcacagttctacaaaaacagaattttcgatttgagattacattcctcaaactcaaatcacacttattcttggagaagtgatctttataagtgatagttttatttttaagcataagaagccatgttaacaaaaatacagcatatttaaagatgaagacattaaataatatagctaaatataacaattatcacgtctctatacaattttgtttcacctttttttttttgtgctgaaaagactttcatcttcttgaggcatacaaccaattttgtttttgcttaatccatgtgcattgcacatgggctctaggggtctgtgtttgaggtgtgcaggtgcagtgctggtgataactcctagttactgttatcattggtgggattgagttagaaggcagcaatgattaaaacgaagtatggacataatttattactacatgcaattaatgccatcatttttacttttctacatgtataaaattagggataatgtttaggtctggatgttttaagagcaggttttagcttttgctttttaacattcttttattatagtattaaagcagtaaaagctaattaaataagcctttttcagttgcttactgttggccaaatgttaaataagtaaataacaagatgatcattttactcttaattgttgcagttttaatccagttcagaattttgaaattgttttctcttgtgtttcttttccagaaaacacgagatttttctcctatttcagcagttggccacaacttcattgctgggaaaaggtgatttcaaagtatttatttatctggtttattctacattattactcattcaaactggcttttagtttaactttgcatgcatcagttgttgatttggagactctgtttgggttaagtctgcagacacacagcttctaagctgaaaaacatccagggaatgagcttgtctgatttgaatttagcaacttaggtcttctgcgatagaaaccaagacgccaatgggtatacttcctacaacatggtgtttccctttgattggtggtaagcccatccatggctgagctttgtaaagcctctgtgaagttgggctaaatgcctactctgtctcaatctctttcctcatctttgagacagggataataattggatagtctcatgggcttgatagagagattaataggatacacagtgctcactgccaccaccaccaaaaatatacgaggctgtgtttttggttatcattattcatggtattaataatctcattttgtgctgatgataaagttatgttaataattccttaataaccttgggtcatcttctgcgaacagaccaaatgtggaaaaatcattcagactaaatgaacaggttaacacaaagacattctgtcttttattttagaaattcatttactacaatggttatcagtgtttataatgaatcctggacttcgaagcactatgtccacccatttgaaagatttattttacaaacctcaagtgttatggcctgcccgactcatattcattttaaatcattatccaatgcctgtatggcctggaaaggaattcatctggtctaagttttcccaatctcttcaccaaaggaatcttgtaaaataggccactgtcttttaattaaatctttgcttcaacttactgagaaattccttctcttgccagagtaaccctttcctcttaggagagcagggagctatttcagggttattttggttcccctctgaggccacagtctttctaaatataactgcagatcctggaaatcagcctgccttttgttagttaacttaggctaaagaatcagtgcattaagacctttgattatccacattctaaaaacgccttcctctgatctcctaatatttgacaagaatctcgattcagggattagacattttctctaatgcatttccatttccactagagctgctcgccttacacacattatggcctgaaatgtagagcattttccggttgggggtaatgaagatttaactcaagaatctatatactttagaataggcatcacatgtttctgtaatagaatcacattcctcccaatttctggaaagcgttgtgtggtacttttttgtacatggctgacttcttgagttttactccatctgaccctcctatagaagctaagcttgaggtcaatgtttgtatcttattttagtacctacaacatctaataaatgcctggagcatagtaacacacagtgaatgctctaatttctttaaatgaatatatctctgacactaaagaagatagaattcatgaaaagtaatttatctcaagctgagctttttttctgactagatataagcattcttctcaacaataatgctttgcttgttattttcgccacattaaagaagtgccaccaaaaccaatttatgtcccctttccctcttctgctgagatcagaactaacatggtggctacattcttttgaaacttgtaattgtgtgtcatttccacagtggaagtagattcagacagtatctgcaccaactttagtggtaatagtagcgactttatgatgttttaatttgaaattcaaaattttaaattgtcccaacccattttcaggcttccaatgtgcctgtgccttggaaatgtatttcaaacttccatagttgttctttccagttattagaaacataagcaaagcaggctgggtgcagtgctcacgcctgtaatcccagcactctaggaggccgaggcgagcagatcacttgaggccaggagttcgagaccagcctggccaacatggtgaaaccccgtctttactaaaaatacaaaaattagccggacatggtgttgcacacccgtaatcccagctacttgggaggctgaggcacaagaattgcttgagcctaggaggcagaggtttcagtgagctaggattgccccccaaaaaagagaaacacaagcaaagagaacacagaatcagcaaccgtccagggagatgtgcactcctaagctgaattaacaaataagtgtgtttcttgagaggccagagttaacacaattagtgatgaactgcgtctttgaggagctaggggaaaataatgggattcatttttaattcaaaccaattctaagcaagagccttggctttctggagtggctttgtaatcaaaggttaccgcagggcttgtcagaacttttaacaactgtctccactgtgaaaatggtcttaagttgtaaggtgattgcagagctgaggaaatgatgactctagccagcttttgtctcgcatttgatctttggctcacaaagacgaggttaatttcagcataagctgttagctttattttttaaatcagtcaattttaatagcagcctgcttatgccctgaaaaacatccaagagcagtaagaaagagttggcctggaatataaatgttacagtataaatcttagctatctctaggccagtagtcaacaaaatactttgcagtcagtctaattaatctttcattttctttttgctatccttccttgtgtttattgtgtgtgtgtgttttctgaactataaagcatatacatagtcacgatagttggaaaatttaatactctcaaggaagaaaaaagtttccttgtgaatccattacccaaagagaaccattgttagcatcttggctggtacttttccctgagaatttttcccaggcaaacatacataatttttaaattccttttggttttgtttgcttttagagacagggtctcactttgtggcccaggctggacatagctcactgtagcctcaaacccctgagctcaagagatcctcctacttcagccttccaggtagctaggaatacaggcacgtgccaccatgcctggctacttttttttattttttgtagagatggggtctcaccatattgcccaggctgatctcaaactcctgggctcaagcgagcctcccactttggcttcccaaaatgctgggattgcaggcatgaaccaccatgcccagcctcatacttttaaactgcttatgatgaaaaattttatacacacacgagagaatcactgagtccttacatattcacagtctagattcacagagtatcaagattttgccaccatggcttcacctatcccttttttctttctccctttctctttcctcttttgaaatatcaactaagctacttttaagaggaaaagatgactcttgatattctgaggactatggaaagcaagtatttgcctgccaatttcacatattctcacttatcctttattaggaagcaaaaagtatggttttacacttcatattgtattgtactttgggaataagctgccttaaagctcaagtctattgcatgctagatgggtattgatttttcctcttaaatcaatgtttccctagggcatagttttatttattcataaagctaagatgatgtctgacaggagttacagcagtgtaaatctgtggtgcaggcacaataagaagagcttttgtaacactcaaaaatccatgttctgatgctagagggtatcctcataagcctgaaaaagtgcatttgcgatgcttgcaagtgtaaaaggaacatttcagcatatcgttaagttttactcctctgttttctatgctactttgcaaatggacctaaatacattgtgactgaagccaagccatgattgtgtctgatgcacaacgggttattggaacagcaggctggatagaatcaaagcttcagccacaatctcttgttgacaccaaatgtcagcttgctccggaaggatgtagtggccctgttgatctgtcccctgtaattttgctccctggcccaaaggatgggcacttctgcccaaggggcagttaacatgagaatgttcactttgggatacttcattcactttggaataaccctatgtacttgttggtgtgttatagtacatgtaacagctctctgtgtagctaggccatgtaagtcaagtgtaatcctaaaagtgtactcattttgttgatatatatatatgacatatgatatatatatgatatatataaacatatatatacacacatacacacacatgcatatatatacatatatatataaaatacatagtctattctgttttaaaagtgtttatgatattaaaattattgttagacttttttaacttaaagaaaatatgccctgacttttccctcaacattaactgatttttttccctatggttgaaaaatgcttctaatgggtagaatggcaccatttggaattttaaatatccagttttttattagcagtctgatcttagcacagtagaactggctggagagtcaggtgacgtaaaagctagtttcattatccactcttggctgctttgtgacctatggcgagtttctgaacttctttgggacattttgtttatattgttgtttttttcccctaatttaaacagcagtgagtttgtgagaaattggcagatttcacttcttgatttccatagacttccatacatcaggactcttccgtttgaaagtaactagttgatatttaaaaaaagaagaagaagaaaaggaagtgaaaagagaaaaaaaagaatgcagaagtgaggattatttcttcatgaagaataaggtttgttccagttttaaaagcctgtgacttctctgtgaaaacattgcagatgattagctcagctaccaggagccacacagttttcttagaaattgtgccattgaggacaccaagggggccagggaggacacagctccagttagaggctggggccttgagcgcctccccccaagagcagctggtgctctgccaggtctgtggctcccaggatgcccagatcccttgccagaggtttgggagaagccttaaaggtgctgtctcttcggatctctgctgtttcctctccactgatagctacattgggagcctcttcagaggaggcttctaggaattagaagggaaagcatataaatgccattcactacagtacctgttcactgctggtcacagttgttctcctttgcctcatcagcctcaggcatggagataacctggtggcatgtcagtgtcttcgagtttttcccattaagctccaagagcattgattgctattcacttcatgaatggatgtcttgagaagatcgtaagaactacttttgaaggaccgaggctgccgtctctgcttcagtagaaacccgaggtgcctgacatgaaaagcacactagaggacctatttgaagaagagagagttagctgtttggaatctaaccgtttatgttaaggtctgtgtgttaggttttctagttagctttagtcaagtccttcaaggtctttttttacattcttccaatataatctgctttatattctttaatagtatgtttttgctcttttagcattaattaattatgcactcctataggaagctgattaggaagtcatcctccttgaccctgtgtttggttcctttagagcaggggttttcagcctttgcaggaaccaggccacacagcaggaggtgagtggtgggccagcctcctgtcagatcaatggtggcattagattctcacagaagcatggactctatagtgaactgcacatgtgagggatctaggttgtgcactcatgatgatcttagtggaacagtttcatcccgaaaacatccccactccccctgcctgtggaaaaattgtcttccatgaaaccggtccctggtgccagaatggttggggaccactgctttagaggtcctcttggctccccaagtcaaccccggtgtggaagctaaagtaattctatcttgtaagctaatctaccatgttgacttcttattaacagttccaggaatgctctgagatctccagtttgtcttttgctccttgtgtaagagcatatacctaccataaatcctgcccttagagcagatcaaccttgacatactggtacttactataaatcctgcccttagatcaaattcctcctcatttcctctggagcatgtgtaccccttccctgggtatataatccttgggtctgggggtctaatgacgaggagatctgcttgtcatgtggctacccaagaccatgcccctgtccgtaagttccccaataaaatcaccctgtaatgacaagagggacttgtctgcctccttctttggttttttgactccttctgtgtttgggggttgctttgcctatatgaccttttcgtgaaacacctggtcattaatggagtgatactttcacagccagacacctgtcacatccaaattactaacataaggtgattttgaatgctggatttctaggatcaaccacaggttctagtacttaaaaaaaaactttaaaaaatgttttttagagactcccactccgtcttatgaaagctccatcctcaccagtggagaaagaatttccctgttgggtctttgtgtcttgcaggtggccagaggtgctcactgaggcctctcctgttcagtcgcagagagctccagaccagtctcttgagcaaggtttaatgaagctgtggctgccttccatattcctttttcatgtcatgaaaaaagatacttcttttgtgggcctgccactttaggaataaaaaccctccctcaactgcttagtaccaatattgccctaagaaggaagtacctggctctcatggccttatctgagcctcgaatagaggagacccacgcaggctggaatggccctgcccaggcccactgggagagatgactcagttccaaatagggctttcattttagatatttaaattccaagtttctcatagttattcatgactaagaaaaggggcagctctgcactattccttcactcacatatttccttcctttctcttttttcatcatcttccctttctccctttatttagtggatttttaaaataaataaaatgctgtgtggcatagcactttgccaaacaggaaactctcataattttgtaatattttctagaatagattttagaccagccatagtgaaatttaattatggtgctaatgtgcttctgaagattcctgataaaagacttgtgcccttaatcccatcgactcaagaggccgaggtgggaggatcacctgagtcctggagtttgtggctgcagtgaactatgtactccagcctgggcaaagaaaccccatctcttaaaacaaaacaaacaaaaaaaaagatttctgttgagaggataaagttaaccctgtctatggtggctttaactatgacaaatcagccagcagtaaattaaataaataattttttttctagtgtttcttataagggaagaaccaaaagattgagatttatgtgaaaaatgaaaaatatctgataatgggatagctggaaaacttagaaaattagaaatgggtttgcgatttcattcatgtgatcctttgccattacccatctgatgccccatagcccaaaggcatgctgccaatatgaatgtttacatgtattttttatagctgaatatatatagtttataaaatggatatataccattaagatgttgttagacaagtattaggccaaacaggttatgtttgcagaaaacaagtgtgaatgcaaggagtttagtgtgttcttaaacttctgctaacaaaagaacttccatttacttttacagagttaagtttgcctcctgagtatatgagaatgtggcataggccacagatagcacctcagaattgatgtcgactggtgactattgcgatgagtgtgggtgcttttatagataactgaggtgttgttagctgaagtgtcaagagtggctggattgtaattgttgactcattttaaattgctttgttttataatctcttaatataataaatatgtagtattttaaaatatgcctcaaagacaccaaaaatgatgaaaaccactgaattacgagactaaactgctccctcccatccctcccatttgctgtctatcatccttttcccatgaaagatggcttttataggttgaaagcatagaggatggctccttcttgtcattcagatctccgcttacgggctaccttctcagagaggacttccccaagcatccatggctcaggaaaccccataagacactctcacctttccttttttacgttttaaatgttccctatctggtactttggtgctagtcttttgtcagtcttcacctacaaggtgctaagaccccatctgttttgttcaccctgtgtcctgagtgcctggagctgtacctggcattgagtaggcattctttagatgttccatatgcaggctttttcctttggacctacccctgtgcctgaccttgagagcatttcatcatcattgcctagaatcaggcccttgttttggaatctgtggtactgtattctctgaatttctgtcattaaccagcctttactccctggttgcagcatctgattagtatgatgataacacaactactgtatgtcaacatgatgagcatttgtggcaagtgagtcctatcaaattttccagccacaagagagcttaagaaaggttttgagagagaaatgtgtagacatttaagtctttcctatgctggtgttaaccctcaagatcaattggccagaatgttctgctctgatggtagacctgagtaatagcatgttgtagcttccttttttagtactgttatttaatttacccccgtgagtaatgctataagaaggaaggctttaagaatacttcacttctcatcccccgacttccagcccagtagcctgagtctaatcttgttatgtctgggaatagagttactagattttctgctaatggctgtattttacatgataataaatccagtcttttctacaaagtctacttaatttatgcaaaacagatataatttggaatgtgtatgaatgaagctattctttcaagggagcagagaggctgctgtagagcctgttaaatacaattttatgggccctcatgtcaggttaacacaagcaaatgttggttctgtggtcatcaaaggtaatgcttattggatagtttcaggtaaaacaaaaaacagcttttgaatctcagagcctttgctacttactccctaatttaagctcaacttgttttcaaccatctttcacactttgaagtagtgacctcttatacattagtggcctcaaagtattagtgagactcctgctcattgattttcaataatatagagaaggtattccaaactagttctggccattaacagagcaaaggcagtaaattaaattagcagggggatatatcaaaagccttttgtacatgccataaagtctccaaaatctaatccctgagagaaatttattttgttctggaaagaatagctttcttctattctaaaatacctttcatttataaaagaatggattattgcctgtgaatggaatagcaggaattctcagtcctttaattttgccatcaacttgctgtggtttatctcaaaaaaataatcaacctgtaagaaaaacatccgtggctgctctgctctttgacttttaggtagagttaattgtatagattaatttaaaagttaggtgtactaattaatagttacacatttcagaagtccttagctcagggtatttattgatttttgtctcttttgagttttataaaaaagctagatgcctgaaaacactgaattgttttacaatgctaagttaagaatgagtaaccctgccttcttactaatggacaaaattttgattttttgatctaatgccagtggtccagtgcagaaacacaaatatttacttgcttaatttggatggataatcagattttttaattattttcagaggcagggggttaaaaaaatacttaggctttttttttttagatggagtctcactctttttgcccaggctggagtgcagtattgcaatctcggcgcactgcaacctccgcctcctgggttcaagcaatcttcctacctcagccccccacaagtagctgggattacaggtgtgcactcccacacccagctaatttttgcatttttagtagagatggggtttcaccatgttggccaggctggtctcgaactactgaccttaagtaattggcctcccaaagtgctgggattacaggcatgagccacaacacccagccccaaaatacgtaggcttttaaagcaagataagtgtgctttagggagacctttttgcagaggctgatttagctatggggagataatagactccttcgagaagctaatgaatattctagactgtctgaagaaagacacatgcacagaaaatttgacataattgcaggtagtttacagaccctctgaaagttggccaagatcctgttggcacctatctataggactccaggcaaacaaaccctgacttacttcttccaagcaggaggtatgtttaattttgtgctgtaaatactggtctttcaatttctggtagtaacataacaccccaggcatatttgaattttataaaatgctgtaatatttttatctaaacagaaacaacatttacagttggccctctgtatctctgggttccacatccatggattcaaccaacctctaattcaaagcattcaaagaaaaaaaaaaaaagaatgtttgcctctgtactgaatgtgtacaaactttatttcttgttattctctaaacaatgcagtatatcaactacttacatagcatttacaatgtattaagtattataagtaatctggacatgttttaaagtacatgggaggatgtgtatagtttatatgcaaatactatgcctatatatatacttaagtatatatacttaagtgtctggggattttggtatctgaggggggttctggaaccagtcccccagataccaaggaacaactgtatttaatccttttgcaatgaagtatatatttaagatgctgacaattattattaaagaaatagttatatagaacacttattgagttaagaagatccattttattttttgagacaggatcttgctctgttgcccaggttggaatgcaatggtataatcatacctcagtgcagcctccaactcctaggctcaaagaaccctcctgccttagcctccccaagtagctgggactacaggtgcatgccacgatgcctggctacttttttatctttcgtaaagacagggtctttctatattgctcaggctggtcacaaactcctggcctcaagtgatcctttcactttggcctcccaaagcattgtgattacaggcatgagccaccaggcctggcctgaatttctaacaccagctttaaaagatcttgctctggtgcccaggttggagtgtaatggtgtaatcatacctcagcgcagcctccaactcctgggctcaagcgatcctcctgccttagcctcctacaggcacacaccaccagctttaaaaggacccccaaatcaattctattgttaattttcagtctgtctttcccctaagtggggatgttaagaaagaaaatagtatcagtttttattaccacttgcctggcattttttaatttgtttttcccaagtattcctagtaaattttgctttattctcctttatgtacacacattgaaacctgcagaaggatggtttcttttctttgtgctgctgttgttcaaaactgctataagaatctacaggtccctttttgggtccatggtagattatggtttaacactcatttaatcttagcaggaactaagattaggattggggaaaaatgaacaaagaaatctctcaccaaacaattcctatatatgcaccaatgtccagctcaaatctcccttcctctgcaaaaagttccctaatcccttccatgtcacatctcttggcaagtttttgatacctcccttaaggcagtatttactgttatcagtaaatactcccttctgctagacaaggagtttaactaatggaactggagttatttttgcttttgttattgatatgtaaaacaatggctaccaaaggatttatatatatggtggaaagaagtacaagaaaagtcattaacttgaaaaagggatttacgttataagtaaaagactggactttgatattctagtacattttaccagtgatactatttttccaaacatttctcaaaaatttaataatcacatgaaacatactcagttattttttttattatactttaagtcctagggtacatgtgcacaacgtgcaggtttgttacatatgtatacatgtgccatgttggtgtgctgcaccgattaactcgtcatttgcattaggtatatctcctaatgctatccctcccccctcccccgaccccacgacaggcccctgtgtgtgatgttccccttcctgtgtccatgtgttctcattgttcaattcccacctatgagaacatgtggtgtttggttttttgtccttgtggtagtttgctgtgaatgatggttttcagcttcatccatgtccctatgaaggacatgaactcatccttttttatggctgcatagtattccgtggtgtatatgtgccacattttcttaatccagtctatcattgatggatatttgggttggttccaagtctttgctagtgcgaatagtgccacaatgaacatacgtgtgcatgtgtctttataacagcatgatttatagtcctttgagtatatgcccagtagtgggatggctgggtcaaatggtatttctagttctagacccttgaggaatcgccacactgtcttccacaatggttgaactagtttacagtcccaccaacagtgtaaaagtgttcctatttcttcacatcctctccagcacctgttgtttcctgactttttaatgattgccattctaactgttgtgagatggtatctcattgtggttttgatttgcatttctccgatggccagtgatgatgagcactttttcatgtgtctgttggctgcataaatgtcttcttttgagaagtgtctgttcatatcctttgcccactttttgatggggttgtttgtttttttcttgtaaatttctttgagttctttgtagattctggatgttagccctttgtcagaggagtaggttgcaaatttttttcccattctgtaggttgcctgttcactgtgatggtagtttcttttgctctgcagaagctctttagtttaattagatcccatttgtcaattttggcttttgttgccattgcttttggtgttttagacatgaagtccttgcccgtgcctatgtcctgaatgatattgcctaggttttcttccagggtttttatggttttaggtctaacatttaagtcttaaatccatcttgaattaatttttatataaggtgtaagaaagggatccagtttcagctttctacatatggctagccagttttcccagcaccatttattaaatagggaatcctttccccatttcttgtttttgtcaggtttgtcaaagatcagatggttgtagatgtgtggtattatttctgagggctccgttctgttccattggtctatatctctgttttggtaccagtaccatgctgttttggttactgtagcctcgtagtatagtttgaagtcaggtagcgtgatgcctccagctttgttcttttggcttaggattgtcttggcaatgtgggctcttttttggttccatgtgaactttaaagtagttttttccaattctatgaagaaagccctttgacaaaattcaacagcccttcatgctaaaaactctcaacaaattaggtattgatgggacatatttcaaaataataagagctatttatgacaaacccacagccaatatcatactgaatgggcaaaaactagaagcattccctttgaaaactggcacaagacagggatgccctctctcaccactcctattcaacatagtgttggaagttctggccagggcaatcaggcagaagaaagaaataaagggtattcagttaggaaaagaggaagtcaaattgtccctgtttgcagatgacatgattgtatatctagaaaaccccaccatctcagcccaaaatctcctttagctgataagcaatttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatggataggaagaatcaatatcgtgagaatggccatactgcccaaggtaacttatagattcaatgccatccccatcaagctaccagtgactttcttcccagaaacatactcagttattaaatgtatttaactatcagttattgctaagatggaattaaagtcagttcttaatttttcaaaaaaaaatgaaccccaggatgaattcattcatttcattcatttaccaaactgaattctccaaatgtttattttataccctgaaatcagttcctcttcctgaatttcctatcccagttaatggcactgccatatgggcaacatagtgagaccatgtctctgtaaaaaaaaattaaaaattagccaggcatggtggtacattcctgtagtcccagctatttgggaggctgaggcgggaggatcgcttgagcccaagagttgtaggctgcagtgaactatcattgcactgcctcactccagagcaagaccctgtgtcaacaaaaaaaaaaaaaaagaaaaaaaaagaaattaattcagtgatgagttagtgtcttggacaggactgaccttggcttagtcattgtatcctgaatctattgatgtgcctcaaggttataataattataatggccacattgggttctttctacccaccaagggcagtgataaaagtttcccccttctcccatccagtcttcatcatgagcttttgaaatgtaggtatgattgagagtgaggagtatagggccgactccttgggctggaatcagacctctttcaccacttaccagctgtgtcacttagacatgttttccggccccctgtaccttagtatactcatctataaaacagataatagtatctcattctgaggattgataggaatattaatatactcttttttttttcttttttgagacggagtctcgctctgttgcccaggctggagtgcagtggcgcaccttggctcactgcaagctccatctcccaggttcacaccactctcttgcctcagcctcccgagtagctgggactacaggcgcctgccaccacgcctggctaatttttaaaatatttttagtagagagggggtttcaccgtattagccaggatggtctctatctcctgacctcgtgatccgcccgccttggactcccaaagtgctgggattacaggaaaatattgatatactcttgaaccctgtgcctcgtgttagctgttagagtcattatcctcattttgcagtcaaggcatctgagcctcagaggttaaataacctgccccatttctcacacagtcagtataaatcagagccaacgttttggaaccatctgtctgactgcaaggccttgtatatgggatatatccttattgaacagaatgggaattcacaattacatgttttcaaatttcttagcatagaaatttgccttacgtacatatgttcttcctgggtgatcttgtccattccaagggcttcatttgccatctaatttagggttggcaaactatgacctgcaagctgaatacattctggcacctatttttgtaaataaagttttattggaacacaggcacactcgtcctttagctactgttgatggctgctttcgtgcaatagtgtcagaggtgagtagatgtgagagatcctatggcctgcaaagcctaaaatgtttactctctggccctttacagaaagcattcgcataccctgatcttgctcactactttcaacctttctcataagatcttgattcctaaatttagccacccaccaaatttcttcatgccccatatctaccttaaaattaacattttccaacctgatttcttcaaatgtccatttcccaccctgaaatcagttcctcttcctgactttcctatcccagttaatgacaccaccatatgcccaaggtgtatctcccctttttattgctcatgcctgatgtcttcaaaagggctgttcattgattatcctaaatacatacactttttgaagacagtaacctaggcttttaagtaaccaatgctgatcattctagtattctcagtccccatgtgcgattagaccagaaattcctttgacagtctgtcagaagttgctttaaggtatattcagtgagaaataactatggtctgtctctgtcaagtaagccatggaaatatgaatccatttctcgactttagatactgtttcacaagtaagaattaaagaatgctagaaagtcagaatattgtaaaatgtgtagccattactcaaatatatggaaaagaacacaggtttatgacttattgagttgtcacttcaaagttattcgtcattaatgttttaaaattaaatctctattctttattcagggcctcattggctggcagggtaagaagttaaaattctaacatcagattatcattttttcttgttcatccaaataatatattcagataatacattcatgttcattcttatcaatatcacttgaatattattccaaagcttatgatattattaactctgcattctcttttatgaatttacaattacaattatgctataataactgatgaagagcacagaagagcattgtaaaaataaataaactttgaaatacgaaaggattagtggggataataaatatccgctcattgtcttatcatctttgatcttggcatttgttctatccagcaaatattttcatagtactttaatttcagtttctttatctgaaaaattatgcaggagcagcctttgttttccaagaacaacagagatgtttatagcatttaagtcaaaagcagagataataaattaattctaatcctctgagcaaagacattagcttttgtgtagcacagggatttgggtttgttcacacaaaataatcccaagaataatagttcccggtgctcacaattgatcttaaagattaatatatttctgtggttaatgattatgtaatatattaataagcttctccaaatacttcctgaaattttaattatctgtagacttttaaagctatattttgatcagacatgtaaagaagcagtgtagctcaatcactgtcaaattaaggatgattttacattctgctttagagaaaaatgccacccaccatcagtctgcaaaatagctgaaatacttagaagaaaaaaagtaagtagttaaggatgtctcaatgccgtttttgtcaactagcctcatgcagtggtgggggctactgaacttacaatttcactctgccttctgctgggagtgcaggtgcccttggctggcctcccacctaagctagaggtggcacttaaagtctcgacacagagtatcacataaaaatcactttcaagtctttaaataggttttagctatgaaaatgaaaatttggaaactactttcttcaacaatgaggacgtgactaaggatataaaaatatttaatagtttatagtcttttttttttttttttgagatggagtctcgctctgtcgcccgggctggagtgcagtggcatgatatcggctcaccgcaagctccgcctcccgggttcacgccattctcctgcctcagcctcccgagtagctgggactacaggcgcccaccaccacgcccggctaattttttgtatttttagtagagacggggtttcaccgtgttagccaggacggtctcgatctcctgacctcgtgatccgcccacctcagcctcccaaagtgctgggattacaggtgtgagccaccgcgcccggccaatagtttatagtctttaaaatgatttatgcaggctgttttgaaacatagaaatgcattttttacgtaactgaaaatggcacatgacactgtatttgctgatggcaacttgctaaatatttacataaaatcaaagatcaaaggaaacatcagagtacaatagagtttaatgttcattgttttctctgttttctataaagttgtttaactttacaaaaattgttatgacctgtttgtcttaagaatgtaaaaaccctccttttctcatcattctaatgagaaaggatgttcagtcgtcctaatgactgaatttttggaatgaagtctttttataaattaggtctcttctgatgtttttctttttctgggttgccaaaatcttatatatgtgcaataagccaaaaaaggtgggaagatgaacagaagatttagatttctaattaatcgaacacaaatagagaaatacctaagtagatgtgccattctatagaaatttatgtgacagtttggggctgatggtttcaaaaatcttaagtcgtttttaaagggcacctgcctgtgattcatataaattaggacttctctgttctcatttttctatttcctcttatcacatctaacagggacactaatccagtagtgctcattttacataagagcagagccttcaggcttaacttgggcatgtgatagagctggcatcacgtcatccagcccagcactcagtatcagagacagcttacagatggatggagaaaaacccactgcataagaaataattctgcattcattaagaggcatatatatgtataagctttatctcaagaaaagtaaaatgtaagacaaacgtaaagtcaccatcctgtagagaaagagagtgatagaagaatatgggcaactcaaattcactttggccaccttctctacttgttcaattctgtaagactgatgattctgggaggctgaaggcagtgagtttgtgtttcctttggaatgagcacatgttctactggcttctgccagctcatgcagcaggaatgtgaggatgcgattgcggagttgactcaccagctgatggactcaagcacctacttctctcctttcattgcctcagtgggtttctctacattatctcactgggtttacttgtctttctgttttcctatctggaaggaatccaaatgccttaaatccaaatgtatttaccgcacatgaattaacttatagacaaatacagatagaaaggactgtgagtaccattttttttttatttcaggactaagctttggtctctcccatgtcttatggcattttatgacagctacacttatgaaggggtaactttatactaaaattgtggcttgagaactgcaacatggtgctggaacctcagatctctgtgattttagatgcgtaaaactcaaaactgaatttcaaagagggtcttctccagccaccttcttaccactcttcctgtgaatgtttaaatctaagtttgctttattagataaattctgacatttgggtatatgaatgaggtagactaatttatgtgattaaattctcattcatttaataagaggattaaatgcttcattgcaaaatgctgaaggatatttttaatttacagtctcaattttaattgcaacactatcattctgttttgagcatcgaggaatagcaatgaaacgtgtttaagttataaagtaatgattatgttgaattaattttaaggcagttttccctagttttgtttttataggaaaaatatttacaagttaatttttgtttttatccatatataaaatgaaaatagtacattaaacatgccatcctgtgtcaaatggggcagactcggggagagaccaggagagcagggagggaccttctccatccccagtcccagcgtggggtttgttgtatggtaggtactcagtaaatatttactgaatctccaaatgtatgattaactactgggagtcagcagtctagactggagtaccagccctgttagtcctcagtaatatcactgaacctctcagtctcagtttccccatttgtaaagcaggcatggcaatgtttcctgtcgttttaatggaagactgtgagaattaaagggaaaacgtggcacattttagaaaactggaaaatggtgatataaggaatcctttctagcattattattttgctatgtgctgcttattagtgcccagtgtttgttagtattagcatccagttagcattcaacgaatgcatatttaaaataagctaatgcactcacagtaaaattgaggacacattagcaatttatcatacattatttgacttagcattttttaaaccctatatttatttaggtataattgtaattcctttatgtgcttagtttacttttgcattttcataggtggacattgaaaaacatatatagacaactaaatcattatttttctgcagcattgtacattaatagctttttgtgtacatgtgaataggagttggcaaaagaatgtagcacataatataaaggtttaagatgtaagtaaatgagaagctggcttattgctgtcacttctttggaaattagattagggcatatatcacattaaattcacttttagatatgttgtgaagctaatgacagggctttgttgaagtgagggtttgtgggttttgatgaagaaaatctatcggtatatgccttatcttttattctctcttcttgctcaatgtgtaattaggtttgctctgcaggatcacagtatagagcatatattaattttatattcaccctgcctgtaatgattgtatgctagcacttctaagtgacaccaaaaatgcattaataaagtcataatcgttagccagaatcacaagtattgtagtcctaaattttgctttattttctctgtatgtccttaattgatgatgtattaatgattgaacccatttgagtttatttgtactgtatattatatattgcagtgaaacactgggccgcaaagacttatgaaatataagacaaaactttgtccaggcagggagatgggacacaatctcacaacagcttttaagatcatctaataaatgtatgtacatttatatatacgaatgatgctagcgtcgttgatgtaaatcataataatgacaaccaccctgaatttcccaagttctgagaaaaactgaaagataagataaaatcattgtcagataaggctcaaacatcacccttattatctgtaaaggccaggctgcagggcatggtttatttgttctcctaatatggaacccaggaattaagcacaggtcacagcggctggggcaggcctctctgggcccagagaatcaactcaaattatttgctggaggatcagaggagaattcatattcatggatggtagccctactccctgcagagagaaggcaagagctgagtccaggagatgcttccccaaattgcccattagacatgtatgtcactcaacctccccttgggtagagtaaatgaagagatggaaagagaggtattatatgctagaaatgtgtagggaaaaaagcattctcccccaatataagacaggtaatataatatttgatgtcaagtgaactgggcagaatctaagagcagaaggaaaagaacaagccttgctaaaaaggacagtcaggacttagagctaagtggtcaggggagaagggggaagaacattccagtcatgaatggtatcagcaaaggcacaagcagggatgaggagtttgtgttggaaagaagtcaaggctggtgaatcaggttacagagggctggaaagttctaaccacaggaactagggagttccttacccaaggagctttcggaaatggtgcatttgagtacttccttgtgaacatgtgtaggagaggtttacttttttctttatcctagaacactgaactctaacaatggttttcatatatttgcatgattctctctatagtttatcttggctaattacatttaactatgggctctccaattatatgttgaactcaatgactaatcatcagatttcgatagcaaagagcctataatttcctgagtgtatgacctatgtaaggatatgttgcagagagaagctgtttcctttaccatagtaaaaatttgtttgtggttacattagaagctacctctaaaagacatttagctctgagatagtttttaaaattgaagtttgtagtgtgtgtccatctgagtggaccctatggaatcctgcttaccaggtcatgcccagatgcatgagacaagagccttttgattttaaaggcttctgtttctgtttaagtgattattgtatacattcctccaaaataaagacttttctcaaaagaagacatacatgcagtcaacaaacatatgaaaaaaagctcaaaatcactgatcattagagaaatgcaaatcaaaaccacaatgagataccatctcacatcagtcagaatggctgttattaaaaagtcaaaaaacagatgctggcgaagttatagagaaaaaggaatgcttttccactgttggtgggatggtaaattagttcaaccattgtagaagacaatgtgttgatccctcaaagacctagaggcagaaatacatttaacccagcaaccccattactgggtatatacccaaagaaaagtaaattgttctattataaaaatacatgcacacatatgttcattgcggtactattcgcaatagcaaagacatggaatcaacctaaatgcccatcagtgatagactgggtacagaaaatatggtacatatgcaccatagaatactgtgcagccataaaaatgaatgaaaacatgtcttttgcagggacagggatggagcaggaaaccattaccctcaggaaactaatacaggaagaaaaaaccaaataccaagtgttctcatttataagtgtgagctgaataataagaacacatggatacatggggggaacagcctatactgggacctgccggagggttggggggtaggaggagggagagcatcacgaagaataactaatggatgctgggcttaatacctaggtgatggtatgatctgtgcagcaagccaccatggcacacgtttacctgtgtaataaacctgcacatcctgcacatgtatccctgaacttaaaataaaaattggaaatttaaaaaaaagaccttagaaacggggcttccaagagtggtcacaatcaattacaggattactacatagattttcttattccgtgcattaaattatgtttgcccaaaaacaatgttactaaaaagaaaaacattttaatatgaaactttgctataggtctgtcctgtacccataaagcaattgttaactctttgctgaatgctttgggtatcaaatggtgataagagaagggggaaagggcacatcagctgcctttcctatcattgaggagtttgaaatttcactggggagatgtgacaagtattcacatcataggtggtaaaaactaaacagtttatggataaacaccaggatgcctgcttttagtcatccaatgcttcatttattcagaaggcttgctaaacagtttgcaaagcattagagatgcattcttttgcctgatacactgtcaaatattactgccttgcacagaggtcattggattcactctggaactgatatcctctccaagaccaaaagcttggtaagtttttaggattctcttcttggctgtcattttatcatctgtaaaatgagggctttggaaccaaatgaatgtcttagttccttcccggctctaatatttaccgacttaagagtatccctgatgacacagagaaaaagaggagagaatcaggataatgtaagacaaaaggaaagttgtgaggtcgagttatgctgttacacgcccaatgctgaagcaataggatggttcagagtaaatgggcctgacatgagagatccttatctgtcaagttttctttcagatactataaacattacaggctgcagtatttttcttttttattaatgcagaaggtctattttattttgtctgtgtggatgtttgcttatgaaagaattggcttgttttaacagaaatccttttagtttgggatgggttgaatgaaccactcttttttaaagaaacaacttattgagatatagtatctttcacatactgtacaattcacctatttaaagtatacagttcagtggctttcagtatatccagctgtgtaaccatcaccacaatcaattttagaacattctcataactccagaaggaaacccctcacccctaggctgtcaccccacctccaatttccccatctcaccctccttccagctctaggcaactactgatctactttctgtctctagtgagctgctctttaatgaaggagacagtcagtggacatcagagactaagcaccatagtgcagctttatccagacacatctatttaatggttggagctgttagagtttgcagtagctgatggcaaaatctagtttctaagtgatattgaccagaagaatgaatgtcatcaaaaataacaacctgaaaatagccacaaattcagtgcttaggagagtactcttcagccattatcagtggagtgcttcagtcacttgcagtcagcctgacatactctacctcattacatgagacatgtttaacaaaataaaaaatcatgatacatttcttatagttgttatatttttatggcactggtgtatggttcacccagcgaaatcccactttggacattctgtgtgtggtgactttgctaggagatgttgaatggctctgctttcaaggagcagcataggagtggatgataggtatgcataaacaagcaagtgcaaaatagcagcaaaatactccaggtgcagcatagggggcacttacaaggacagccagttatgcccggggagactggtggggaggggggtgccagaaacagctcatggagaaggtggagctgcagataagcaatggaacactagtcatgcttagggaatgtgagaagcaaatttaggtagagggaccagtgtgttcaaatgcactgacataggaaacatcctagagcctttggatgtgagcagataagacagtagggtggttacaggagaggttgtgaggaggattctgaggctgtgcatcagtgtgtgaaaggggctatgtgagatctctaaggagttggacttgacccactgttttaatttcttgtggctgctgtaacaaagcaagcaaattgggtggcttagaacagtagaaatgtattctctcccagttctggatgccaaaagtccaaaatcaagatgtcaacaggaccatgttccctctgaagcctgcaggggatggatgtttccttgcttcttcctgcatctggtagcctcaggcattccttggcttgtggcagcaaaattccagcctttgcctatggcttcagatggcatttcccctgtgtctcttcacatctgcttccctctaggcacatctgtttctgtatccaaatttccaccttttatgtaaggacatcaatcctaatgggttagggcttaccctaatgacctcattttaacttgattacctctgtaaagaccctatttccaaatgaagtcacgttctgaggtactgggagttaggactttaacatttttaggggacaaaattcaacccattactgcccccaggcattcagatgttactgcagggaagtcaagtgttaatatttgcattttagaaagtcacttggagagttgtgtggaggatgaatgcaaaaggggcaagagtagttgggaacctcttggccttgaccgttcaagaagccttgtgggctgtttactttatccttcacactccagattcttcaagtttaaaaagaagaagaaaaagaaatctgcacatccacagcaaaactagaaagtcagggagaactaccatcagtggagaaggatatttaagaattcccagaaggtactaaaagaaatgaattgattggtagtgaaatccagaagaacaaaggattatattcccttttaccattacatactgtatattaataaaactttggttttaggtcagtaaggagcaggagaataaaatgaaaatgtgcatgccctttcactcagcaactccatgtctaggaatcctatctatactcactcatgtgctgagatatatatgcaggactaatcattgtaatgtcatttgtaattgaggaaaaccaaaaataatctaaatatccgttggcacagaatgcccaattatagtataaccacaccattcattgaatgttctatagttactcaaaggaatgagataaccctatatgtactgacatggaacattctctaacacacagtaaatgaacacaatgaaactgttgaacagtgactagtatagggtactatatatgtaacaaagaaagaaagactctttcgatttttgtatctttccagacctttttaaagtattgtactgaactctaacagtgcttacctgtgggattagggaatatagtgaaaaggaatattcttttttaaaacataatactctatatcctgtgtgttctgtgaactttttcagtaagcatgcagtataccaaaactggacatttactaaaacatttaaggagacagaatccatgagacttgagacttcaccagtgggcgaatgtggtgaacagtggggtggtaaagaggggaaagtagaggaggggtggaagggatgggatagggatagcatgaattcaaaacactcagaagcaaaagggcaacattttaaagggaactattaaaaaataaaaaagacagaaagtatgtattttattgtaaaaggggtctaggagtgttagtttgagaaataggaggatttatgcatcttcaactatgattggtggagcccatcagcataagaatggagaaacagtgccgtgagatgagagccagttgcagaaattaatgtcattcccagaatctcttctgctaaagagtgtatacagccaccaaaacagccaccaatgacttatccctagtgatccacaaattacatacaaagtaacacctcagggataggtacttatctctgaaatgggagggaaaagtctttaccccttctcttcattaacacctttacttgttcctgtctgtgttttcccatctccgcttgactctcctgttcctccttcccttcctcacccccctttctcttttacacacacatacacctacccaccccgtgatacaaatctactagcctgaacaaaaagttaaagaaagggaactcatagaagaaaatgacgtccaaatcagataagcacctccaaatgataaagaggaaaaagattttctgccaaaattatcatgtgaaaattgtcatggcctacttattttatcagaaaaaaagtgtgttaaaggtaatgttaacatagcagaaagcttgaaaaacaagtgacaaccatatttccaaatcagcttttatatgcctagtgttttgcagttagtgatcaaatgctttcacagcattatctcgtttgagcctcacactgaccctttgaggtaatgcttccatgtctttatggaaggggacactgagtcccagaaatgggcaagagccttgactggtgaggcatagactctgttttctatgacactctgatgcctgcatggcctcagcagagtatagttggtaccccatggatttgtctctcgagctaaacctttcagacttcatcttcccaaatcttgttctgtcacctgccttaatcttgaagaatcacagaagttagcaaagtatactaatctatgtcatttatttataaagcagagtggtcatttgaacaacaagaagtttggtagataaaggggataagattgcaccctttgggggaccaccaacaatagcttacaaagtaaaaatgcagaatttaatttcagagatagtgttacttcctcattcatggtactacttgtggatattatggtgagccgtgagcaatggagaaagagccaaagaaatgagattttgatcccagccagactctgaggtatttcctggtacctggcctacaaatattggcaatagttgttcataagaagaattagctattaattatttcactaattcgtagcatgcaatcctgaggttctccatctgaaggggagaaaatggagaaattattactaaatgtactacctaaaagaggtagaagtataaccaagaagtcattcagtgatatgtttactttttaaaagtttccagacataacactgcacaactgcagctttcctccgcaaagtcatcaaagagctaaaatgtacaaatgggaatagggatataaagtggaactgaagataaatggagagccacagcagcccccgcaatacttccctggtgttggttcctcctgggaccataatctgggctgacatcttctctccttccagcatctctttcaaataacatgaagatctggtaaatggccagtcaagcctctggctgctcattctggtaggtctgaggttagtttggctataatatatctttcttattttgtccctctattgtggttttgtatagattttcttgcctgtactacttcttaactaaaggatagttaccatggcaacacctgttgatgacagacaaaaaaaaaaatgtgattccacagggtggaggctgctcctatatttcttgctcctcgctctcacagttaagattcaaggggtgtttttgtttctccttctttcttcttctgtgggtgacactagttttctccattttggcagatcgatgtggaaactgctgtctgctgcttcagttttccatgcaaagatgcggccatgttaccctcgcgagcatttgttgtcatgatttttaccaactgtaatagacatcgtgcttttgtacaagggagtttacaatctttcacgtctgttttttccttctcctttcctctctttttccttcttctctttcctcttctacccttatttgatcaaccaggtgagcccatattccttctttgactagatagccaaaggtctgcagtagtaaagtccaaatttcacatctcatttaaaatgccattagtctggatatcaaaacaattaataaagtaaaacatggggtatacataataccaatttgttctataaacaaatcagtttgaaagaaatatattctagatagtaaataaatggaagagccttaaaaaataataatgtactgaagaacagtcgtatatgataactggttaatctcttcttatacatatgtagctatatcataaatattccacatttaagcaagcattttgatatgcctcatcgggacatggcattgcagaagaatctttggatgagggtttttgttgtttttttttaaggcaccagttctaacaccaaatcacctgattaggggaagaagcacaggtagcgtaggtgaaatggctaagccaccacaatggaggtggaggtgaaggtaatgaaaagtggcctgggttatgtttgtggctcagacctcagatagccgtgtgattacagccagggctcagtttccttgccactaaatttagagactgaacagaaatatcatggagtttgtttctaattctaaagtatattaatataactctgaaatatacataagtactaaacaatagaacagaaacatcattatacactaagggctgaaaaaatgtacatagagaaacagggtggactcataagcatgaattttgagtgacttttcaaagacatgaattaaccaagaggggagtctaagaaaataagtgatgtagcatatcagtcttaagatactgtgtcccagtaaagcaaaaaaattccctaggaattttggttgatataaattcttacagagctctttaaaatttttcctcacaattaaaataattattgaaagctgtttcattaagtatgctgcatattttttggtcattcatctctcaagctatcactggaaaaaatacaattgaaaatgcagattccctctttgaaattgtataatgaattgcgtgaacctacctgttattttgatgttcatttgaagttatataattaagaaataactccatatagcagatggattgatgtgtaaacctcttgatatgaggtatgtaaagtaatgagaattaccttccttaccctaatctctgtgtctttaagtcaggactggaatattaggtaacttgaccatcttttcatgcactgaccctgtattctagggctgccataacaaagttccatgaactgagtggtttaaacatccagaattgattgtctcaccattctggaggctgcaagtctgagatcccagcgtcggcagggccgtgttccctctgatggctctaggcaaggatctgttccaggtctgtctcttagttgcttgcagttccttgccttatggcagcataccttcaggcttcacatgagattctccctgtgtgggtgtccctgtgtccaaatccccccattttataaatataccaatcacattatatgggggcccatcctactctagtgtgacctcatcttaactacttatggtatatctgtgatatgctatttccaagtaaggtcacattctgcagtcctggaggttaggacttagagacatgaattttgggggacataaatcaaacctaacaggctcagaaaagcgtcacataggcacatgcacacacacacacagagtataagattctctaattgtggccaccctgtgaacatggactcttattagagtccatcatgatacttgtagttcttctaaacaccatattttaccaatcatactgtagctaacatttactgggcacttaactattgcaaaactcttgttagggtgtttaaacatacattagttcatgtgtcatttcccttcaagtgaatctccttgactatctctgtgatagtgagcattacatctcactgaatgtctcagaatttctctaaagttccatgtagatcatttagtagttactttccttcagagaaactaaatgtcatacatatgttagcatctcttaaaaccaccctaagtcatgcgagagtgtacacacgggcacattatcaatggcagagttctgttgtggtatctgcaagcagcattgaaagtctaagattgaagtggtcaaatgtgtgtgtgttctctctcataacacacacacatacatatatatgtactcattacatatatagagtgtgaaggagcaaggaagacacttcaaactactttatcccatatggtccatctgtaaaatgccaacctaccaacccccagttcacacacggccctgcatacccctctgaaactcaggcattttacggacaacaatctttcaaaatgtggaagctgccaggcgaataaccagagcttaaatgtctctctcttgaccccacaggcagagccattgcctcaggtcaacacaaacagcccagccagttttgcagaaccccaagaacggaggccagggtcctttctgtggctgggaagttaccccgtggctgggacttttcatagcagaggaacttcacagcagatttttgtgaatgtttggcatctcaaacacatacctgggcagacttcaagttagttactgaccccacaactttctcggcttcctggggaaagggaagtctttcttgcctgcccctccccgccgacatgcatacccattcacacaacttctgctggggcagcaaccctccaaccccataaccccttgagtgatccccagattagataacttagaagtcagagaactgtttctcatcaggaaatgcctgaggcagacctgaggctttgtgagagacaacccggtgttccaggtggctacccagttagctgcccatgatgcacaatggcaggatagggcatgtgcattaggccaagacaatcaaagctctataaatgacagctaaagtcccagtccaaaagaaagttcctaaatgtgcagagtggaaaggactggaataatatttactttttgttcattgtattcataagcaaggaaataacattgagaggtgaataaagaaaatgaacaaatgactgaatgaatatcctctgtagttgtgctggctattatctcatgcttatttacattgcctaaaagaagatgttttaaattctgtattttactatcaatttataagctaataattagaggagtcaatttatatgtcttctattcactaaagcaacatttaagtactgaatctaatcttactttgtattcagatgcctgagaagcatgctatagagcttctcttaaacacatcgtgctgcacattataaactattctattctgtgccaacaagaaagatttcttttcctgttttgaacacttcggtcatttgattacttctctgctgatattgaaactgcaaggaattcatatccaagccacacttgggatggatgcatacggataaggcttatactaaattatggcattttaagcctctttccaggtagcatgcttagaaatagaagatttttgctagtaaaatgtcattttaaaaaaatcaatgtatgtattataactgtatctgtcttacctgagtcctgtatgttgtagatagtataaggatacatcgttaaggatttttatcttcagcttcctagaattcaagaaaattatggtcctcttggaaaggagattacagagttttcattaaaccacaccactgaagaggatttgcagaaagaactatttttccggtgtcatacttataatctttttgatgcctaaagaaatctgattattattatattttgccttcatcttatcttcacagtggcctcttttggcagctctgtgaactactctttcttgctgcttccattttttctgtactcaacgaaaaaaaaataaaacccagaaaaccctcttttaatggactgctgctttgcatacatcagggatttcagctgttcgagtgtgtgaaaaatgaaacaggagacatcagatggcatgaagactagaactgttaacacagtaaataccagaaaggctgaaagtgtgagccaaagcagctggggagtggaaaaaacgagaggcacagctgggagaagcagcaagaaaaagcagccccaggaaacatgagggagcttagcagggggagaagagcggctgatgaaaacaagaatccgaggataagggaggcagaagcgttgttagttatgtttttccaatattgcacagtgcatcatagcccatatgcattgtctttggctacctctttaattgctgtgtcattgagcatatttaatacagttttcttgcatgattactatggactgaatattgaaatatcaatgaaatatctgtactttgaggttgatctctgttatattgataatgtactaaacctgtcagggaattcagacaggttaatgagaaatatcatgcattagtttaaggatacatttttttttctaccaaaagtatatcaaattgctaacatttagtatttggacaaataaggaatgtgtgtaattagctgggttaataactggtttggtaggcatatccagagagcactgattaataaattgctctcttcctgaagagaggtttttggtattttaactttatccagtcttagtccacattaggcctcacatgagtaaaactgtataaatgcatgccccaaagttgggagagatagcagatgtaaaaactgatggaaacagaattaggaccatcttgacatttaacacagtgacccaaatctaagaagcagaaatgtcacagggatcagtataaacaccctgctcccccagttaaattgcaaaggaacagtaaggagagatgaagcttagcagcatcatatttcacagaaatttagattttagtcaaatataaatgtatatacacatgtgttaatatgtgtttataactgtgtatatatgcatgtatatatatgttaatacatatatacacatgtgtatatatgtgtgtatgtgtgtcagggtagctgttaaaaaggcttctgtgatctttggccttctaaataatgtgggtggacagaaataagagacctgttccactcttcactgatgaagtgcttcttcacctggagaattgcctttgagcttgatcttttagaagagaacatccagaaaatgacagtgccagcccccagtacatctcctcctgccttccttgttccctcactatttgttcctcttgcatgtgccatcgttgccctccccaaatctgaatttgttctgactaaagcagaaaacactttaaatgtttaaacctaccccacagtccactggagcacatcactaattatactctctctgtgcctcgcccacagtagtatcttgcccaatgccagctgtgtttgtttgctgaatctcccatgttgagatgttattgccccagtgaacactaggatgactatgtcacattccagcgatgttattgtcatgcagatgtaggctctggtatcctaagatgattctcaggctcccataatccttactccttggccttccaagtttcagctgtttctgtgtctgtgtaaccaagcgtctgggactgaagatcctctttgggtctcatagtctgtgttggtcttgccaggtgatcttcttgagaactgtggctcttactctgagtagctgctcagtggctagattctgttgctgtgactagacctccaggatggtaatggacgaccctcctgacttcaccaacctatttactctttgctgatagctttgcctccctgcgatagctgggccccaaaaatccccacccaccgccaccaccgacacccaaataagggttatttcctaaatcaggtcgatgttgccttgttccttggaggttgtgcttggttgttgggctcccctcccaggttgggctttgtagctgcagcaggctcttctactctgctcttgtgagcagacctggccagggacccgctcccttctcctggcagcctttgtgttcttttgagttatggcaggtggtacatgaaatcgtattctttggaatagagaaggaaagctcaagagcaggggaagaggaacttctttaaataggtgtcttccagtatctgaagggttgccatgtcagggaactattggacttgctctgcatggccctagaccttaaaaccacgactcaaacaaggttgaagccactaagcctctggagcacagaagaacctttcttactcctagctcaaatttaacaacacttctcagagacagaaagggattccttgggatggaggaagccctttattgtggcagggaattcagcataggtagattagcaggtctaagttttgtttattggtttatttccattgcaacatagataaagtattgtatttactggaatgatgtttgcatgtgggaaatattgctgcagcagtatgccagtcatgagcagccggtaatcctactctcttctctgtcttcagggactgtgagtgagagaggttttattatagcaacatccttgagcctactctgatttttttaaaatgaattcactcaatcagtgaataaatattgagcaattactatattccaagcactgtgattcattccatgctcagtacgttgaactgttctatttaaccaagtccttttgacatggcagttatcgatgagatgtcacagacattgtagaaaggattcaagtatcaagtggggttgatttatggatgacctttaagtttcttttaaatttgagaatctgtaattgagtttcatgattctggtctcatactgagtagttatcttgcctccaggtacagtttttaaaagtcagacatgaatttggagtagattgctgaagtctattctcctcaatccctgtatttgtctacccagatagcagggagatacactctcaacatcattactccttccccagaagagactgttaggatataacctcgagaaaacactcctttccttagaccctcctcagcactgccagcgggggctcagcccaggccatctgtcaggtgcccatctcatccctcagggtttcagtgtcccagaatggagctctgtttcagttctgctgggtggctttagccagaacaagagttcaggttagtttggtaaaaacacatcctgaactggagttcacttgcttgggccttcttatgaatgtcatcattagtattaagaagtcaccaaccgtcctcatgaaaactgtcagagagccagatgtaacagaaactgctgggcgtggcattccatggacaggatatgtgggtttcagggagaggtcatgtttgactaaatcgtcagtatcagaagtcctaaaattccattcggtggaaaaagaaatcaatattgaaggtatgggatttctgtttgattgggtcaataatcatttgcagtgattaaccttattatctctataccctgataacctaattatctctatcacctttggaaataatcagcaagatgaaaggagacctgaagaagtgtttggtctatcagaattatactcaagttgtcccagtcagggcatgatagtttgcaatggagctaggttatctgcttagtgtaacaactcccatgattccagctaaaattgttttggggtttgccatttttttttaagactgatctgaaaaatgactgatgcttacttataacatccaaatccttggaatattatttttcataagagctttatttagatgcaattcacataccatacaagtcatccatttaaagtgcaaccatcaattttaggacattttcatcaccccttctcccctagccctaaggaacacaaatctactttctatctctatgtatttgcctattttggacatttcttataaacaggatcatataatatttttttgtgactggtttctttcacttagcatgttttcaaggttcatccatgttgtaacatgtaccagtattttattctattttatggctgaatactattcttctgtatggatataccacattttgtatatacccattcaccagttgaggggcattgtttctacttctttgggtattacaagtaatgcttctgtgaatatctatgtgcaagtttttgtgtggacgtatagtttcatttcttttgctatatacctgggagtggaattgctgggtcacatggtaactctctgtttaacattctgaggaactaacagactgtttcaaagcagctgcgttattttacattcccatcagcagggcatggggttctgatatctctacatcctcttaacacttgttattagcttagacgtgtttattatggccaagagcaaatcactaggaaggtatgaagtggtatctcattgtggttgatttgcactttgttgatggctacttatgttgtgatgttgagcatcttttcatgtgtttattgattatttgtgtatcttttttggagaagtgtctcttcagatcctttgcccatttttggttgggttgtctttttattattgagttataagagttatttatatattccatatataagtcccttatcacatacgatttgcatatattttctcccattctttgggttgtcttttcattctcttaatattgtcctttaaattacaaatatttttattttaatgaaatctagtttatctgctttttctctagttggcttgtgcttttggggtcacatgcctctgccaaatctgagctcatgaagatttagccctttggttttttttctaatagttttgtagtttacgcttttacatttaggtatttgatccattttgcattaactttttctgcggtctgagttaaggatccaactttattcttttatatatggctgtctagttgttccagaaccatttgttgaaaaagcctgttctttccccgttgaatagtcttggcacccttgccaaaaactcaactggccatataattgaaggaatataaatatatgggtttattcctggatgctaaagtattgatctgtatgtctatccttatgactgcaccacagtgtcttgatgaccttgtttcgttggaatatttttaagtcgcaaaatgtatattttgaaaattcaaaactgtgcaccatttttatattattaaattaactgtcaaatcttgtctccagttttcaagtcaggatcttactcatatctggtgatagagaaagcacatccaaacattatttttaatacacattaatagaatttgacattttttaaaaaattgttagttctttaaattttaccttttaattgcagcaatttgatttagataattaaatcttgctcatatttctggctaattcaggagaattccctggattgaccatgatgacaagaaaaagtggagaggtttatggttggaatccacatctaaatatatctgcatggcaggggttcagaaggaggcttgacttgaagtctaataaaagagtggaacgatggcttgggaactcagttgtctatcaagccctgcacccagcgaagctctgtctcctagttgatgagattgacagcagaaagacctggagtcggcttagaagaagacagcccatgattgtgtgtcttgttctgatctttttaaacttattaaaagaaaataataatgtagctaaatgcagtggcaaacaaaagacagcagtttctcactttctaactgtcagggaaacaatagatatacctcaagataatataaatattctgctgactctgctatcagagaaagcaacacacagtctaagatgataatatgtggttctaacaaaagaacatcagtagatgcaaatctagaaggctcacgttccactccgtttgttatgtcagaaatcaggaattatgcctcagttggttaaaatgattgagaggttctgaatcttagtcaacagccaagatattctccttagagcataaacacagccgttctttcatccgtttgttcgttcgttcattcattcattccgtccctctcccctcctccctttcttactgcacttgtcatggtgtcttatgtaaagtgagtgttcaatatgggagagacttatttgaggatgggaagagaactagagaggaagggggcaggaggaagggctaggcaccaaaaacagcagaacaacaggtaggattggggagctgttgaatcaggagggagagcgagggaagtcgcccatgtagcctctcttttctgaacatcttccccatttccacagcagaatgcgtgaagggacaactcggggctagatctgcatgtcgtccaggtgacactgttcacgctgcaccaaagtctccttctaataagaaattttcagaactgaatcacagcttaccttaccaaaaagtataaatgctcttttcaaataaatcacttgttttatttcaaattcagaaaacagttatttgaattttagtatcactgtagtaacacagaggtttacttggcataaactaggaaaaatatagaaagagcaagtaaattgatttgtatttgattagacacttacgtggcttttttattaaaaatttttgggtggatggggagataggaagttttctttattgaaatttttttatttaattattactgtctatagttgtgcctctacatttcagtttgctttgttcaggaaggaatataagaatataaatctcagtgtttggcataagtacactagcatttttacagtgaactgaacaagtatctttcacagtgtatatccatctgcctttttttctaactttccttctctttggctataggccaagaaagaagagagaactctcaccacaacatttcaaagggaatacattgccagaacttggaatactctactggacaaacatttcctccaaggtaaatattaccattgtaccaataaagggacacatcactagaatttttgaatggcagtggtacagcacaaaggtttaattgtttagtctcatacagacctagagtgacataagagaaagagagagagggagagagagagaagaaagcagtgctgttggggtatcctgcagcctcttctaaatgtgttaccaggagaatgccatcagaatctgggagctcactgagctgtacgaaaaatgtgtgggaaatgaggaggaaagaagaggctggccttttttcttcgtgttacagatactcgtgaacacaaaagccagcggggttcgattatgaaaataacatttcatcctttatgaggaaaaaaatgagtagtttcctttagaggttaaaataaaatatatgctgtattcatgtcacaagagggaaaagcctgaatcataatattttacaccaactgagacaagtatgaaagattttaaggaactccatgttcttctatgaaaatacctgctaagtaagcctttagtaagcctttcattggtttgtgaggaatgcttcatgaagttcttgttttggaaatcatatctttaatgcctcttgtggggaggggtgtgtgtgtgtgtgtgtgtgtgtgagagagagagagagagagaccaaagaaggatctgtcagcatgatactataggtttcagaggagtaactctaggcgctttctttgtgaatcatgagcttagtgggaataaaggcttaacagaagcagctgaattcatagtcagctttggcattcatgaattagctgccaatgttttagcacaaattgctgtgtcatttctatgaagttcccctgtcgctgctcagtctgtagctaaaagctgtcttgttttatctgatgaaacacctccttccttataaagatatttgtgtacccgcacacagaaatgcaaaaacatatgatcccccttaaaagaaaataaacttgtcaactttctctgtttagaagttaatatgatatggttgatactacctagcccttagtgttctggaaggcagtttcagattggccaggggagagtcctgttttcctcctcggtcctcatcctggttattctcttctgaagggcttggggtgagggaaatgtaggctgtacattagaggagaattttgtgatactattcattctctgttctgacagagaggacattgtttgttcactgtaataggcttggcaggaatctgtgctgtgcgtacagaatgggaaaatagcagagcagtgggaaatctcaaaattctaagcagcagatcagcttagagattttgcaaaaatctattttaatagcttctcattactgtagacgtaagtcataatttggagaaacagttttcctttcagtgataattttcttcacattgcattatgcctgtgttacatgaaaaaagtctttaagatgcagtatgcctatccaagtactgtagtaacaagaattaaaatcatgaaagtttagaaatacttgatgaacacactagacctgctttgatattgccctttgtacgtcagcattcacattggtacaaatgaaaattagcctatgtacgtcatctggtggttcacagaagcaagtgtatgctgccaaagataagagaaaaaagacgcatttaaagatgtgcattgaggtaagagatgcactgctagtgagagggagccatgctccaaatgttcagaactttaaaggcaacaactgtaaaagcaaaggctcaaagcagcatgcaaaccgtgaactggaaactgagctggctgtgactgaggcctggcatttctgcttcttgaggctatgtgttcccacttctccctgagcacagagactgcacaatatgatgggccctgatagccccaggtgtctggggaccttgtgtgtgtgcatgtgtgccaggctgctgtgttcacagacagtgtgagctagagagtgggagagcctgccccacacccagcagccccaacagcagctgtgggggaccctcgtctttaggcttaaagagaaatttctcatggctgcccaatcttggcctatattctttttttttttttttttttttttgagacggagtcctgctctgtcgcccaggctggagtgcagtggcgtgatctcagctcactgcaagctccgcctcccatgttcacgccattctcctgcctcagcctgccgagtagctgggactacaggcatccgccaccacgcccagctaattttttgtatttttaatagagacagggtttcaccatgttagccaggatggtctcgatctcctgacttcgtgatccgcctgcctcggcctcccaaagtgctgggattacaggcatgagccaccgcgcccggcctcttggcctatattcttaagaacagctccctggatatttttataaaaactacataatataaattatgagacttttaaaattctatccgtagtagtgtcagtatacagtagagcattggattattgcaaatccctttttatgtagcctgtgtaagggttaatcttatgtaacaaaagcaggtcctttactccaccacttgtgacatgattcacacgtattatctgctttgttgtttttaagtttctcagtcttttaaaatgtatttgttagacaatctttttgatgatgcatttgttcgtctttttaaaaatgtatagaaattggccagctgtggtggctcatgcctaaatttccagcattttgggaggccgaggtgggcagattgcttgagtccaggagttcgagaccagcctgggcaacatggcaaaaccctgtctccacaaaaattaaccaagcatggtggtgcatgcctgtagtcccagctacctgggaggctgaagtgggaggatctcttgatcctgggaggcagaggctgcagtgagctgagatcataccactccactccagtctgagtgacagagcaagaccctgtctcaaaaaaaaaagtatagaaatatatttatatgatgatattttgaagtacatcacaaagatagcaagaaaaaaccaccaaggcttgaataaactccctttattctttccatttggtacatttttttggtctgtttttcaagcagtttttattttattgtttttcacagctgagttaaggattactgagggacgtgaggttgaggcagggccaggttctcctgctccctccagggactccttggaggtgctgcctgcagcagcagaactggcaggtccctggaagacaccttcgtgtgcagggtaattgctggcccatctgtgactcagcagccatgcctcctatcctgcctgcttgttcctttcctgcggaatttccggtaaccactgagacctgatctttagcacacaccagtgacagctgggtctccataccctgtgaccacagttcgccagaaagctgggagagcctgcaggcagctaagttagtgtgggcaccagcctcatgtgtgtcatcatcgtggctcgggggaggatgccctaaagcaaggcgtgcaagggccttgtttcaccaatgctatgtgtcaccatctagtatgaaagaaaatgtttatcggtcgagggaaattggagtaaacacttactgacactcttttattttggggtttttttgttttgtttttctgagacagggccttgctctgttgcccaggctagagtacaacggtgctatctgcgctcactgaaacctctgcttcccaggttcaagcgattctcgtgcctcagcctcctgagtagctgggactataggtgaatgatactattttatttaacaaacactcatattgtacctacagcgaggcaagcactggtctaagcactttgcaagtattaaactttaatctgcctgatcaccctattactattattaacattcctgttttaccaaagaggaaactaaagctcagagagggtaagtgacttgccaaggaagggtagaaacagcattggcatctactccagggtctaggcattagggctccatgcgtctaaacacgggtgtctcctggaccatagcagagcttgcttaactgtcaggcccctttagggtctgtaaacacacacactgcccccacagaggtacacacaccatgttatgttgtcatttttggaactctatccccattgactgatggcatttgctgcagtggaggaagaatttgtcatccctgtccttctagaattcaaagtgggtgcggactaatccctgttacatggtaaacaggattccaggcacctcctcctgtggctgtcagggtgaactgcatcctgtgacatgcctgcagaggaacgcccgagcagcatgtagagaaaggaccagggtactgccctgcccctcctttacagcttcttcactggtgggtcctgggccctttgacataccatggccctgggcacggtggtgtagcacgacctgccagtgtggagagcagccgctctccaggatggacatttgacaattcctccctccccactgccatggggatttagacagttgctcctggaggccttgtcttaacacagaacttcccaaagtggaatctgaggagtttgatgggtgcagctctctctcatttgggcgcccccaaaagagaaaacaaacaaaggtttattcatggttggatatgtttgggagacatgggttcagcaaaattaaattgatttacttattgcaggatttctcagaattttcttgtgactctccaaagcaacatgtagaatgcagaatgtcctacattttatattttctcaggtgggtgaaaatgtctgtcaacatcatttggtcagtgttgtcttaaggagaggtaaaaaaaaaaaagaaatccaccgtcataggaggcaaacagatattgagggaaaatcaataagctacatttggggtctctaaattccagtccctttttaaactgatagctattgggaccttagagcctgaaatttctcatttgtaaaatatggaggatagaactgaattatccctaagcttttttcatccttataagctggtgactgttttgttccagaagagttttaagaataagatacaatacacaacacatcaaatgaaaaattggtgagggtaaaatgaggcacagagaatgtaaggtagaaaagatggaagaaggagggaagttattatgcaaaatacattctgtgaaatccttcatggttaatatgatagaaccaaatttggttctatgctttctaaggaacagtttgaaaagggaactatgaccacagctttgtaattaacagactcctaaactaaaaacaaacattttcctaaaagaaacaactgttcccagtttgaacaaatttttcccatggcttttaactctgtggtatggccctttagtcttttaggtagaaatttcagctctgtggtgggatggcaccaagatttggaacctcagtagatacacttcataggtcttgtggatacatacatttaatatacatcatcctcatttacggaaccattacatgttgtagcccagcccaacttgcgtatatgtggaggtgtttgggtcttgactctggactccggagtattctctccatcctggaggggccgtgtgccaggagcccgggggtgtcagccgctctccagatggcctcctttgtgcatcctcacatcagttctgggtgcacccttctccttcctgcatctctaacttagcattggccgagcctggatcggggtttccaacagccttttcacaaaatcacagcgatgcaaagctgtcccaggggttttgtgttgttcagggtggtaaaggttcaaacctaggttctattttttaagtaattattaataaataaaatgatagcttaaatacgttttagaaaataatactgcttcaggacctcttaatgtaagtgaagctattagtgccagtcagatgagtgaacatgcttatgactcacataaacactgcaagcccccatgggggctttaattagtttttataattagtcatttactgttactttatacatagaatggataactgattacagacagtaagcagaagaagcaactgatgttgtgacgattatcatttgcagtcatctggtcaaaattcttacagacttttcatggtgtagataatgttttatttcctaaactgggtgtgtatttcctaaacctgtgtttattgcattattcttttaatcttaaatatcttaatgtatttgtggagttttatattagtctattaggacatttatatggtataaaattcaatgttgataaaagaaaaagtaatgataatcatatgtaatttgaccttgatttattagaaataaatatcactcataccctctgtctttccctctctctccctttttttctctctctttctctctctctctctccttacattgttcctgataagctgacaacagagtcaaatgaaacacaaatatatatatatatactgcagagaaatgcatacaaacagcagcctaaagctttatcttgtctcattattttataattaaacacaaaaattattgcaggttgattatttttgtccaaaatgcaagattaccaaatattcatgaatgaaaacttttatctctttatctatcatgacatattaattgtagcttgaaatttatataattggtcccaaaaccaagtatatgcccatttgtcatttcaaaaatttgtcatttcaaaaatttcaaaaacaagtcatgcatttcattacatgatgaatttaaagtagactaagtagcacatcactgttaaataagaaaaaagtcaaactagaattagtaaaatttgtatttaaatgaacttgttaatgtaacctttaataataattaacttaaaatcaagtaattttacttaaggcacttcttatgtgccataaaattttaaaataattaaaatatcttccatggaggtttgcaaaagtttatgcaagtcaaaaaacatgaaatctttaaagaagccaggaaaagatattaaaataattatttgtatccaatttaaagagaaccttgctgttcttgagtagattactggtaattggataatatgaggtctggtcagttgcagaagggagattaaaggccaatggggtagtcagctgatttgaagaacatgttataaagcagttcttgctgtgctttgccctgtccacatcatagaaaaatctcctataatttcctgtcccagctctcagtgaaaatcagggatcacctcttcaaatgaatactaatcttaaatatgttaaacaaatccctatactgttttttatgttctctttttattgaagatatacatagatattcatactattttgaaatgccaattataaattagtacaattttcccaataatatatgggcattattgtgaaatgaaataccttttacctttaatatatggatttatggacactattgtgcccatatattatttagaaaaaatatagtaagtaaattttacatctactattacatccaaatgtggctaacaattcagaatgacttagataagcatcgttattttccagcaatattgacattgcttggctgttccaattgttaattttaaaacccaactgttatcagactaactatgatttaataaaactttggtaaatgtctaaaggagcctttcagtaaatatgatctaaggaaaaagaaatatacagaaatgaaataacttttacatttgattaattgaagtaagttgcaacatttttctgaattgcagttagctttcattttcagactttggaagaacaagtcatttgtaccaggaagtacatggtaaagaactatgtttggcaacttagagaacatttttagcatttgaatttccctatttatagtacagcatcaggcatagtaaaatgtttggcatttctataagggatgcaaatgccttaacattcactgttgtgatctaacaattcatttcagagtaagatgaatcagtcttgtttggaaaatgttttacacaaatactggcaaggaaactatcactgcatttctgtggattttaaaatgcagactcctctaaagtaaatggtgacaaattgcacaatgttttttctttcttctgcgttaccatgcttctatgtgaactgacttttattactttaaattctcacactactctactacattccttgctttttagattttgttaatccatgctggaatcagaaactctgtttccaggtccttctaaatgtcgaattctttttaacctaaccttcctttaatccacaatgttttcctcataattgaaaccacagattacttcattaacatctgcccttttcttttacattagagaacgtgagaattgtaatttgtaggattttgcccttaatttgctacatagaaaagaaatacttgtattctccctctttctctctctctatcacacacacacacaaacacagaggcacacacacacacacacacacatgcacacacacacacacttgaagtaatgaaaaatgagcagactaaatgtaatgcagcatcctagatgggatcctggaaccaaaaataaaaggacatagggtgcaaactaaggaaatccaaataataataataatgtaccgatattggtccattaattgtaacacatgtaccatgctgacgtaagttgttaataatagactagaaaaaatacagcaaattcatttataactaacgtattaaaaaccatagttgacttcagcctgttttgtgataagaagaattgaagtatacaaagtgataatgatatctcctgttgtcaatgtcttctactgaacatagtcatctatagcaaaggctggcaaaatccaagtatttggcaaaagctggagaccaaatccagccctgccatctgtttctgtagggcttgaacacacttctgctgttatcttccagatgcccctagcggggcaagaggatgcaggctcagatgatctgggctccattcccagccatttggtgttgtgggcattgtttgacttatttaacctttctggatgtcatttttcgtatctgtgaagtcagagggtcgaaccaggtttttcagaacctgtggcgtggagaattctgactctgaatgtgtgttggaggtccatttgtgattacagcatagagtttattaaggatgaaattttggcattaaagcaatttgcatgcattatatatgcaatatatagcttaaaacataagattacccatcattttcggcacttttgaactctaccaaaaaggaattaaataatcacaaaaaggaaccctattgccacgtgtattagtctgttctcatgctgctaataaagacatacacaagactgggtaatttataaaggaaagaggtttaatggaatcacagttccacatggctgggaggcctcataatcatggtagaaggcaaagaagaagcaaaggcacgtcttacatggcggcaggcaagagagagcttgtgcaggggaactcccatttataaaaccatcagatctcacgagacccattcaccattatgagaacaacatgggaaagtcccgcccccatgattcaatctcttcccaccaggtccacaacatgtaggaatcatgggagctacaatttaagatgagatttgggtggggacatagccaaaccatatcattctacccctggcccctcccaaatctcatgtcctcacatttcaaaaccaatcatgccttcctaacaatcccccaaagtcttaactcatttcagcatcacctcaaaagtccacagtcctaagtatcatctgagacaaggcaaatcccttccatctatgagcctgtaaaatcaaaaacaagttagttatttcccagatataatgggggtacaggcattgggtaaatacatccattccagatgggagaaattggccaaaacaaaggggttacagggcccatgcaagtccaaaattcaatagggcagtcattaaaccttaaaatgacctttgactccatgtctcacatccagggcatgctgatataagaggtgggctcccatggccttgggcggctccacccctatggcttttcagggtacatccccactcctggctgctttcacaggctggtgttgagtgtctgtgactttttcaggtgcacagggcaagctgtcagtggatctaccattccagggtctggaggacagtggccctcttctcatggctgtactaggcagtgccccagtgggaactctgtgtaggggtatcaactccacattttctttccacactgctctagcagaggttgtccatcagcttgccactcctgcagcaaacttctgcctagacatccaggcatttctgtacatcctctgaaatctaggtggagattcccaaacttcaattcttgacttttgtacacccataggcccaacaccatgtgtaagccaccaatgcttggggcttgcaccctctgaagcaagggcctgagctgtatgttggccccttttagccatggctggaactgaagcggctgggatgcagggcgccatgtcccggggctgcacagaacaggggggccctggcccactaaaccatttttccttctaggcctccaggcctgtgatgggaggggctgctgtgaaggtctctgacatgccctggagacattttcaccattgtcttggtgattaacatttggttcctcattacttaggcaaatttctgcagctggcttgaatttctcccagaaaatgggtttttctttttaattgcatcatcaggctgcaaattttccaaacttttattctctgcttcctcttgaatgctttgctgcttagaaatttcttcaaccagatatcctaaatcatttgtctcaaattcaaagttccacagacctctagggcaagggcacaatgctgccagtctctttgcatagcaagagtgatctttactccagttcccaacaagtttgccatttccatctgagaccactttagcagggactttattgtccatatcactatcagcatttttatcaaagccattcaataagtgtctaggaagttccaaactttgccacattttcttatcttcttctgagccctccaaactattccgacctctgcctgttacccagttccaaagtcagttccacattttcaggtatctttatagcagcaccccactcctggtcccaatttactgtattagtctgttctcacactgctaataaagacatgcaccagactgggtaatttataagggaaagaggtttaatggaatcacagttacccatggcttgggaggcctcacaatcatggtgtaaggcaaagaagaagcaaaggcctgtctcacatggcagcaggcaagagagcatgtgccaggggaactcccatttataaaaacatcagatctcatgagacccattcaccatcatgagaacagcatgggaaagacctgcccctatgattcaatcacctcccattgggtccctcccacaacatgtgggaataatgggaactacaattcaagatgagatttaggtggggacacagccaaaccatattgccatgtgagtcacttatgtactaggaaagcaagaccagttgttttgaaatacccatgttgaatctgagctcaaaatcatattaaaatattaaattgtgccttaatttgtgataaagtattactatccaaatgataatgtacactttgagaaagaaagattttaggctaatgtactttaagattgtacacttaaatgcaatttagcttgaatttgttattcaatatagtcaataatgttatgtggtatttaatttaggccaataaagttttgaatacctaattatgttaaggcctttaagacagttgagaccttgccaaatgttcatattatgcttgtcgagttaattatcaggaagttacttatctgatcattgtttcttaatttctattgagccagtcattgtcctttataagaaattattttccagctgtagtatttcagtgctgggttttgattatagacatataaaaagggtttatttaggactgcctttaaaattaaatctgatcataattatttgactagtagaggcactctaggaaaaggttgagtagtggctgtccactttggctactcagtaaaattacccaaggggctgtttaaattcccatgtgcaggtataccctcaaactaattaagtctatctctggaggtatttttttaaagctcccaaggtcctttgaatatgcagccaaagttgagaaatacaggccttgagaacaagcaaggaaagcctcctggggaggtctttctgtagtggaatgctcctgctctttgtaattgggtagcttgagtagctgtgaagttctttaaagaagattattttcaaaaagaaagaaacttaccaatatctggagaggggcagaaagcacgtgttgcttgccctaagtctccatcctacaaataccaggagagtttgtcctgattttgaaaggatttaggaggtaacatcctgcttttgtcaacgcatggtgtttgctttgacttttgtttggcatcttatttcacctacaagatcagtgggagctaaaatttattgagcgcacctgctaagtatcaggtcctgtgctataaacatcactctgtctcacagccaggaaagatagaattattcacttagaaataaaaagtcagagttctgttttgttagagaaatcttagtgtaattgcataaatatttagtgatttctttattcatctggtgacctttgttgaatacatatgctattccaaaaataagtttaaacatgcccaaagaatacaaaggatctgtattcattatctgttgcttcataacaaccttagtggctttagatgaacatgtatttagctcttgattctgtgattgatagtttaggctgggctcagctgggcaatcctctcgtcttggccaggttcactcatgcaacaatggtcagctgtggttcagctttgctgatcttggtggggctctctcacttttctgggagctttaactgagacaagctggctgaccaagctctgttcctttggcctctcagtcatcagcagggtcaacctagatttgttggaatatggagttagggtttcctagagaatgcctaagtatccacggcaccttaggcctggtgtgagaatgggcacaccatcacttctgccacatttcctggccaaagcaagtcacaagcccagtctagacacaaggagtggggaaagagatttcatttcttgatggaaggtactaaaaagtcacattttaaagggcaaggagaaaggaaacagtgagcaattaatggttattttttgcaatcaaccacaggtagaaaacttcagttctatcttgggacattagagggtgttcctgagaaatggtaacatttgagcaggtttcaagggtagaaaatatatttcaggtgaggcaatagcataaggagaactgtcaaattgtgctttcattagtgaaaaacaaaatggaggtagtaagttccctaaacgtagaaaatatgtctagccgacaactgagcatgtggaaggcactcagcatgtactttctcatttacatcaaagggcagtgaagtgactaagagtgtaggcccttaaagcaggtataataacctgatagccttaccatttaccagctagtttgccttgaacaaattactgtgcctctttagtaccatgaggacaataatacctcctatagcatttgctgcataacaaaccactccatgacttaacggcttaaaaacaacagccatttactcagcagctcattctacagttttatagtttgggccatcttaggttggaggttcttctggtctcagttgggctcatgcctgtgtctttggtcagcttgcagtcagctagatgtctctgcttctgaggattggctggctactgggggaacaataaggacaactggatgaccaccttctcatcatccagcaggctagtgtgggcttattcacatagaggatcagcagaattccagagtgagagtagaatcattcaaagcatgtgggctgggttcaacattgacacaccattgcttccaatgagctccatgagctaaagggagtcacaaatcagcccaccattaagagtagagaaacagacagcatttcttgctggaaggagctccaaagtcacgttgcaagaagtgaggatacagggaggggaagacttgtgaccatctagggaatcttctatacctacctatagctcacaacaatcctgtgaagaaaaagttaaatataacttgatttttctaggtgaggctccaacctaaaaagtaccaggctaatcatagatgttcaatacatggaaagtattaactttttcctatgaaaattagaaatcagattttaagccaaattctttaattgcttacttttatagaatatcagatgaacctccaagtgcttcttacaaaggttaaacattatacattctttccctgttgcagaaatataatgtaagtgggtaaagctcactgcctctgagtgcatgtgtatcttggcctgacagtctggcagctgcaatgtgtagaatatgcttattcaacataaagggtcaactcaggaaaagaaccagagacggtcaagtacaatgtttcagttcccaaaatattcaaggccttttataatgggtaagaactcatttcaaaacctatacaaagaacaaaaaccttaataaattgttattgatttcttttactgttatgagtattttcataaaaccagctaagcctcatatagttctagattgatccacacattgcttttggatcccataaattgcattcaatggagatttatttatctggcagctaaaatacctctaatcagtgatgtgaactggatcaaaaaatacctatactctttgaaataaatagaacatcaaagggtattcaagaatgtgtagtgcagaaatatggcaaatgtgcattgagggtggtgccagcttttttataattatggaacttctaagtccttaaatgatagagatcagatggttcttgcgctctgcctcctgacttcagcctgctttacccaacccaccacctccaaaagctccaaagcccacaaaagggccctctatccgcccgattgcacctcattcccaaacactgaatgtccactgtactgcttgttcctcttaagattttagaaagtcttagtggtggagtgattaagaactgtggctctgatcctcatgtctctcactttcttcctctctgagtgacaggggaagcttctgaagctacaagcctccttccttatttccttaataatggtcgtacaaagacatgtttacgtggccattccatcacatttagagtcatttgctgttaacaacaacagaaatattgaatccccaacgatttatgtcattagaaaagaaaaacaaatataaattaattaacattttcaagacatcccaacacaggtttgctgatggtgttgctttggctttcaaagcctgctagtccccatcttgctctgcagcactggagtatgggtcactttctggaaaggcttcagtgcctttgctacagagtaaatagtttgttttgaactctcagtttgtttttaaagtaatgttttatgggccatgtaatgaagtacctaacatagtgctaagcacatagtaataagtatttgtagacctgatatgtctatctttgcatgcctgagaatgatttccggtttataaaatttgtgttggcaaggaaagcagtttttgttgctactgataagccatctggggcttgatattctaaatttgatgactctatttacacataatatcttttagggggattccatattttttacgtttgtttgccaaactagaagttatgtacaaagttgtaagcccaaaatctgagaattttaccctggcaaaccctacaaatattttaaattaccgcaatgattttttagtaaataaaatgtcaatgcaaatatgtggaactagatttcagagatctcagagatccctgaacattctatggttctttatactggcactgtagagaatttatattatattgaacattttatattaagcatatgtcttgaggccaggtgcagtggctcacgcctgtaatcccagaactttgggaggctgaggcgggcgaatcacttgaggtcaggagtttgagaccagcctggccaacatggtgaaaccctgtctctacaaaaaatacaaaaattagccaggcatggtggcagacacctataatcccagctactccagaggctgaggcaggagaatcgcttgagcccggaaggcagagcctgcagtgagccgagatcacgccactgcactccagcctgggtgacaaagcaagactctgtctcaaaaacaaagggcaaggggaacttgatgttgagttggatatgggaggaaacagagagggtggtaaacagggaggacctgggatttgaccttggccaactagctgaaggtggcaccatttccagagagaggggccctggaggatgaccccaggggcagggtacaatggagagtatagccttgcgcacactgaggccgagggcctgggggacacccaggcagagaagcccaggtgcagctggatatgggatggcagctctgaaaagaggcttgggccagagatacagatctgggatcatggcaacctgatgggaaatgaaggcatggttttggatgatgtgtccaggaagataatatgcagcaaaatcaggaaaagaacccaagaccataccttaaacaactatggtatttcatagctagggagaggagccaatatcctggggtgttttctcaaatgtgtggttaccataatttggcatcatcctttgacccatacctctgccttttaagttggcatatggatgataatgattctggatagttatacagtgtctgaaatttggtctgatattttctcacagaaacttatacacaaacctctgtcttgtggatgtgagttgacggacatgggtaggcaaaattcttgcttgctatttgatgatttaagtgacagaagtgaaaaaaaattttttaaattctggtatgtagacttagaggcttgatcaatgcgagtttgcattatcgttagactttctagctagtgcccagggtttccttttgcatcacacaatacaatgtctggttgtgcctcttttcctgacattaaaattcatcagtggattcagaagaacctgcttattttaaaaactcaatgtatatataatatattcaaatggacagctggtatctgattatttctttattttagttacagctgtgttaaattcaattataaattataaatcataatagaagaatcagctgctttgaatgcaggaagatgcagattcttctttaagtatgtttttgaataaaataagattatgttaaaccagccagggaagcagcaaaaggagttaatatttactgggtgcctactctgggcaagggcactgaactgtgcatgttgcacaagatacaaatgtagctgattttggtaggggtttcaaatatacttttctatgctgaatggcaatctgaaatactgaagatactgaatggagctgacatgcaaacataggcacatgtttggaaggctggcagagtgtgttatcaatatggcttaaagtgctagtctagaccaaacagaagtgcctcaaaatagtggtagtgcccaactgtcattccatatgtcagtaggatttgtcctgaagatattgcagctgacttcttggccagtactctcagtatcatgtggtaataatggaaggataagattactaacaaaagatcccaggctataatgagtccactaacattaaatggatgctttctgcaatgtacctcccatctcaagctgacatgtatggaaatgaacaattgcaagagacccaaaaactttaccatggcagactgaggaccctatgccaaataaacatggtgttactcccgataaagtgatctaaagaaacctcaacagacgattggaagtacagtttcagacattaatgtctagctgccttctgctggaaattgaaaggaacaactaagattgcaaaatgtgcaaatggagaagccctctctaccagaagcttggagccagccagaggtcagcaaagcacaggctgcaaaacgccttctctgcaaaagtagctggcactgtgaatctaattaaaatcccaacatgtgcatattgcatgagggactatagcttaaaatgaaattgcaactgtacacattcattatctattagccatcagtagttacaaccttaaagaatacaggattgtatttggtactattcttagtaagactgcaaagatatgcatttattcactccatcaatatttactaagcacctgctctgctgtaagtgcatgtattagtccgttttcatgctgctgataaagacatacctgagactggtcacttataaaaaaaaaagtttaatggactcacagttccatgtggctggagagtcctcacgatcatggaggaaggtgaaaggtatgtcttacatggcggcaggcaagagaaaatgagaaccaaacaaaaggagttccccttataaaaccatcagatcttgtgagacttactcactaccatgagaacagtatgggggaaaccactcccatgattcagttatctcccgccaggtctctcccgtaacatgtggcaataatgggagctacaattcaagatgacatttgggtggggacacagccaaaccatatcagtgccttagttatagctgcaaagacaaacatagagtttgtgctcatgaaggttctattctagaggttgtacatacaacaataaacacaaaggccaataaataatatgctttcagataaggataacaggaaaagacagcagggtaatgagatgaaggctgagtgtagtggagtggacgggagagtttcagaatggttggtcatagaatgcttttctgagaacacgatctttaagcaagactgaaaaaataaggaggaaccagctgtatgatgacctgaaggatgttcattccagaaaacaaacagctagtataaaagctccaggtgaggggaagcttgacatggtcaagggctagaaagaaaaagcacatgagaagtcatggtcaaggagaccaaggaaccagctgaggctggaatggttgggtccacctgccccatgagaacccttcaatgaatgttggtcaaactgagctgaacaaagtgtactgtgtccgtttaaacaatgaaggtcaatagaaaagctaaaatagcctaaatcataaagaaaagttattgtcataataatgtgttgatttattgtacattctttctaagaattatggatcattttgcaagtggatagagaaatgtattttggatcagctttgacatacgcttaaaaacagtggtatgttaccctcaaacaagtaacaggccaagagattttatatatttcttgttgaaatttttatatttgaaaatgcttaaaaataatgctattttaatttctataataaattacaatagccatataacttttgagggatgcagagaaaactacatagaaataatgtagcaaacaagcaaaaaaaagtgtggctcaaaatccctatcttctaaatctgagtctttatgttgtgtgagctcagataccaccctctggaatagattcaaaacatgatctgttttggcctgggctttaaggatatacatgtgagaaactttggtttatgtgaattgcagcatagactcgttatgtgggaagaggaacaatgagctgtatctgttttatattgccacatcctgattatgacatgttccaatactacaagagaaataagatggaatagcatctgctagttaagagtttagaaatatgaatgaatagtctagctcagtgattctcagccccaaacatatattcagataccctggggacaccttcacaaatatcaatgtcaaggccccattcctgatctattaagccaactttgagagttagacctcggcattagtgtattgtaaaaagtttggcctgggcacagtggctcacacctgtgatcccagcactttcggaggccaaggtaggaggatcacttgaggccaggagttcaagcccagcctgggcaacatagctaaattccatctcaacaatacataaataaaaattaaccagatgtggtggtacatgcctgtagtcctagttacttaagaggcctaggtgggaggatctcttgagcccaggagttcaaggtttcagtgagctatgatcacaccactgtactccagcaagggtgacagagaccttgtcttaaaaaaaaagttggcaatggatagccagggttgaaaaccactggtctaatttaataggtcgccatagtctttaggataccgttggtttgattttcagcatcttagtctctatatctcatatcttatcatctgggtaatacttcattattttttttagagatcagagcttatggtccctaaggttagtttgatgggaaagtcttttcctttctgacttcctttttccttttattctttgctcttttgaaaatgtattttccttctaaagcataatctggagattgagaacttttaaaatctataaaggaatagtccatggtaattaaacttcaagtttcatgtatccattattcagaaattaatatctgcttctaaaaatattgaagttgttataataaagacacataaggttttttaaaacatatgaaataaaaaacttgtaattggcattggtgtaggcagaggaaagaaagagctagacgaagataattgctataattaaagataattacagctttgagcatccagccagccatgtgaggggaaaagaagaaaggaaatatgatttttgtatgtgtagtttatcttttatacaaaaaggcaaactacttcaccaggacagaaaaccttcttctgagaagtaaaatctctaggagtttatcacacagacacataaagctttatgtaccacacagtagaacaatgtcatttaatagttttatgagaaattcagataaatcaagataatttcttatattaatattttataaaagctacttttatgacattacttcatcagtaggttcagctgctacctcatagagtcctgagctcatgtcagtaggactgtgccagctgcagtcctggaggatgttggtattccagtgagctgtggcagagcatgtccttcagttcatctgaaagccatacgaagtcacagatgagaggaagtggagcagaacaccactctgttaggaaacgtgagattggaatttgatctgtcaggttcaccttacccttttaaattcttacagtagtagtattatatatactactatattatatatattatatattagtatataatatgtagtattatatatattatatgtagtattatactttgggagagtattaatagtttgagaactatactgtagtcatacatcttggtgtcttagatggatcctggctacagaatcaaaaacgtatgatagataagtggctactgcagaacaccttacattgttcttaattatgttcttcgtaaagggaagcagagtgttaccagtgactactagtgagccagttgcccctaaagtttgtttattcctgaaacactataacatggcaatttattaagtataatgaagtagaattttgaagagtttggagaaaggtctaaaatatgtgatgtgaaaaagactgaattattcttgtttatgggataatagcatattgttttacaatttgtgtctagaaatcacgtaactgttagaaataattgcttacaaaaagaactagaatgaaaccacatagcttatattatttaatccgatggacaaaatgatacatactaacttcttttcccaatagcaattactagatgtcagtggctaccttgattttcctagatgagttttctttttgtcctaaaaacacatcttcttgtcctgttttgtaaatatatttttcttgaagttttcctgtaatagatgcatgagaaataagcacacagtgattcccccggaccagattccactgttatatttctcacagtaagcattggcagggccactgccacggctatttagtgcaaacctcatgcctctaggaggtgccactcacagaaatatagtctatgctcttagtacagccagacctcctcaaagcctcagtggcagagaagtgtgaactcacattcctgactccatgtgtcattcttcaagctcccgtgttttattttttaagttcttttttttttttttttttttttttgagacagagtcttgctctgtcacccaggctgggatgcagtggcacgatctcagctcactgcaacctccaccttctggcttcaaacaattctcctgccccagcctcctgaatagctgggattacacgtgcccgccaccacacccgtctactattttttttttttttttttgtatttttgtatttttagtagagacggggtttcaccgtgttggccaggctggtctcgaacccctgacctcaggtaatccacacacctcagcctcccaaagtgctgggattataggcgtgagccaccatgcctggcctattttttaagttcttaatagaaccttgtactccatgagatccatgtttcttttatgataaattaacttaaaatcaaataacttccacatttctagaagatgttgttggcacctttttcccgcacttcccacaacatgtctctaatatatgcctgtccctacctgcaaaccttgccgctgtatcataggctactctctctctctctgcctctctgttgaatgcctttaaaataccctttccagaaaaagagtgaaaacgtagcatagagaagtgaagggggcagggctgtcagagccatactgtgatatttgttctcattgtacaacctgaagactttccttggtctctactttccaaagaaaatggaaattgggggtagagtgaccatgttgactgccttacatacaaagggctttgaactcagcacagggaaaggctctctttaaaatgttagcttaatgaatccatattctaaggcctctccaaaaaagttcttaatactgtggcatacaatgtgagttccacatatgatccttcaacttgaaaacctctgtgacactcaaaatgtaaaactcttcacattatactccaagacttttcataaacacagccttaacccataacttccattttattcatgatttccaaatagaaaaaaaaaatggaaaatctcgaggaagacagtgtgattttaaagatgttcagaattgcattctttttggtgcatgaggtcttgtaatcccattggctccatggctttctaaggagggtcagttttctgagttctccctgtggacttctggagtttcactgcctctgcccctggggacccgctatgagattagatttttactttcacactatgaaccaggaacacagtgaggcttgtctacagaaccagtgagatggaaagggaccaggaagaggtggcacttcagtgcccacacagagagagaagggatagagaacagattcaggattgggcagtgcaggactcacaagcacgagacctgtgtccttcaaagggttttctagtgaattacctacttgggaatcacttaggatgcaagataaaaatatagattcttggccaggcatggtggctcatgcctgtaatcccagcactttgggaggctgaggcaggcagatcacttgaggtcaggagtttgagaccagcctggccaacatgatgaaaccccatctgtactaaagatacaaatattagccaggcatggtggcacatgcctgtagtcccaggtacttgggaggctaaggtgggagaattgcttgaacctgggtggcagaggttgctgtgagtcgagatcgcgccactgcactccagcctgggcgacagagcaagactccgtctcaaaaaataattaaaatttaaatttaaaaattaaaatatagattcttgggcccctctccaactctattatatctgggcctcagccctttaacaaattgccccatgtgttacaaggcaggactgggagaacgtcagggagtgagggattctggagggcatctttgcctgggaaggacggcaagtgaagcctatgaggctgacagatggaggggcaggtgtgctgaacggacctgcaggacacgcgctctgatacagatggaggctgggtattccatagggccacaatcacacttatcacttcagttgacagaacacgcacttgctcagaaatgttctgtcccattgttgtgtctctactagagaccctccagttttctccatattgccttttgtatcgggtccaaggtctttttggctctccaaggtattagcagcctttgaaatgaacaagaacctcttccaaagagcatgactgattctgatcactgagttccacattcagccatgtcagactgaaagaacaagatctgcacgagtgttactattctgttgtactgatttcccccacctgtgttgacttaattttaacttccctaaattggagaatggaggagagggagatcaatgtattggagtatataaatacatacatacatacatacatatatatgccattctctcagaattccccctggattaaggccagccacaggcaaagaggtgaagcagaaaacaattacctggaaagccccctaagtctattcccccatgtcctgtctctctcagatgcacaaggcccctgcgtcctggcctcagccctctcatccttctccttcccctcttttcctcaccaggtgacttggtctgttgccagtcatttatgttctgtgtgattttgaatgcatgtgtcacctcttgcatgaatattttctgttttaagctttcactttaactgtaaagtgaaatcagttttcttccattcagaaagtgggggaggtaggctctatacagcaccttcctggtccctgggatccagcccatcctcagaggccggctggccctggctgtggtcaagtgcatgcgtgggagggagtcctttccaccgtgtgaacatgcaaaggctgtctttggaatccaccagacacattggggacagttctcagcttgaaacaacatcagtccaagggcattgcagctgcatcaatgccatggagcctctgctgccaggctaaacagaatcaagcagcaattattgtgattaaatgttgtttctagtgcaacatggtagaagtgaaagaacttgtggcttttttgttctgattgcacaagcttggagttcaacaataaatggcttttcatttgtggtcaaaatacagctctgtattaggaacttaatcctaaacaggtttttacctcttgcaaagtttatagtggtccaatattgtttcatattcatggtgtgattagaagatgaaattgtgcctggcacatagtaggtatttatcaattatgtgtttaatgaatgacagagtgtcagcaagtagaaaatatcatgcgaggtattggtcaagaaaccagtgaaaccaacccgagttgcagactgcctgtagtaagagaaacagagaagctttccagaatctcttatcacatatggaacctcctcaagcttatcaagtcctgagattagaaattaaatggatccatttccaacttgctttttgtgtaagattttcaatattttgggtatatgcctttaatcagcctcggaagctttcaggagaagtgttttctttctgcgttacctgtccgtgcaccatctgtgtgttttggttctgtcttcgcattttgttgaaaggctactctaaatttgaattgtaaatatgtaaatatgccaagtacatgttaatgaaaaaataacgagacttgtaagtcagccctgcagccggtgtaccatggtgatgttgccagagtgcaaatggtgttttggaagggctgtcgggagtgattcccggcactgcatgctgactaaaaaggccgtccatggcttctcttcctgacatccacctaactgctgtggcctcatcaggtttgcctctgaattactaagactgtgctttctgggagttgaaactattgatcacattaagaatttaagattcttgctggagcaacattctcctttgtgtggaaagtcctgaatttttatcttagactttaggaatcactggcaacttataaaatgatagaaactaagggttcaaaagaacccttagcttcttttgaaatgaccacatttttcagaaggggaaactgaggcatggggcggcttggactcgcttcaggccacacagcaattcagtggaaaagaatggagcagaacctggtctgtacttctacgtagcagcaatgtacccgatcactgccattttaccagactctggagtgggaaagagctgccttatattcaagttcctttaagggaatcaagaaggctcctaggaaacaaaagctctgactttatcatcccataatctttgagtaaactgaaggctaggttccagctccagggatccggctgtataaccttcagcatctgtactagtgctacttcaaatgtagttcacagactggcagcctggatgtcacctggaagccagttagaaatgcagactcttgagccccgctccagacttgccaaatcagaatctgtaacaagatcccagatcaccatatatacatctagcagctcttctagaacagtgcttctcaaacttcagagtgcgtcacgatcacctgcagggcttgttaatacagaggttgccgggccccgccacccccgagtgtctgagtcataagtctgggggaaggttcagaattctgcatttcaacaagttcccaggtgctgctaactgggaccacccttggggaagttccattctacaagaaccatgaccctgtcccttcctctacaaggggcctaggagtcacaccccttgagtcatctgccttccctgccctctccaggcagaaagctgtgaggataagctctggacatatatttttaaatacaagttctgactttctctaatcaagctagtctctcttgaaacatttccccagccctaagtaattcacaataacaccagtaaataacttggagggatgtgtgttttgaggattttggttctatttttatgaatcaagaaatattttgcctggctattaatatttttaaaacttcataaagatagccattatttaagtactgcgtaatgatttcagccacatttttgccattgctgggtacaatattagcactgttaagccagcagtccttacgatggcagtacatctaatggtgtgggagagaccacaggacgcgttctctaatttggcactagctcacagtgaactggtgttacaaactcctctgttgacattcctttgacatatgaaatgaccatctgctcttaaattctacttctccagtcttgagggtttacttttcccagatcaagcatcttttactgtgcagtcccagtgaggtagtagctgtctgccgaaagggggcatttgtagttagcccaggctaaacaagtgctaaaaggaagtggatcttttcaatatcatgagccacgagtaggaaatttgattgagaggcatttgtgtcaagtggtacatttttgaacctcttggcaaagaaactgaagtttatttttttttaagtcttttattatgaaaaaaaaaaaggtggctgaattactgccctcagaagccaaataaaaacagtgcaaagcaatgcttaacagagcgtgactgcaaatagtgctggtctcagtaaactggcctgcctgtagacaccacatccatcacagcaaagctggtgggatgtttgtaaagccctccagataccttggaaggaggtttatgattaatgcatggctgggagtaagcagtgggtgtaccagatgggagtgaacattcttctctctggccctaaaacaagtcctgatagagtgaagttaagattgccagggagatgggtgtggctctcacatcctcacctgtctgctgctgtcccagacaggccagacgcctggaggttgtgaatacctggggctgagagcatgctgggcagtgtgttagaagaggaagtgctggggacagagcctgtagctgcatgaccctaaataaggcactgaactttgagcctcagtttcctcatccatagaatcgattcaataacatctaccgcaaagggtcatgaggacgaaataaaataacccacagtaaagtagctggcagacacacagtctgtgctcacttccatttttcggtgctttttatgtcaagcctatgagtcaaaactggtatgtagcgagcctcttgggggccctggagggaacttgggtaaagccacagtaatggattatatgcaagcaggagcaccatggagaccaacctaccctggccaggtggtcgggcaagcaggcttttgtaggttccttgtgcccccatcaagtttcagcatcacttgagaggacagagcaaaagggtttcttccaactcttaccacctttgaagatctgaccaatatgcacttcctcttgcctccttttcttcctcttaactattaattcatccaataaatattaagtgcctactgggtgccacacactacggctacagttatgaaccagataggtcagtttgaagttcctccctcctggggcttagcccagcagaggagacacttgaattgcttcataatttcaattttgagtaaggaaggaaaaaacttgtaaaagatgggcctcagccacacctgagaggtgggagggttttggcatcaggaaagctgccccaaggaagtgagactcataggatgcttagatttgtcagatgaaaaatgttggaaagagagccaacaatgtttaaggctcctttttcctttagaaatggaaggtccagcccccttgaggcttgtgtgaggaacctaggagctggagaaggtgtgaaattgtcattgcagagaggggtcagaagaacactaagcttggggacatggtgagattactggagttgacaggcctgctgcgggggatgaagacactgatattacggtgctgtgacttttctcaggagatgttcagctgcttcagtgacaatacagagaagccagatggctgtgttcattccagagtgaaggatttgccttaaggccaggtgcggtggctcatgcctataatcccagcattttgggaggcctaggctggcagatcacttgagatcaggagttcaagaccagcctggccaacgtggtgaaaccccatctctactaaaattacaaaaaaattaccaggcgtggtggcacatacctgtagtcccagctactcaggaggctgaggcagggaatcacttaaacccaggagtccttacaatcgattcagtaacatctaccttaaagggtcatgagccgagatcacgccactgcactccagcctgggcgacagaggaagatgctgtctcaaaaaaaaaggatttgccttaagacactcttagcttattttttaattgtttgcttagtgcgctcatccctattactctccttcccttccttgtggtataaattatgaattaaacttgcattttgagaatctgcttgagaatctactcaccattcttcctacagaaacatgtattcaataaaaattcctgactggctcctatttcccaggtcatagaggtgctaggaatatggtgggaagtgaggtggagacatccctgccctcaaggaaattagattggatgagccaacatgcaaggcaggaagaaatagaacctaaagcccaaaatacacactgtctgaaacattccatgaagccttcttgtgcaaagtgaatccccactacccgtgctccttatgcagtcagtgtagaacgtaccgcattagcccaaatagaagcgcatctcagggttctgtcagagtgcatgtgatacgtacttctagaaagaccatgcccttgcactctgcctccctccctctctcgtgtctctctctgtctctctctcttcaccattaaaaatgaaccttgagaattggcttccaagtcagaatttgggggaaaccaaccttagaagtgattccttacccatcaaattcacttgccttttggcttgtctggggcaaaagtgtttataaacaataaactatattatttctgtgatgtaagtttaatgtattattgaagacaagtgacagccccacatacccctccaccaaaagggtcagctttcctgttttctgtgcagatcgataggtttggtgtgtacaaaaagtgaccaggttatgctgacagacagccatgaggatttataacttgcttttaggatgagtgccggtctctctcccatgagcagtgagtcctgatagcagggtcactgtggtctggtgatgttaaggcattccaggtttctttcatctacactcattcttaaactgctgcagaaagagatgtcaagatatcactgggtggggacattagaaaaggattcaggaatctataaacaagaaaagcttaccttccaccaccctctgtgctttgggtgtgttctgcccctgactcagtgcaggatcagaatagggcgatcttgataacaatcatgtgtaggcaaaagcctttgtaccttagcaggatggaatagtaaatatctgggtaggtgattccccatgtgtttccaacagacactcatccgtgcagagttcagtgtggcaggcttttctgtagcacagtccctgtaacctgaacggaagactacctgaatttgcacactttagcttaaaactctttctggggcttgaggattctgttcagagtttatttcatcttagcctgtgcagctgtcagtgtgctcacaggaccagggaacccaccaaagaatctgcttcctccgccatcattaaatctggttaatttagagcccacaaagtgtcattttaccacatggttcccacgcctggtaatgaccaggaaggaagaattcccactgggattgggcccttgaccatatttcatccaacagtgaggggtcatgagtggaggtggtttctatcatgtttaattatgtgtcaactgcaacagctgtaaaaaggtaatgactatcattactgacctagacctgcttcaaaagaactctaaagtgtctgtttccatatctaatctcactggccatcccatctctaccaaattattatttatagaatttgctatgatcagagaacctacctgttaaggatgtttggccaaagaaataaatagctgccatttggtctgcacctttcattaatttgtgtggttttttttttctcctgttggaattgattttggtggctgatagtgcaggctaatgaagacaattcaaatgccaagcataaggcaccaacaataattgagcagctttccttaaagaaagtgctgcatagggctgagaacagaattatgctgccaccttgtggttaaaagtgacacctgctggccggtcatggtggttcacgcctgtaatcccagcactttgggaggccgaggcaggtggatcaccaagtcaagaggtggagaccatcctggccaacatggtgaaaccccgtctctactaaaaatacaaaaattagctgggcatggtggcgcgcgcctgaagtcccagctactcaggaggccgaggcaggagaattgcttgaacccaggaagcgaaggttgcagtgagctgagatagcaccactgcactccagcctagcgacagagcgagactttgtctcaaaaaaaaaaaaaaaaaaaaggacacctgctgttaaatttaaaggccagtggtttttctagtgattaaatcacttatgcattaaaacaaattagtggatataaaagggtaagagagtatggaccttttagtccaaaataattaatgagataaatctttgaaagaatccccaatgaaagtcctttaaccataagcactgacctttctcaaggctaaacaacaagttctcacagtagttcgaaattatacaaaattggggtggagattgaggtagtaccactgagtcttttacagcaatactatatgcttgtattatattacagtctccagccatgactttacatcaatgcagccaataatgaagcctattttatagcaaacagaattaatgtacaactattaatctaaatctgtgatcacattaatattaccatcttctgtggctcatcttagtacagcattcaggtgccaaaattaagtgttagtagagttaacaattaaaataaatggtccttctttgccctgtgttgaataactcaaagaatatttacacatgtggtctgataagagaaattttttaaactttgaagaaataggctgggtgtggtggctcatgcctgtaactccagcactttgggaggccgaggtgggaggagttcaataccggcctggcaacatagcaagacctcatctctactgaaaatcaaaaaagttatcctggtatggtggcgcatgcctgtgttcccagctactcaagaggcagcggtgggagcattgcttgattccaggaggtcgaggctgcagtaatcacagcactgcactccagcctaggtgacagagcaagaccctgtctcaaaaaaaagaagaaataatattctatgtaatattatatagttgaatgcaagtttattgagtcaagtaagaacaggattcggagaaatagacttaaatgtcttcatgaaaaaaacataggggatgctcctccaaatggctcagatatttctgctggaagagatcatccctgatagtcaagacataacttacttgatattgaatcagcctaaaataagatggtccttgtggaccataaccatgtcacaggacagcactgccttgggtggcacagtgtagagtctggaaatgccatgattgtcacaggacagcactgccttgggtggcacagtgtagagtctggaaatgccatgattgccacagggaccttcctgttcagggtagcttttactatccatacactatgcctcctatccgcttactgtctcccccatcactcatcctaagaaaagcctcgctggccatctgaaagggtactgatttccctccaccttcccctcactcaaaagaacagaacgaggacccccaagcactgcatttaagggcagttaaaccgacacatgagggtccagcctaggggcagagcactgggccctctgcatgaggcctctaccctcagctgctccaagaaggtgaaacacaaagtgatccatgtacatctgcacacatggggaggggccatccccatgcacaggggaggagccggtccaccgacacacatttaccaggaagtccatctagacctgtgagcaggagggtgagcgggaggcagtcttggctcagttgtagatgagctgccaaaatttaaggagatagccagagaaggcatgggcagcagaattttggaaacaaacatccagaaaaaagagagagagaccaggagagaagggtagcagtgcacagatcttctccaaaatgggaaccgtccaccaaggacgtctgctgtaaggatcaaagattatgttagtctagatcccctcagccaccactcctcccacctccccaccaccaacactcacacactctgccaggcccctaaagaagagtaggtggcagttgctggtgcagccactcaacccgccagcactgcccacgaccacggggactggtgtcccacagtcctcctgcagagcagcacttagagggtccaagaggagaaagctgcccccgcaactggggcctttgtccctgaggactgcagtgcatctgactcagaaacgtgcacctgatgatgatcattctgttcgctgtgagaattttgtccacagtaagaacttgggaaaaagtctttcagtggctttatagacaattctaattgaaggggagtgagccaggagtttcaacacattttctcttggttccatcctttattccacagcttgtaataatcccctttcatcctctttctccctgcactgtactaataggctgggcatcccacatctctcatcatattctactgacctccttctattaggagagaggagagagagaagagaaacatgtacagaaaggagagagttgttggcgattccacactaggtttcatgaatggatatctggcttttgaataactcacacagcaaactctttttaagaacatggcattttataaatgggcatcaattaatctgttgtatgaatgaatgaagaacaaacagatgcctgcacaggagatagataccttttgtctgtgattcctaaaatgttgtatgctttggacctgtgtataaaaatgtattttatatattttcattggtcatcatgatttagctgcttgcttgaatgtattttaaaacctattgtggtgccaatttgtagtctcagtttaaagtgaattattctttgcatcaacaaatcacagaagtggtggttattttcatttgtttatagctgtctgggggcaaacatgcaaagtaatttgacttgttattactgtacgcctgtcgtgtttacaggcacaatatacatacaatcaaacataggaagaaagaagttctgtattacgcagggagtcctgcatttatataattatagagccttagaagacgttcatgttgattcaaagattgaggaaaacaacttcatctctcagaactctctctgcatacattgtaggtaaaagtctctttttcttcagctttttaatattctttaactttgaatattcaaataaatgtgacagtgtttcacctggagatgatttggtccaattgaaccacatttgccaaaatggcttttattctccccgttttaggaggcaccctggtttgctgcgaagccacccctgccgtcttgatgtctgtgctcagggatggctgaaaacagtcacagctttatcactgaagcaaacgaaaatgtaaatactttttcaaagaagatattgcactattatcaaaaaaccaaagtatttgcttattcatgacacttgagaccaacttaaaggctatttcttttcatttagaatgttctagaattgagcaaagcaaatattctttaaacaaggcctctgtgatgacagatcatttgatatacgactccatttttaaaatatctgtagctcttaaaatatttcacacaaggaatctgaccatttctgtttcgaagtattgggacagggtgcagtgaccctgtgagtcccagcatccccacagtgacaacgagctttccttgatggacacagagcacaggctttggagtctgagacagctggactcatccctccctgccacttagctcctgtgacactcaggggaagtcaccgctctgctgggatttagcttccatctctgtaaaagggggattaacagtgcctcctacacagggtggtgacagcaattaaatgaggaaagcatttagcagaatccctggtacataccaggtacggaaatgtactaggtagagctcttatgcttctcttgcaattgtttataaataggtcttatttattcccagggatgtattcttagcacatacttcattcattcatttgaaaatgcatttattgggtactcacagcagggtagtgtaaacatactcagaatacataacatactcagaataaataaatgcaggtgaatataaagacattctatttcattagttacattgaccttaaaccttctcagacaacagtgggtgagggagatgagagatggcagtgggtagggagatgagagatggcagtggattagggagattagagatggcagtgggttagggagatgagagatggcagtggggggcaggggcaggtgatgagttgcatttttgcaaaagctatataagaattgttatatactgttctgattttttttaatgaacctaaatgagcatggatttatttgctatggagtacttgaaatctttatttgaagacattaagaatccatccaggccaggtgcagtggcacactgtaatcccagcactttgggaggctgaggcaggaggattacttgagcccaggagtccaagaccagtgtaggcaatatggtgagacttcgtctctacaaaaaataaaaatattagccaggaatggtggcgcatgcctgtagtcccagcagtggggggcaggggggtggttcaggagaggattgcttgagcccagggaggtcaaggctgcagtgatccatgattgcgcccctgtactctgggcaacagagcaagaccctggttgaagaaaaaaaaaaaaaaaaaagaacaagaagaatccacccccaaacatatcaagataagacatccattgcttcaaacactgggccaggcagctgtatgttcccgctttcgttttcaggtaagaaaaatgaagacctagaccatggaggggacttgcccagagtccaatttcaagtccagtccggggctctcctcagcatccagcacacgcttccctgactttgcgcaaaggtcttgctcctgacagggaccgaattacagattctgccactttacccgagaattactctccaaacgcactggtctctttgcaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacaggtgagaaccagagtgtatatacctgtgccttaaactaatacatcccctgtacccagaagagtttctgtggaaagcctgttaggaatggaatcccgccacagagccgtcccagaaacttgtgcattagctttaactctcttctctctgctgcagagcgtctcgggacattctttattcactgaaggaaaacccatatttggttttgctagggagcaactagaagagcccttatattttaaacttcccagaatgaaagtcttgctgttctttcgatcacacccttgtcaaaatggattttgtcttttttcatgtgcgggcattttgaaatcttgtgtgatgcgcatctttttgccaccaccctgcggaagtcacagaatgtttgctgctacgtgatttcggagggattgtttatgattaaaaatgtgtagtgtagaccttcagtttctcaagaaacagattattttccaaggagaggaacatgctgtatatgaaataatcatcagtgtcctttttttagagttatacttctctctctcctctgtctcatataaaatgtcagtacccccaacaagagaaatctttgctcagagagaagttctttctaaccagaagtgatgtttcaggacattctggaactgttacaaagcacataaccttctgataggctagatgccaccagaggcccatgcagaccagctgaccgtcagccagccctgtccaaactctccctccaccatggaagcaactccaggagcgtcacttaaaattctgaaatagcttcctaccctaaaatctgtcaggaggagaaaagccaagaccctctgaacccagctagcctcctaatccctgcccagcctggacccagacctctgtggctgggacagagtctgaatgattgggaagatgaacaaagaggccgcagggccggggcttcccggggcctggacggcctgcttctgtagttactcatgttcccactaggtgtcacccttgttttatagagaacgtggatgggcggcgtattctctacaactgatggctttctttagactgtcccgagtaaaaacaaattctatttttacttgacagactttcccatagactggaagtacatatgactcaccctgagagcatgtacccttcctggcgtgccaaaaatctgtattttctccatcccactgcagtgtgtgactttgcagagactcagataattgtcttcattttctcaaaaaaaaaaaaaaaaaggtataacttactctgctagtttaggtataaacaatttctacgcaggcccaggcctcggtcctctccttgtgaacttgtatgttttttcccggaagaaggggtgccaggggaggtggacagtccctagttgaggcttgaactcctcttccccagcacctgcaaacgggccatcaaatcactgtctgattttgtctttgttgacaaaataaacatggttcttaaaacgagagatttaaaagctgataagaattgggataggaaagggtagtgtgcgcttgattttaagggggcacatttgacattacaacatttcacttttcatttcagggaaaagaagccgcgacagcatagtggggaccatgagaacctgatgaacgtggtgagcctgcgcgtgtcgtctgcctgtctgtccgtgcgtgctccagaacatcagctacttatctaagtgtgctcccatgtgctcacagcctgagtagaacccacggggagagctaagcctaagttaaacggtggcttctgaaatggatgcagtagtgctgctgccggaatgatccttaaatggctccaacctactgcagggatgggacttttttgcctctattaatttgctagtgctgtcataacaaaggaccgcaaacagggtggcttaaataacaagtttgtttctcagttctagaggccagaaatccaaaaatcaaggtgttggcaggattggttgcttctgagggaaagtctgttctaggcctctcctggggcttctggtggtttgcagccaaactttgggtgtgacttggtttgtacaggcatcaccccaaattctgccttcatcttcctatggtgacctctgtgtttcacatcacctcccatctatgtatggctggctgtgtccaagtttccccattttataaagacaccagacatattggactagtgcccaccctactgtagcacgacctcatattaactagcttcgtctgcaatgaccctatttccaaatgagaccatattctcaggtgctgggggttaggacttggacatgaattttggagagacacagttcaacccataacaacaggtcattaagctggagggagcttgggacccacaacaccctaggtatataacctagccttgctggcgttttcccagccctcagtatcttacagggtcctgatgatcctgaggccctcagggatccaccctggcgaggaacagcctgagagtgtccaggtccttccttgtcctctctgacccaggcccgtgcttttgaatggctgagcagtcccagccgctggggagggggcccatcgtcacattagcaaggcagagttcagaatctgccctgagtcctgtggcagtgctaagacagaagatgcttcttgttcaggacatcatttctcaaggtcaagcaaaaactggttgggaggagagggtgcaaacaaggaagcatggatgagccaaggtctggcgtaaaacccgcagccagcagacgtttgcagagatgaccaggggcatctccagtctaggcttcctgacctgccaattctcaggactcctctggcccaagcaggcaggaagttgtcaggactccccgttcctcctgggacccccaggattttccttccctcccctctgcatccacatgcccacctcacccttcgcagctttcctgggccctcatcaccactcctccctttactctgtttctcgccctgttcccatccctggttgtccacattgtcgccacttctcatctgttcccagcgcccctgctctgcctggtgattgctgctgtggtggcctcagcagggagggtgggagggatggagggaacgccccactgtcgcttctccccatgcagactccaggcccctgcctttcgtcactccaccattctcctggtgccagttgggtggtgaggtggggctggggaagggctcccaccgccattcctcacttccttctagagcaggggttcttctgcagtgtggcctggacctccacccacagcagcagcagcacctgggagctccttagaaatgcgaattttcctgggggtgaggcccagtaaaaggctcgcaagcaccccaggtgatccagttgtatgctcgagtgtgagagccactggcctagagcttgggttcccgctgttctactcaaggtcagcagcagccctgggcgagataggaagagagtggcaggtggataaaaggaaaaagctggcttccatcccctgccttcttcctcatccaccatataattcattattgccccaacccatagcctcatttatatggatgtgaatgtctgtgagagagcgcgagcacacacaggaacgcatgcttacccggacactggcacccatgtacacacgctcgcccacccagctctccttaagagcttttcagctcctagatcttatacaacttgcggattcttcatctcatagaagcaaagattaggaatagtagttagagtctagattatggtaacttcagctgtgatcgattatgctgttatgggcccacctgggagtcttccttccccacacccatgcctgcccatttataacatcatttctgggatattagcacctgcattgcaagttcctggcaacctaacacagtgacccatctcactgggggctcatcagacgtgaatgagctgcattggatggaaacagctgacttccaatacacttttggatcattgcacagcatgaactatctgctgtgtattactggcttccaatcaagagtcagagaatttgtgaggccaactagcaaaggtttgtgtgctgtttacatcacaactttccttgtagaatcctggagcatgagatagcctcttggaacgtgcaggctgtgagaagaacagggagcaaatcacatttgcagtgatttgggctgcaacctgagacaagttgggtatttaaagaaatacatgaacaccaacttgctttctgactactcttagctatagctgagccaggcatattgttctaggtagcatctacacattctatccctgcagaaaaccaactattgatgccattcttccctccaaatgtcctaagtttatttgtaagaataagaaagatttgcagagctgggcacagtggctcacgcctgtaatcccagcactttgggaggctggggtgggcatatcgcttgaggccaggagttcgagaccagcctgagcaacatagcaagatcccatctcttatgggagcagccagacatagtggtgcatacctgtagtcccaccgattccagaggctgaggcaggaggatctcttgggcccaggagtttgagacttcagtgagctataatcatgctactgcactccagcctgggcaacaaggtgagacctcatcttaaaaaataaataaataaataaataaaaagtttgcagagctaattttcagcatattattgtttctgtgaacctagcagccagaggctttgctggttctaaaatagtttcagaaatcaatagccttatctatctctgaccagatttaagtctgttcccttcacatgacaaagggtgatgcctttccacgtttctcatagcatggcacacctttaccaataatgatttacagcacctgtgttgtaaggatgaggctgctgtggtctttttcaaccagttcccttcctgccttgagctaagggaattgatatctcacaacctgcctatagccctgtgtaggtcaccaggcaggaagctctgcacatggctttggaagattcccagtgcccctaagattctgggacaacagtgtctaatagaactttctgcagtgctggaagtgttctgtatctcctattggatatggtatccactggccacatgtggctattgagcgcttgaaatgtgactagtcaacaaggaactcaatttagtgtattttattttacttaatttaaatctaaaaacagtagctccccttaatctgtagttttgatttctgcagtttcagttacccacagtcaaccacaatccaaaaataggtgagaaccatacaagatattttgagagaaaggaagagcacattcacataactttcattatattatattgttttattgtcagtggttattgttaaattactgtacttataaattaaacatcatcataggtataacatatatggataggaaaagacatagtctatatagggttcagtactactcatggttttaggcatccactgggggtcttgaaatgtaccctctgtagataaggggggactattataggagattctgttttctgtttctgctgttttaattttttgaaaaagccatggatcttctcctctgctctgcagtccagattcttagcaatgtgatgcatttgtttttgtttttgtttttgttttcagccttcagacaaggagatgttcagccgttcagttactagcctggcaacagatgctcctgccagcagtgagcagaatggggcactcaccaatggggacagtaagttctgcaaaaacaccagctttccacacaggcctcatcacctctggaagtcctaggtttcaaaatacatagctcaaaaagtaggaaatgtgttattgctcagttttagtattcctagcagttttagcagaacccctcatttggatgaatactgctacttattaatccacttctgtgtgccaggcattgttctaagactggtacatgtactaattcatttgctcttttagtacattttagtacatttacatgtactaattcatttaccccacgagattactgttattaataataacactactctgtaagataggtattattactcctcacaatttaaaggtgacaaaactgggcacattgctgctgtaacaatattaccacaaacctcatgccttaaaataacaatttattgacttgcaattctgaggtcaggagtctgaaatgggtctcactgggctaaaatcagggcatccgtaggcctgtggtccttcctgaagcctcaaggagaatccattggcctctccctcattcttcacatccctctctgaccctcccccctccctattcacttatagggacccttgtgattacactgggcccacctggataatccaggcttccctctcatccgggagtcatctaattaacagccttaattccacctgtagccctaatccctccataccctccacaaaacattacacattcacaagttccaggaattaggagacagacatttttcagggtcgttctgccttccacagagatgttgctaatttgcctgatatcatatagtcagcgggctaaggatctgtagttggaaccaggcagtctgatccctgggcacgcactcagtcactctgcataacctctgcatcatgcattgtgtactcttgctgatggaaggagcagctaggtttccttcatgctttagagtttacaccatgcttttacctgaggtaagagggcgtcctgttacccctgtttactgatgaggaaactgtggggtaatcaggacaccagtgcctgttctctgtctaccatgatgtagacaactagaaccagagagcaaaagttcaccccctccgtgatgatcagggatttagaacacacaggggtgttggtaagttcagaaggattgggggatccgttgtcattttttcacataccccttggaaacactatttctaattcccccagagtgagacactaatggaataacttgcttactttgtgtctgcatcctaagggcagggctttctgtttcattgaatgatgtgtctgcagcaccctgcaccatccctggtgcatggcaggcactcacaacacggttgacaaagggacgactgaacagcttcacacaatagcatatctgtggctggccaagaatttcacatttggtttttttctaatttgaggtaggaatgttggtggcgggatgagatggaagcaaggtatgaggtgccagtccctttgtgctaatggctgacgggtgcatgtttgccctgtagtttctattatgtctgccaaacaaaagtcacctgtgtgaaagggggtggctaccaataattccctccacacaggcaggggtcagtggtgctggggactgtggtcactgcacatgctgcctttctggtgtccagcctcccatagttcagcggcatcaaactggtcatcttctggtcacattggacaatctgcctacaagagtctctcattggagtgacattaaggaaagtaattgtgaactacacttagagccaagataacttattaaatcttgtattgggaaagatataatgaacagctttattttaaactgtgattgaagtaggataccaactgatggtcataacaactataatttgtgcctgagacttaaataaaaagcacgcatcttgatttaacctaactttatattacctgattctcggtaataattattgaaagacttgcctttctccgcttttaatgtgtgtgctgctttagttctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaaggtgggcactggcgtttttgttttgtctttgtgggttcctgttctggttaggaatctagctggccctggagttgttctgggaaatatctgcaaacactttccagtttgttgaatgatgagagctgttttcatgtaagctgtgtttggctttttccccctccaagtaataaaataccaaaaacttgtatttatcaaatatttctctcagcaccttacttggatattttcacattttttccatcatgtctaattagggccaaatcttgtttgcttcattttgatgtccacaaattaaatacagaaactggacactttgcccacacattttacccattctgcttgttggctgcctcagcagcatggtgacctttccccttccaggatccccaaaaatcagcatgcatagcaacaggtaccatgggaaccaactcacaggtgcccctggttatatctgattgtacaaaccttcatataaatcagtaggagatcttattttgtgaccctttctaaactatagcctatacttcctaaatttagatattcaacaaagctgtaaaatgcattagcaatccacaccttctgcatgtgtctgataacttgatatctgagccacgatgaagttcacatccctggttgttaaaatctctttgggatttaactaggcccatctacttcaggcaactaataattaatttctgttttctacacagaaaaagaggaaggttctctcttctattcagttttagtaggaaggacaagtagcaggttagccagtcactagtagccttaaaaaccttccgtagttcatggccagaggtgaaccctcactctgtttgtataaattagaccaagaaaatcattctttgtgctgttctctgaatgcatttcaacttttcatattatccatgaaatcagctgttgagagcaccaataaaagggtttatgaacatgttcataaaatataaaaatgcagtccaattttttgcccttcatagaaccaaagaccataaacctgatgtaaagttcatgctgcctaaaccagacaaagctttttacttacaagcattagaaagataagacgttgagttgtctaaccattgctagtaaacagttctccagatttcacgttaaaaactggaaataatcatctggaaataaaattatccttccacaatatagtaaaaatgagtaatccatcatctttatataaacaaccctaattttaagtgagttgagggtttgaagtatttaatattcattcatttatttaacaaaagatcttaataagcacctgctgtgtgccacacagtcttctagtcctggaaacaaaacatgtacatgaacaaaatccctgccctgtggaacttacatcttagtgggaagagacagacataaagtttaaagtttataagagaaaaaaatagaaccgaataaggggaactgagaaaacaggtggggagtacagttttggatagagtggtcagggtctgcccagctatgaaggtgacgtttgagttaaaggatccaagggggtgaggtttgtgcttttgtggaaagagcacgtgaagcagaggggatgcccagtgtgaggcccctgaagctagagcttgcaactggctttttaagggaagaggaggggactgctgtgggtggagagggaagagcaaggacagcagtgaggagaaagagaaccagagctcgatcctggatggccttggcttatagtctgaacactaataatgtcactagagtcccgagcagcagaatggcacaacctagcctatgttttcaaaggatccctctgactccagttttgaaataaagggtagaagtgaggagaacaattgggtagtgactctaataaaccagattagaaatggcggtggcctggatcagggaagaggcagcagaggtgatgagaaaagctaagccagagccaagagatttgcggatggatcctacgcttagtgagataaagaagaggcagtgatgagtacgaggctgggcccaacatgtgggaaagattgaattgccattaactgaaatgaagaggatacaggcagagcaggttttggggggagaaccagcagtcagtgttgggtacgttcaacttgagataccgattggacttccaagtagagcttatcagatggtagctggattgatgagccgggtaaagaggaaaggccagggctggatttgctgatgtgggagtcatccacagaatgtggttttaaaagtcatgagattgggtgaggtcacaggataggtgagtgtaaatagagcctggaagagctccaagaatagagatctggaaaaggaaccagcagaagagaccaaagtaggaaacaaaaacaggaaagttgtggagtcctggaaggcagtgaagaacgtgtccaggaaggaaggagtggcgggccgctctgccaaatgcagcgggtaggtcagggaaggcgagtctcattggtgcccttgacaagagcagtctctgtggaatggtagaggcagaaacatgactgaaatggattagaaagagaataggaagagaaaaattgttcggttgactttttagaccactctttaaaagattttgctataaagaagtgagacaggctgggcgcagtgactcatgcctgtaatcgtaacactttgggaggccgaggtgggtggatcacttgaaaccaggtgtttgaaaccagcctgggcaatgtagcagcaccccgtctctacaaaaaatacaaaaattaactgggcatggtggtatgcacctgtagtcccagctacttgggaggctgaggtgggacaatggcttgagcctgggaggtcaaggctgcagtgagccaagatcacgccactgcatcccagcctgaatggcagagtgagacgctgtcaaaaaaaaaaaaaaaaaaaaaaaggaagtgagataatgagtaggtagaatttcggagtaggactaggtttgttttggttttagaatgagagaaacaacagcatgtttgcatgtggctgggaatgatcccacactgggagaattcctggctcagtattcacacataggtatgtggagacagggtctagtgtgtaggaaggaggggatcacctgaaggaggaacatggaaaatccatttgacagggaggaaagaaaatagattaacgcagaggctgagggtggggctaagagttgatacaaatttcttctgattccttcagttttcttagccaactaggaagcaagatcatctgctcagagtgaagataggtgaggaggtgttggaagtctggggagaagaggagaagatgcaaagtagactgtgagttgagcagagactgagtatactggggaagcatcggatgatacggagcggctttaagggctcactagagggttgagttcacgtatgattggcagttgactatggagcttaagcttagtaaagcagtacaggacaccaaggagaagggcagactttgaaagcatgaatgggtcccaatggtgttgaaggagcattggaactgggttacagaaggagtgagctttgacaacgagcgctggtctgaaaggggttgcaaggacttgggctggtggagaggctgtggtttagaaaggcctggggtgcagccatgagggtgctgaggccgggggtggacatggagaggggacacagatagagcataaaatcagtgggggaagggaaagtcaaggaactgaagggcgggatttagaagggtacacgtttgttgaggtcaccaaaaattaagacaagggatgtgttagagaatcagtaaaccaagagccaaaatccttcagaaatcaggcagggggcaagacacaaaatgtgagtcagtttctccattagctttgaagtttccaaatgacttaaggatctttctgatgacgccagcaaactgtagaagtataaaattcaggcatttgataaagaaacaccatgtttttaaatattaatcctccatggatgatcaatccttcagtgacaattaggaattgaaacagtagtctaaataattattttggcttctttgtacctacagatgcaaatacaaaattagaggaaatttctctaaggataatactactagatatccccgaacatcatacatgtggtaatagattgcataagtgtttctcttcccataatttcttcgtggttccataaaaatcatttgaaaacgttgctagacagattatgaggaaacatgtgcaaaagaaaggttagattgttaacgctgaattactttccttggcttgtgtttgttctgacagagatttagctcattgtcatacaagtctcgggaagaagaccccactctcacagaagaagaggtaagttttgtttctttttaaaaagggaaaactgtagtaaagaatagaccttccccccttgaataaatgcactgtaatgttaccctttgaaagagctgaaatattctcctatgcctatgtttggagatgaagacttgggatgctggttttataatggcttggagagactgacgggcaggccagacaagaaggatggcaggacaagtagtcagctcaggaaaagaaactgagcaggaaagcagggtcaggaaaaatagagagggcaggggagaagagtgagaagagaaaaattccagcgtgggagcagtcagcagtcaggaagaccacatcagaaggaaatgaatcatgggttggaaaattcaggaaattagaacaggtgagtgtagggaatttgctccagcctgggagacagaaagaggaagtctccgtggggaaatttggatgctgagagcagattaacttcagtaagtacagttccaggcaggagctagggtcagacatagcagccaacaagagcagatcgcatattcccaagcaccagggtgcaaaattcacgagttagattttcaatgaagcattaaaattgttaaagccagtattatacatataatatgaaatatgtgtatatatacatatttcatatgtatatatataaatgttgagctatgctcagagagctaaacaccttaattgatctagctgtatatagcttctatctggaattcctagcagagtaaattgtgtacatgtacaagagcaaagtacatatgcaggtacatcacttcctataggactctgagtaaagcattagaatatggacatagacacccacgttgaatgttcaaagagcaaaaatgctttccctaggtgatattgcccaccctcgtccatgtttctacctccagaatggacctgccatctgtctatctggttgcacagaccaaaacctaggggtcatctcgatacttccttttcctcactgtcctccaacacagtcaattgccaagacccatcagttgcacctccaaactgttttctttgtgtacccacctccctcaagcccactgcggccgcccctccctaggccagagcagtcccctcctgctgatccctggcagctccttggcctccctccactctgttttctactctgcagccaaagtgatcccatctgggacaagaaggtaaaatatataggagttctgggaattaaagactatgtaaaattttaaattgctccttatcttacatttgtttgtattttttgaaacaggacctagttatactgatgaatttttaacatgacagaactatgactcacagacattcattttaggacaaagaggaaaaataaatatgaaagttttttttgtatttatgtaatttaatgttaaacagtccagactgaagctgagatctgagctttaagttctattaccccaatttaacagaatgttatggaaaggattgattagaaaaagaagagaaatggggaaaaggaagagagtaacttatgggaatatagcaacaatttacagactgaggaataatgatgaaagttttaaagagaaaaattgagaagctaaatagcaagggggctggaagagaaacctgtatacaaaataaaaataatagtcataatggtcatagaaaacagtcaaaaggaatatgagaagactcaagaagcttttataaaagttgaaatgtacagtgagaccctctgcacactaggttcattcccagagtcaatattaaattgcaagttaatgaatgaggacaaaggccaagaagaccaagtactcttacaaagagtgaggggcattaattacaaagaccagggggaagaaagctgaggagagaagctaacggtggtgaggggctgactctcattgttacaatctaggtcaaggtacatttgtcctccttgatgttaccaggtgatgaatacgctggtatgccgtctcccctcaccattgtcatccattgtttacctttttataatctgtccacatataatttttggcttggaccaccatttagataatacattctgtgtttgcacttccttataaacagcagtgaattttttttattaaattcaaagaaattataattcttgtattctgagagcagttttttcattaaaacctctaaggtgagaatgttaatcatttcatattcattaggatagtcagatcaacatagtaagagttttccaaagactgtttttctgaactgtaaacccttggattgtcaaggcctcaccaaactgagccagccaccagcctgtaatgaaaagttctcatgcaaatgaccagttagcatgtggcaggcctgtcttaagaagcttttgagacataagaaggcctgtcttaagacaggcctgtcttaagaagctggaaacttcacctgcagtatgtgagaaaagtggaagcaggaaaatgtccctcagcccttgggaagccaggcatctgtgaggaagcatgttcatgtatttcctgggtatttgaatgaatcaaatcactgtgataaaaataaacacaggtaatgaagggtatttttacttatttccaaccgtgatttttcacaataaaataatactccccaaaagtctcctaattagtatatttaatcttcacaatgaatgaaatccctgttgatatcggaggtgatacaggatttattagtgagactgtgggggtgtgcttggaaagccactggctcttaatagtatcctgtaagttgtcatttctgacttggctggttgcaagcgagaatgagttttcccactgaagaaaactagacctggactgtcaatgtctgtttaaccagtaatacgcaactaagtcaagaaataatggacaggaataccctttcagatatatgtgtaccaccaacgagaatccagcaacgggtgttggagaccactgtgatgcaggaagcatggagtagtctaattcagagttcttatactttactggccatcagaatcagcaccggttgctgggccccagccccgaggttctgatttggtggttctgggatgaggcctgagaacttgcctttctgacaaattcccagatcctgttgctgctggtttacagcccacactttgagaatcaccggtctactatgtgttttctgtccttttttgtaaagcagtggagccccttttcaggcaaaatatcattctgataaagaaatgaaataaaacacatgctgtggtcaggtccccggggccttcaggagcttcccactccacctctcctcaaattcctcggcagacccaagagaactgggttttcacggaattaagggaatatgactgatctagttaacatagttgaagatagtgtgtgtaattattctctagtaatgtgctccataattagtacagataagaaagaacaaatctttaaggagtacacacacagaaacccaggagtgctcagtatgtagcttgtcactaaaaagagggagggggaagtcacagctggaagtttattcaactctccctttgtctcctagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattcctgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagtaaaaaaaaaaaaaaaaaaaaaactttttatagaaagctcataaataatcatgtcattttgcaattttgttaccaaaatttcccccaagagttttcaaatattagttctgcaatgtggctatgaaatatgcactgaaatataccttttaatttgagaaccagtggttagaataagctgtgatataaagtattttcagtgtacttttaaaggaactataaggccctccagcataaacgctaaaagaatagatggtagcacaggccatgagggctgggggagagaagcagagtgaaccttagaaagatggctcagctatttggagcactggatattttactgaagttatttactgaggcaccatcactgttttgactgtacagtatagtttttcataaatttcatcacatttactttgttcagaatctgggcttgaatctttgagttggacaaaagcctatggtttcttttaaaaagtttcatcttgagctaatgctacagtttaaataaaatgtatgaaaggtagttatcaaaaacaatttgtatatttaaaattctattttgacatccattttttacagcgaattatagcaggttatgtgaaatttaaaaataaattttaggaaatttttttatcttgtaagtaagaattataaatctatctcagttaaaagtaggatctttgtttttattcagatattttgaaagtttagaagcattttgtatgctactttggtatttcttaagtatagtcagcaggaaagggtaacctgttttatgcaaaatttttttaatttgtcaaatgtttttagtgtgtctactttctgaaatagtctcaatatcctgtctgtatcctaggcagataactacacaagaacaaaacgctatatagaaaagaaaatatttgaggaaatcttaaattccataagaaagtaattcttgcaagaatgttggctacatatttttttttctgtcctgaataaattacatcattaggtctgttgaagcttttgaagctaccactattctttctgggataaaggctaattactgatttatctgccctcaaaatcccagagttaattctaattgagtactaaattaacagtaagtagttaacacagagaactaaaatttaaccgcattatatcactgtatatatttctcatgatttttgctaattagagcatttacttaaccagtaataaactacacacacacacacacacacacacacgtatacgtgtgtgtgtgtatatacttggctctgacacaactctggtgcttaattaggatatgttctattatgtattttgaatgtttatcctgctagtgtgatgaacttttgttggaaaagcagaattagaaggaacagtttttcaatcagtttcatttggtaattacaggaaaaccttgagttgctctaatttaatttttccaattaatacatttagactttaaattgcatccgtaattctcttggctgaaaaacagtggtattttaagacagttttgttatacatgtgacttacttttgactcagcctgagaggaggaaatgtaaagagataagagatttggcccaaagcagcaagagactagtaaccttgagccaggacgaagccaagacaacgtgactcccaagtagcaggagcagaggtcggtcacctgtggcattctgtttcattcccttttaaaattatgagactttataggcagtgtaaaacatcagcaggcagcgatgtgataggatgtgcgaaaaagctggtctgataccatggctataattacagagctttagttcaattaggattttgtaaatgagcaaatgacctttttttccagtgccccttgtaatagttaatatgagtccatgcaatcttgtgatgccattctcctgaaggtgttgatttctggtacccagccagcttagctttggctgctggaagcacagtaggtactgatgattacttcctggaaatcttgacaggcttattgtactgtgtaatggggaaaagttaaagtataatgtttggtgttaataaatgactgatgtgaaaataggaacatgtgtctttaatatcaaatatggctttatttgcagtgaaatctaaattccttattctacagtagtattttcttgccctgtgttgtatattttcctaaatacatttttcctgacagtggctttaggccagttgaacacacttagactgaaagtgtttaacttaaagagatcagtccagaaaccatgataaattagaatctttatctggaattaccaaattaaaatttaaaatcatggtccagaagagaacaaacattcatggttttttttatcctactgctcatttttaggtctgtgtttacatctagtctctactatttgtgaagtatgtcattatttttttcaagttcttctttgacttaactgaaaaataatattccaaattcttaatgtaacatgaaaagagaaatacaatttttgcttaaaagacattttttaaaaagcgttcaattcagtaatcatttctgttaatacaggaagtttttttggcttgccagttatatactgtgggtattttttaaaatgtgctacccttgggttgtctcatatcaccttgcgtaatcatgtattacaaaggttgataattgtcatttctcagatgtctgtatgttacattggcagcagtaaaatgttttaatgttgttaccttttaaataattgtgttgtattaacatgcctcatattttctggggaaacttgaaatatatctaaacaaaaaaggtctgttataaataggaattggcatttcattgttaatgttttttcctcataaaaatagttacaccaaaagtgacatattgtctattacatgggcccaatcagtattaaagtactccccttactcaaaaatattaaaaaataattcatgacacttagtagcattttcattgattgtttcaaaagatcttcataatggtcaaattgtccaattcacaaaagagtgagaaagttgttttcagtactgggaatttttaaaccttagttttaagaccaaaaatatctcttattagcttgaacattttgtgattacttttccctccccggatctagtccttttaaggagtaagtctaaagaatgaggccatgaagtcactatttcctcccacctcagtttgtctcctggtacttagctggcctatcgctttgtgtggcaatacccctgggtcgcttccccactcagccttctgtatctgctgttcacaggacatgccattatgtctttccagtacggatcacagtgctgccatatcacagaccctgccagccggcacagaaccatgcctcgtcacagctctgcccaactcacaggctgccaagatgaggccacaggtccacctagggcggcagatgctggtgctatttgtcacgacttttgccaaaacatgtacactgttgctcacatctttcgtaagaatggttgacactaaggggccatggaaaagcacttttaaaaaattatgtggtggaatcaaactcacagaggcagaaatgttagtgccgtgctctaaccaagtaagcttagtgttccccacagtgatctgtatctggcctgagtctcctcaagcagcaacccccactgtccagcatgtggaaggtagatccttatgacaacaccagacccatagttaccaggaaagaaaaaggaagctgagtgttgtgaaggggaagaaatcctttttataagaagtaatcatttttaggccgggtgcagtggctcatgcctgtaatcccagcactttgggaggctgagacaggtggatcacttgaggtcaggagtttgagacctgcctggccaacatgatgaaaccctgtctctactaaaaatgcaaaaaaaattagccaggcatggtggcatgtgcctgtagtcccaactactcaggaggctgaggcaggagaatcacttgaacctgggaggcagaggttgcaatgagctgagatcgcaacactgcactccagcctgggcgacagagcaagactccatctcaaaaacaaaaacaaaaaaaaaacctttttaaagtaaattgagtgtaaaatgttttcaccatgaagccattgcaccctctcccccaggaaacagtgcctaaggatgatgtcaagttacagccagtttgctctgatcccccaggacctaagaaaactgtgagtgcttcagcatgcaaaggtagagctaccagataaggagaataacttggccatttatagcaaactgcctgactttggagtgagaaaccaagcaccttctaggtcctaggataggtgaattggaggtgcagctgctgaagttcccattttctacatacttcaggagccagggtgtttcatttggttttgtaaaactttgctgtaagtcatcacagttaattctttgaatggacattttagagtgtaactttttttcaaaattagcagaacagatatctctgctcattctctttatacatttagttttttaaagttcccctagtatacctgttaggcactctaaataggacacagttaaagctaaaagaaggaccagttgctccctagagcctacagttcagaactatcttgttgtcatgtcctggtttggtttggtttgtttttaactcaacaagttggaaaccatgagtttaaagcaaactatttccttttcttaagcttaaagagaattttttttttaatctttagctcctcatttaggtagtgaaggcttccctgaaagacagcagtgcccttctctggaagaagaggctgggaccaaaagcctgagtctatgggttgaggattttgagcattcctttgacaagcttctatgtatttttaatataagactcataaatgaacctgatgtggtgttcatgacccatcccttaagcatgcttgctttttttaactttactttttgagtatagtacttgtcttgtttttcctggagccatgctaggatttaattcctatgtgccactacccgcccatgtcctggaagatggccatgcctgcagcaatgctcatgtcttgaggagaagcaatgtgaaaagcatcaggaaagctgaaccttacgttcaagtcagcaaacatttgtgagcattctagtatgcttgcgaccttgacactttttaaaaattatctttttatttgcttcgagtatcaaccgtatagttgactctagtggggcgaagggagcagagatgagagcaaaattcagacttgctgcccctgtgtgtctcagttctcatgtctctctgagaaatgtgttggcccaattccctatctgccactctgagtctcttgagtaaatgtgtgtaaatgagaaaaattatctcaaagatttaacttattatttagatattttcttctttttaaactcaggaataaacctggtttgtagataatataatatggctactagagctataattgagtaggtgactagaagcattttttcaaatatatttcttgtaaagacatctactttgttttaactaggaaaagaaactcctcatattaaaataaacatttccataagcactttctagaagagtgtagcatccatctaccatccatcccagaatgtttgtatcttgctcatagtatttcaaaaatttttatgggtgaaaaaaatgcacttttttatttattggaaaagtgtagagttattgaattaaattctcaagtgggacaatttagtgtaaagggaaacatgggttttggagacaagagcacagggctgtggtccctgttccagcattgactttactatgtgacctcgagcaaatgatttaacttctctgtgcctcagtttctccatatacaaaatggggataatgatactaaccattgcctacctcatagagatgttatggggacaaacgaaataatagagataagcacgaatgctttcaactcttcggaagaaaggtgctatataaattgaagttgtgtttttaatgatccaattattaattatgtttagggtttaaataacaatactgttagtcatgttaagaataagttttgttttgatgcatatttccacttctcttctgtggccagatcttgatcattcaaccagtaatggtacctgaggaactgaaatgggtatttgttttcgtatgtttctgccagtagtatttcaattgaatatccagaaaagactggagtttaacttgtaatatcttatagtttacatgtaataaaacttattcaagctatatataaaagtatgattacatgtaaatagcaggtatgttgtaattaaaggcacttatcaaattgtctttgttcttttttaattgtaataaaagtcagttttacataaa

SEQ ID NO: 138 - DNA, 1653 bp, Homo sapiens
cagagactttgccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggtgagctgggcagggcaggggctggtgggggaggggtcatgtggccccaggtcccacctgctgggccctgggggtggggcggggctgttacaccccccttcctttcacatccacaggaatcccctccataacccaggcctggggactgtgggtcctcttaggggctgtgacgctgctatttctcatctcgctggctgcacacttgtcccagtggaccaggggccggagcaggagccatccggggcagggacggtgggtgaaggacaacagggatgggttgactgagagttctctcttaccgagaagtccccactcatcccctaaactctgcgttgcagctctggagagtctgtggaagaggtcccgctgtatgggaacctgcattatctacagacaggtagggagctggcagagaggaggggcacagaggccaggtcctgggtggctgggatgggggcgtgcaggaggaaggacaagttgctgaccagattcctgttccccgtcccaggacggctgtctcaagacccagagccagaccagcaggatccaactcttggaggccctgccagggtgagtcaactgtggctggagaaaagggggagggaaggaagtggggggcttttcgggcttttccgagggtccagtgaacttctaacagccttgcatctccaggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaa

SEQ ID NO: 139 - DNA, 14392 bp, Homo sapiens
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaaggtgagtgtccctgctctcccctaccagatgtgggccccattggaggagatggcagggaggtaggcacggcgggggggtcaggggccctctggtacagtgggatgtacccagctaccgtgattccagccaggtaaggtctttaaaaaaataataatagaataaatggcagaagacttaaaggtgaagtacttaatgcatgggcaggggcaaaaataaatgaattcatcaattgatacgtagatggataggatttttaaaatatgtcagctgccagtctttatggatttcagagctttgaacaacttgaaatgctgtccaggtgcaactgaaaatttcaactgcatctctctcatctctttgtctcttagctcttgatgcctctcatccttctctgtctctctgctcaccctgtcttgctcttttacatgtttctctgcctctctttctcccgccatctgtctgtcgctacactcagactctctttccccgcatctctcctggcctctgaccatctcccctatctctgtctcctccatcttgaccacactccatcgatctcctttcctccatctctcccgctctcttttcttgccttcccccacctgccttcccagccagcatccagcctagagctttgtacacagctggcgtttaataatagtaatgtcgccgaggacctttacattttatgagagtgagcatcagttctgttcaccctagtagcaggaggattgcaaggtgccggggcaagctgagcacttaactgaactttgcttgtatcgctttagaggagacccttggggcgggggggcagggagcacttcacaccattgtcaaccgtagtttagctgtgtggacctaccccaggactgcatgtgtgtgaccagagtccatattcaggaagcaaacaggttgttcagggctggggtgagctcgattctgcaggcttagcacagcgtttggcacaaagtaagtgctcacgaagtgttagctattagtatttctgtaaccaaattagaatcatgctatatattggttttgttcctgctttattcaattaacagtagtgtttttgaagcttactaaaaattgtttgaacacatgatctttcatgatggacaagactgtcctcacatcagcatgaactttgattgatttgaccaagtgccgattgttggacattccggttgtttctcgtttttttctataaacatccctgactgcttccttggattcctgaaaagggagttgctggggcaaagggggcgtgcatttttaaagtttatgaccctctctgctaattctccttccaaaaggttgtcctattttatgctccctctacttaagctaaccctaggtgagtattattatgttttaattatttcccaacatgacaggtaagaaaaacacattatcacattgttgaaatttgcatcttgtgattacttttactattcattggccattcatgcttttttttttttttttttttggttgtctggtcatgtccttactcctaatagggtgttcatcttatttttcccttattgatttgccacagctctttatttggaatggttattaacctttcatcagccattacatatatagcaaatattttccccaattcatcatttgctttttttctatttgtttatggtgttttttgtgatgcttatgatggttttatacagtcaaataggttagtctttttttctgtggcttctgtctctggttttgtgcttagaaagtcctttcctacttgaaaatgagataaatgttcacctatgttggcttctagtctcttttatggcttcattttttccatttactatagaggttaagagtgtgggtactggagccagactgtctgggacaaacccagcgtcaccccaagccctatgtgtgatttttagccaggcacttaacctctccatacctccatttcctcatatgtactgcaatggttataatagtaccttcctcaggagtctttgtttagattaaaatttttaaccacagtaaatacttagcacaaggcctgacacacaataaacccaagatcagcattaggtgttaaaacttatatcttgaatggatctgggcattttagggtatatgatgatggtgacatttcaaactgggcagggaggggttgttgggataatggactgactattcactcaataactttatcttctccctaattatctcagacacatttgttaaaccatactccatggtcctccagtttgaaatgccacattcatcacaaattcagttctctccatatgtgggtccatgtccaagctttctattctgttctcttccccagtatctgttcttataccagggccacactgttttgctgattgttgctttgcaatacaattcaatacccagccatgggtgtccctggcaccttgcccttctttattcttgattatttcaggcagcatcagttgaaccagccagagaccagcaaatgttcttatttgaggcaatcctcctctcgcacacatgcactctggctctccatgcatgtgtccatttctctcaatgtctctcactatctcttgttctctcttgctcgctctttgtgtgtgtctctttgtctctatgtatccctatctctcagccagtcccctggatagaggggcaattgtcaacttgaagccctgcagacacctaatgacttaaccagacagcgtagaagggccctggcccttgtctactccacgcctctccgtgctcagtgtagaagggcaaattgaagaccagagatctcagggcctcaccgaaatgcagcggcagagttgaaatccaagcctagatctcaggactctaggtgggaccctggttctggctctctccccaactgaaggcctcagtttacccctcagcacccagaagggggaaggggaacctgggctaccattcccccttctgccttctcacacgttggaccccaacttcccacaggttggacgatccacgatcacagtgtggggcccagcctcacaagagctgggctaggtgaggccccggactccataggtcaggaggcctagttggccagagcgtggtgatgatggaggcatgtcagtcagtcaggctgtgtgtccccagagctggtgctggtccccgaaaaccttgattgtggggcccctctagagagtctgatgatgggctctgtattggcgaaggctgaggcttttccagctccccccatgaggcccagaccaaaggcacaccagcctcaacctcctcctccccctgttgccatctctggcggagtggccatgtatttgggaacgttgttccagagtggacagggagactgaggccctagggaggctggctctgtttccaggcctggtaggcaagaggccctatgaagcagcaagctgcctgactttcagatggttccaaggagtttggacaccagggacactggcctacacatactgagactttgggaccgtagaccccacagtctgtggttttgagattctaggatcctttaaatctaagaaatgctgttctatgattctgaggtcctggtgttatactatttgaagaccccaggggtcccagtatctgtggagcctgcctggcactctcagagcttcaaacctgggtcctctccacaacccaagaagggccaggtcttcagagctaggggcttgtcatagtggccagatggacatcacctaccacatccaccagcacccatgtcaccccacctgggccaagcctgctgcaggacagggcagccagttctcggaacgaaacctgtggggtggggtatctgccctcttctcttcctccgtggtgtcgatgaagcccggcgcatccggccgccatgacgtcaatggcggaaaaatctgggcaagtcgggggctgtgacaacagggcccagatgcagaccccgatatgaaaacataatctgtgtcccagaaacatcccccattcagcttctgagaaacccagtcagaaagggacgtcccaacagacagtgcaggaagccggctgcccagcccggccctctaggtcctctacccccagacagatcatctccatgtccctgtctgagaatgtatctatgctttgctgagtcaggccatcccacatgtgtttggggagaattcttagctctggccaagtgtccaggcagcttcagaagtgaccacaggccagccacatgggccaggccagagtggtggaaaacatccatttgcaccgaaatcggtattagtttgttctggctgctataacaaagtaccacaactgagtggcttcagcaacagaaattgatcatctcacagttctggaggccagagtccaagatcaaggtgttgccagggttggttccttctgggggccataagggagaagctgctccaggcctctcccccagcttctggtggttgctggcaatctttgttatttcttggcttgaaggagcatcaccccatctctggcttcattcattcactcaccttctcatctcaccagtgctctcccaggcccttgttcggagcctccacagacccacactcctgtttctcacgcagtaatgttctaagcccccaggagactaagaacttaatacctggattctcacactcatctccctcagcaccacagctctgacaaccacccccaggaggtgacagcaaagaaaggaaggagcaactgctcccccagaacccttctatactcccccgggctgctctcagcagctgtgtgcccaactcagtgctgtgaggtggaacggggagatggagacacacacacacacacaccagagagtttataaaatgtgcacacggaaacacttcctaaagaaagaagtggagttctcaagtcactatgggactacggaactcggcatctgagcatccccttctgtataatggggttggctgggcagtcccttccagctctggcttcctctcagaccaggattataggatcctgaaaagccagtgcttccctcagggagtggaaggttctggggctcagcagggggcccggagccattgtggagggctttcaaggtgaggacaatagaagagcaggtcttgcgtggcttggacagggaaagaggagaaggagtgggcatttgaggcagggggtgtagcatgagccaggcttgagggccagaaattggggtgaactctgatgggggctgggtagagaagcttctacaggccccagctcaagagaccccatctctcctcctctctgtcacttgccatgctggatccgtgcatgatcacactcctggactcgcctccttgccctgagatccagacccccgtattcagctgccccctcagctcctccactcacatatttaatgccagactcttcatgtctatctacacctgcacttttgcacccaatccaactccccgccatgtcccccatctcaggtaatgtcagctcggtccttccagctgctcaagctaaaacccatgtcactttgactctccctcttgcccactacatccaagctgctagcactgctcctgatccagcttcagattaagtctcagaatctacccacttctcgccttctccactgccaccagcccattctgtgccagcatcatcacttgccaggactgttacaatagcctcctcactagccccactcacagcagccagatgaatcttttgagtccatgcctagtcactggggcaaaataggactccgaggagaaagtccgagaccagctccggcaagatgagcaaacacagcctgtgcagggtgcagggagggctagaggcctgaggcttgaaacagctctcaagtggagggggaaacaaccattgccctcatagaggacacatccacaccagggctgtgctagcgtgggcaggcaagccaggtgctggacctctgcacgtggggcatgtgtgggtatgtacatgtacctgtgttcttggtgtgtgtgtgtgtgtgtgtgtgtgtgtgtgtctagagctggggtgcaactatggggcccctcgggacatgtcccagccaatgcctgctttgaccagaggagtgtccacgtggctcaggtggtcgagtatctcataccgccctagcacacgtgtgactcctttcccctattgtctacgcagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcaggtgaggccctgggcccaggatggggcaggcagggtggggtacctggacctacaggtgccgacctttactgtggcactgggcgggaggggggctggctggggcacaggaagtggtttctgggtcccaggcaagtctgtgacttatgcagatgttgcagggccaagaaaatccccacctgccaggcctcagagattggaggctctccccgacctcccaatccctgtctcaggagaggaggaggccgtattgtagtcccatgagcatagctatgtgtccccatccccatgtgacaagagaagaggactggggccaagtaggtgaggtgacagggctgaggccagctctgcaacttattagctgtttgatctttaaaaagttactcgatctccatgagcctcagtttccatacgtgtaaaagggggatgatcatagcatctaccatgtgggcttgcagtgcagagtatttgaattagacacagaacagtgaggatcaggatggcctctcacccacctgcctttctgcccagctgcccacactgcccctagtcatggtggcaccctccggggcacggctgggccccttgccccacttacaggcactcctccaggacaggccacatttcatgcaccaggtatggacggtgaatgggcagggaggagggagcaggtgggagaactgtggggaggggccccgagtcaggctgaaccacagcccacatgtgccccccagctctcaacggtggatgcccacgcccggacccctgtgctgcaggtgcaccccctggagagcccagccatgatcagcctcacaccacccaccaccgccactggggtcttctccctcaaggcccggcctggcctcccacctggtaacacctcagcccgtaccccatggcttcacagaacccccaagtccccagatccttggctgtgagcagtgtaggctattctgaattgcagtactctgggggtcaaaggtgtcaggtctcagaggcttggaaactccaccctccaaaaaacgtcaggtgcagaaccttaaagatgcagaatgtcaaaatcacaaaaccacagagctttacaaagctagtcaaaatgtcagcacctgcgaatggccgtctttaagcttctctgccagaagcctgggactttggggacagcagagccccctgggagtcagggttttcgaggctcaggagggtgggaagctcaaaatgagaggccttgtgggccaagctccagagcccagcccacagcctccataggtgccctgtccccacccacagggatcaacgtggccagcctggaatgggtgtccagggagccggcactgctctgcaccttcccaaatcccagtgcacccaggaaggacaggtcagtggacagggctgggaaggatcctcgccctcctatcccctcccctgacaccctctgtccccccagcaccctttcggctgtgccccagagctcctacccactgctggcaaatggtgtctgcaagtggcccggatgtgagaaggtcttcgaagagccagaggacttcctcaagtgagtggcccaggcctgtgccagtctaccggccctggcttgtggggagaggtctagggtgcagatctcagctcaggcttcatcccaataagtagtaagatgcaagagctaaactctgagactgtgggttcaaatcccagctccatccctgactggctgtgtgaccttggacaaattacttagcttctctcgacctcagttttctcgtatgtataataagaaacgtttgtgctgttatttacccccattttacagacaaggagactgaggccaaagaggttaagtgtcttgatcaaaatctcccagttcctgagtgacagagctgggatttgaacccatgtagccaggctctagaatctgcactcctgctttgccctgctactcctcatgccaacatgccagccttattccactgttcccaaagttctagctcctctagatggctgctgctgcctcccctcagtccccccatatgtctctctctctctctctctctctctctctctctctctctctctctctctctttctctctctctcacacacacacacacacaaatacacaccacactacacacaacccttagcagcaaccccacatgtcctgtcctccttgcagccaggcctttgcacaggccgtccctccacccagaatgctttgcccactctcacctccctggcccattctcaactcaccacacttccaacattatctccagcactctggccaggctcaagtggtgagttcaggcctgacatgcagtaggtgctgaggggcatgtgttaagggaacgaggggtgtgagagggagactgaggtagagaggggaggggagctggggctcagaggagagaactcccagagggtctgggccctccccattcagagcattgagccagaccaggcctgtcgtggtcacctgcatggaatcttctccctacttaggcactgccaggcggaccatcttctggatgagaagggcagggcacaatgtctcctccagagagagatggtacagtctctggagcagcaggtaatgccagggcggtggagggtaagggatagggatagtgcgcaaaaccttctgtccaccatgtgccagaaaccaagttcacctgggacgagggctggtataaaggaaggaagaggagcgggcactcccagggaagaccgtagcctgggcaaagatgtggcagagaagggccaggctgaggcctcatgtttgtgccatttcacagctggtgctggagaaggagaagctgagtgccatgcaggcccacctggctgggaaaatggcactgaccaaggcttcatctgtggtgagcgaccccaggactggtggtggcagactcagactgctggggggcagggaggaggtctgcacggtgcagggaacctaacctcacattcaggtcctgagagctaggggcccctgtccccagctccaaacatgcccagacctggaaatctgtccccttctacttacaaaccctctgaccccggctgggcgtggtggctcacgcctgtaatcccagcactttgggaggccgaggcgggtggatcacgaggtcaggagttcaagaccagcctcgccaagatggtgaaaccctgtgtctactaaaagtacaaaaaattagccaggcgtggtggcaggtgtctgtagtcccaactacttgggaggctgaggcagagaattgcttgaacctgggaggcggagtttgcagtgagctgagatcataccactgcactccagcctaggcgacagatcaagactccgtctcaagaaaaaaaaaaaaaaaaaaccctctgactctaagatccccaaacactgtgatcctgagttgttaaagcaaatgcaaatagccagacttgccagatgcaggctgtgtgccagcaggaccagctatgtaacctgcagggccccttgttcagatttcaagatggcgaccacagagcattaaacaaagcacagggtgccacataaccacataggtcacacgcccatgaagccagccctggaggccaggcactgtttctgagcgctttgctggtggtaatttatttctcatgatgcgaatgtacagatgaggaatattgaggccaggggggtttaggtgactttcccaaggtcacagttgggtggtaaagagccctattcaaccccagttcatggtcccagcatcagtggccacatacgacatccgcacctgtgctctaataaatacggctcatgctgttttgtgggattccacctcagactggaatttagaagagggcgtccttgctttgaaaaacactgatttaaaaataaagtggagccaggcgcagtggctcatgcctgtaatcccagcactttgggaggctgaagcgggtggatcacatgaggtcaggagttcgagaccagcctggctaacatggtgaaaccccatctctaccaaaaatacaaaaattagctgggcgtagtgacgggcacctgtagtcccagctactcgggaggctgaggcagaagacttgcttgaatctgggaggtgggggttgcagtgagccgagattgcaccactgcactccagcctgggcgacagagcaagactcagtatcaaaaaaaataaaaaacataaaatagaaagtaaaaagtgggaagtttaagcctctgggtcaccagcctctccccctcacccaggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccaggtaagaatggtccttgcactacacggtgcccccaagctcctaatcctgacaggctctgggtggagggtgcaaaggagctccatgctgccccttcccaccaccaccaccactgcagctgccgccactcagcctttgggaaaatgcatccgctcacaaaagcttcctttcgggatgtccgtggcctgaaagccccccatatggtctcgagtgtcgggcccctagccctgactcccttggggattggggccatgcctcacccactctggactccagctactatattcggccatcagaagggagggaccctgctaagtaattccaggagcacctcctttcctcccctgaccaaggaaaatcggggtggattcgcccgagctcacctatccactgctctccaccaggcctggcctgtgggcttagcagggatcagagaccttgactgtcatcctggctctgccatttaacctcttgcatcctttggtgtgcaagttactccgcttcttttcaacctcggggagaactattttggcagaagtggtgcaaagaataaatgatacaacttatgtcaggtgctcagcaaacagtacctgtgcccgtggacacgggtgttgacggtgagatctcaggcctgtagactcaccttgtagggggaggggacagggagctagctaggaggtcctgcatggggcttgattcatccccaccctctgacagagttcctccacaacatggactacttcaagttccacaacatgcgaccccctttcacctacgccacgctcatccgctgggtaagcagggcagctcggccccaaggaggaggaagacaaagatggggtgggggacctgcctcccaaactcctgtctccctctgagtgccctcagagtgggttcctccattcccaagccccagccccaaggatccccaagccgtgcctcaaatgtgacccctcatgctggcttcaccccaaacctgtccgcaaatccaaacctaaaccaccatccaggccagagcatgccaaattctgaccctaaacctacccctttccagatgtccacctcagccccatacctaaccctctcctggacccataaaatagcctaaagctaaccccatctctgcaccttgccctaaacgtaccccagctcttactctaactccttccccagcctttatgccaacccaaccccatctccttccctggccccaacgtaccccagtatgtcaatacacccccaactgggcaccattcccaacctttccttgtaacacccatttgatccttaacttcatcaccccatcccaactccttcatctcagcctccccaatgccttctcagaaccttcatcctagcgccacacctaaccccaaacctgaacctcacccctacatgataccagatattccccgactgtctctgaactgaaaccctgacctagccccatcctgactgatagcctcactgcaatcatcatcgctgactctgtaatcccattcctgaatccaaactgatcaaattccctgaccctcagcctcactccacaccgaaccccacaactaacctcatccttgccctgagcctaaccacctaaccatgtccctgacacgtaagatactcgataattcaaaccatctctggcttctgacctaaagccaagtcatcccatccctcacccctagaccccccacctgagtccaccccagcctgactcttaacccaccccttccctgacccttaagttggcctggccctttaccccttccaaatccttgaccccacttctgacccttcaccttccccaaccctgaaatgtcacctccacagagaaccccaactccaactccatcccagacctttcacctcacttcagccctagccctgaacaagaccccactcccaacctcagtcctgatcccttacctaatcccagaacaaccatacccacacccatctaaccctgcccaacccgacacttcaccccttttctaaccccatctttgaccccatgcttcaccccacatctagtcctgtccctgattacctgcccctacaattccgcccccatgtcagatggctcggggtaggtcatagcccctctaaaccccaagtttggggaatgtgccccttaccccaccccccaacttccaggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccaca

SEQ ID NO: 140 - DNA, 23620 bp, Homo sapiens
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggtaaggaacttgaattttttttttttaattctgaaattgatctgaaaactttattttcttttcctttattgttattattattaattttttttggctaatgtcgcagtagaaacatgcttctgctttagtgcacttagtgctgtcaaacatttgtgagactttccttatgaatcattaaccctttcagttctagacataattgccaattcattgaaatttcagtagtggttccagctcacactcgtcaaactattccgggttggctgaagttttctattttattttatttttaacatgtgtttggcgtcatgactctacatgttggaactaaataaaaataagcaggtttgcttaaatcataactgagggaaaaacaactttgcatccaacttttttttttttaagagcatcctatttagagaagtggaagaatgtaaaaacctccttgaaggacttccacagaatgttatgtttacatttgaacaaacacacattcttacatggaaatgatacccatattcctcatttttatcaaacatgtctatatgagaaaacccttacagaagttgtttacctttttttgcctttggaaaacagtttttttctgagtgtgagggaggattttgggggaatatcctcatcaatgtacaagtggaagcagagcttgtcctccaagtcttctaaatttgttataactttagttacagtaaactgtagtacatcagtgacttctgggaattcatacactttcagatttaaatggaaagtgctatttgtagctgaggactcctaaaggaattctctccagggaattttattaaacggttttatgttttgtttttgccttttcaatttggtatgagatgcttgcaagtcagaagacactgcaggctgttttccccttcacccatttttcctcctcttttcctgtggtccaagtgatttctaagaggccgtagctcagtgatgctggcaggatgcaacccttttcagtcttccatgtgagaggatgaaagagagctcgcagcagagggaggaggcagttgttttgaaagttgttttgcgttgggagctggtgggaaagttcggtcttccccatttggaaaaggcaggctgggttccgctcctgcaccacacgcgctttccatttttagcttcattcagaggcagacagagctccttcctcttcctctccttgtttgtgacacttttctgaggcagcttttccacagtgccgagggtctggcggccatgaccccaggcattctgggacactggactgtgtgcccagaacatttttctgccatgagaggtaaagccagggattgttcagaggtgattctttttttttttttccttttccccacagtgaggttgccacattcttttttttttttttttttttaactaagagtagcatttaaaaaccttgcttcttttcaaggcagtttactttatacggcttcttggctctttctcaactgtaccaagcactctgcatctgcttttaaagtcttcagactactgtattagtcatagcctctcagaaggagccacaggaacggcgggacaatggggattaaaggcctttcctttctcttccaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggtaagcctctggtttattgacaagaagattggggacctggtgccaaatctccctacttgcccttgaggccttgtatatctctgaaaacctctgagaatctgtaagtatcagtaaataattgattgctctattcaattcttgcattgctttctctttccctaaaccatttccttctcatttcttccagccttcaactgttcctcactaattagtaaacagttaaatattttggcaaattggcatgtcttagaaaagcaacttgcagcatagggtgggtgaaattgtcagtgaacttcaagaaagctctgggcccactggccctagtgtccctgttgtacaatatctcttaagggagaaaactttttcttggaaaaaaaagttttaatatttcttttgtctgtctttggtaattagttggctttactctttttaacaagccagctttattagctgggtttctaaaactatcctcaaaactttgacgtgtttatgaagtgaagtgatggtataagccgagaaagggggtcatgtaaaagtgtcctctgtctggatgacttcagagctaaccactgtttatctgcagcagctcctttgctggggctgggctggcaggccaattccttactggcctctgaagtgggtacactctttgttgtttcaaaggggatgaaaacccaaacttggaatgagcaactgatttgtgtttacctttaatataaagattatagctaggcgtgatgtttagctgtgaaataacttgcagaaccacctcttgttttcagaatttggcttactgtagttgcacttactagtctactactgggttgagttgaatgaaaggacccctcagcagacttcccataccaccattagcacagagcactgtcaattctattacttccttcagaaagtagggaaaggggatggttggccgtagaaatccagaatttgctactgggactattccttacagccgtgtcaaatcactttcccccttccctaaggaacagtatttgaaggaatccgggagactaggaaatgctttgtctctttcctgtttgtgtgtctgagtccagtgtttttggtgagggggagacacagctgtctaaaattaaatagaacaacgatgctcagtctttcttttttcccccactgctgcgtgaatggaggcagattttataaaaaataaaatttaaattctagttgtagttgaatgttaccaaaaaatttaaccccagaggtcagccttaattatacctcttcctgaaagtaatgctcttcttatagaaagtctctcaatatgtggcccttggaatgaatgtaggatttgtttgggtatatgaggtttgactatggctttaaaaagtgtagtgtgttttttccccatatcaagtttgaccaaatattcgtctgttcccaagcttcgtttgtgctgtgttgccctgtccagtcctttgggactgaagtaaaaatctccattctgtgggtcatctttgccttttaattctataatgttcttatcgtcagttcagctcttagcttaagtttttcaatttccgtcattctcctttaaaatcatagctaagtcaagtaatgctcttagatcatttagttcaaggttcagaaagacagtcacttacccaaaggcatataggtaaagccagaccggggacttgaagcaaagcttttctgacttctccaatgagtgcttctcgattatgctacactggcccctcttggtgtcactgtggttttagttatcatcttaatatatttcagaccaatccttaagctattttgtgtttttttccctctgaatgtataacttcctatttcaatatattaagcaaccaaaaaacagacaatgcctgtgttcctgaagaaggtccttcgaaactaacctaagaggtgagggttctcttatcctatttccctatcttgcatttaactgaagcgcttgaatagaggatagtatgtctttaaaccctaatcataaagtcaagcaaggagtaaacttgaatgtaatactgtcttaagcttactctggaatttgtacctgtttttctgtttctctcctttgtttttgaactttgggaaaggacagcttcctttagaaggtgaaagaggatggtggagttgagccattaagggtaggatagctgcaaactagttccgggacagcaacattaaggattgatgaaatgtttacattatctttattcagttagttctttaagttccatgagccattgaaataggaagagtctttctacatgtactttttatctgacttattaatcttgcccttctttaaatgttttcgtttaaatagcaaaagatgttacaatatgtactattgtgctgacataccggggaattttttttttacaagaccatttttcattatgaatttgtaccatgtgtcagcaccttttttttttttttggttaaaacaaaacatacaaatcatatttctgatcttgaccctcatttttagattgggtttagaatcattctgcacctttaatgaaaaactgttcttacttcctatttccagaactgaaatcaaatatagacctactattcaaaactttgaaaatgttttaaactgatgggttattcttttatgggggttttccccttgtcctcctgaaataatctcttatgactacttgactacagaaaaatcagttcaagcatttatattttagaagcgttaccctgtagagtttctgccgtcggttgagactgcttgcactcaagaggcactgtggctctgtgagtctcacctccctgtatcgtggctgataaacatcagacagattgtgaggactcctttggtgtccattctgatcgaaatccattattaactcaagccatctgtaaaaagtatctcaccataacatgcaattctctcttcatgttgccttttatttgagaaatgatgtaccaaggcatcaccatgtctcctttaatagaaagataatgaagaaggaaaccttctccaaacaactttgttcacttcactccttttaaaaatggggtgattgccgggcgcggtggctcacgcctgtaatcccagcactttgggaggctgaggacagcagatcacctgaggtcaggagttcaagaccagcctagccaacatggtgaaaccccatctctactaaaaatacaaaaattagccgggcgtggtggtgggcgcctgtaatcccagctacctgagaggctgaggtaggagaatcgcttgaacctgggaggtggagtgagccgagatcgtgccattgcactccagcccaggcaacgagagtgaaactctgtttcaaaataaataagtaaataaatgccattgcactccagcccaggcaacaagagcaaaaccctgtttctaaataaataaaataaaataaaaatgaggtgattgcaggctgaaggtcttggtcactactgagttctagttctctcaagacaaatattcatatggtcaaaacagaattataatctaacgagtcattcttatagagtgggattcggggagggaaaacagatagctagtaatttaaatgatcttaatgtaatttggggagaggatgatcagatgacatttagacttggatatagtttctgcttcaaacccacgctgtgtgtgtctgtttgcatactctctaaagaaggaatttgaaaaaaaaaaaaaaaaacaaacctatattgtccttgttatcagccttccattaagcgctccaactcaacccatcctaagctgtcaaatctccttcattgtgtaaaattgaaaagaagccctgtgttttgtccggaagctgtggaaactgtggacggcggggtgtgttctgtaactgaggccacagacagaaacaaatctgctcaagtggtggaggggtctgcaccgcacataaagagcttctgtgggagcaggtgaagcaaggaggtattgaagccgggtgtcctcttgctgttgagtttatagaaggcacagagcggcctgtccccagcagtaattctttaggaccctggtcagttccagtgaagtttccttcttgagttaggtgaacacattctttgtctttttagcactgtgaagtttaagctacacaccaagttcctccttagtatttgcttggttcaaagataaactgttacaaactatgggtcagggagatgggtagtctaagatgcacattctggatctttctaggaccagagggagacttagtacttggttttttcacttccctttaaaaacaatcctggttcctgttccccctccaaagttacctggacaagcaccatagtcttagagtttcagcttttatggcgtctgtgtctcagacgtgcatttgagatgaagatgtttactgtatattagaacgctagacttagaatggatataggtggtttgtaagtgccttccagttttgaaattttatgattttgtatctttatctataggtgtgagtttatatgtgccctatagcactgtatgtaattgaaatttaaaatattagggcgctctgtccctttcctaatgataagctaatattgaagctctttaatttgtctggggtttgaggattatcatagacctctcttctaccacagagccttctctttttaattgttctcctgtcttgcctgttgaattgaatttgtaaggttagagatggcaagagctacttccggtgctgctttatagcttactagtgatgagtctatagttgtgctcaaataggtattgggtagcttatgctttctagttgacttctttttgggcacaagaaaatgtgtgtaagatggataactgaaaacctagaggcccattctgtaaaagaatggcaatttggaagaagaaccacgacctcagtgcagtgctccgttttggtaatcaagctctgactcccaagacaccatctgtaagagactataatttaaaacaaagttgatgaaccagttgagtgcctttcttaaaattactgttgtaaagtagatatgttgaaaatatcaactgctaattattggctcaccaacaaatggcatgatttgtttttcctgtttgtcattctaatattatggaataatcactgaaatatgaatgttaaatgatttgcatgtcatagaattcaattccattaattttccaaattaattagattcaataataatatgtccaaaacaatgagcctctgaataagtctactaaagctttaaatatatatatttatatctcaagactgctctgagatactcttgtccccagtagttttactgccaacaaataccaataatgacaaacggtgattaaaagggcagatagatgtaaatgaaggcagaggaggaggatgaaatgaacatctgcttttttcagctctctgacagaaattcttaaaggaccaaaaataacactcttgtttcaacttatgttaggtgtaggaaaattttctttttttctctttccagtctgagtatgcttcattgatttgtatattgaatactaaattgttttagaaaaaaaaatcattggctgataagacacttaaatgagaaaagctagtctgtcacaggcatgtaggtgtgccatatctatttaaatagaggtttaaattattgatgagacttaatgaggaactggtgtatattgtaaccaaaattgtagattccactgtgaacaatctgtgcatggatcgattcacatatttgagtctaccatttcaggtacatgaatgtacaggagctactgggaatataaaaactggaaaataaacattatcatctattaccactccctcctccttggtccattttagtaaagaattcagtaaagtgataggtaggctatcttgaatgagaagaaaataaaactaggaaagtgagagaataaaaaccaaaacaaaactgtaactgcaaactgttgtaaaggactactcacagaggagttctattgaatagtgacgaattgcttcctgattcacggttggtgatttttttaccccttcaaagagaaatttattattaaggaggaactggtatagttaacatgtttctttagcaaggccccacaaagttaaaatgtgtgatgcatccagtctgaggtcatttcctcagatcttagaacctacagctttcctccgtataaacttaatttcaaaggagggcttttggccaggcatggtggctcagcctgtaatctcagcactttgggaggccgaggtgggaggatcgcttgagtccaggagtttgagacaaggctgggcaacatggtgagaccccttctcaacaataacaacaaaaattagctgggcgtgatggtgcatgcctgtagtcccagctactcaggaggctgaggtgggaggatctcttgatcccaggaggtcaaggctgcaatgagctaagatcaagccactgcattccagcctgagtgatagtgggagaccttgtctttaaaacacacacacacacacacacacacacgagggcctttgaccactcttgagtagaagactcgagaagaacaaagtagaaggccagagaagaacaaagttacttgaaagatctcttattaaagagaatgtacaagctatgaaaaaaaaaaaacacacacacacacacaaacctcatctggaatgaaaaaaacataatgcatttggtttctggttccttaggctgttatggaacaaccaaagaacattattttggtttctgaggtcagaactattttattcccctcaagcacactatgcttatggtttgagggagaatgagaaataggaaactaggaacaggctgaaatggtctaatcttgaccatctaattctgcagtgtcttattctcattctaaaagagaatggttatattcgctgttctagcataaaaagtaatgataaaaataaaagatcccgtattaccagacaataatcccctagactgttttaatgcttggttgagtatttgcttatgatctcagactttaaaagatggtctccccctatggtgaagcttgttaattatgtaggcatcattaatgtctgtttacttatcaaaattttatcattgttagttgtattactacttgacagtccaatttatttaattgaaaagattggttaacattttatagtcaaagtaattgtttcctgtgttttttcctgtttaggttattggagtgatgagtaaagaatacataccaaagggcacacgttttggacccctaataggtgaaatctacaccaatgacacagttcctaagaacgccaacaggaaatatttttggagggtaagtaagggaaatttcttcagacccattaaatgttaggaaaaaatggagctaaaagagctgggtggctcacctttctcatcctgtgctgagaaatgctggggctcacccataagtatccagcatccccatggacacagggaattctgaacaaatgtgatgaaaccgatgaaatgtctggcctgtaggtggttagtgatggagatacgggctatatgtgaatcttgatttttgcaattcattagagctttgtaatgaaaggaaacagtttgttgcttgctttaaggataggttcatttgcatttctccgcaaggaagtagtaatgagttaccaagccttagatttcacccctttttgatttcttgctgacttaactttaattgaatggaagagttatcacaaatgaattatctttttggtttttttttttttgagatggagtctcactctgtcaccaggctggagtgcaatggcatgatctcggctcactgcaacctccgcctcccaggttcaagcaattgtcctgcctcagcctcccgagtagctgggactaaggtgcgcgccaccatgcccagttaatttttgtatttttagtagagacggggttccactatgttggccatgatggtctcgatctctggacctcgtgatccgcccaccttggcctcccaaagtgctggaattacaggcaagagccaccgcgcccagccaggaatgacaaatgaattaccttataagtaaatgccattaaggaaggatagctggaagatgggttgaggggaatggaggaccacagaactagtcctatttaaatacatgtgcatggtaaaatgattccatttgacaataggttaattatctcatagcataaggaaaatgcttaacagtcatatgcaagatgataagctttcctatagcatccaaccaaaagatctagccagtacaatttcctttgctatattagggttagaaaggcccccagaggtgaaccaattagatggaatccttgaataaaacactggattagcagtgaacagaaaaaagtcagattgctttccttcttcccatagatgtctcagggatatttagtttcctcagaagataaagaatttagtaagcgtttttttgtgcatacttacatgaaatgtacattatttgaattctttaaaaagaaacagctgcatgataacaaaaattgtgttatgcttgctttagctggtatttttgcctagaacgattatatcgttcggacaagaagctattcctaagaaacaatatttttaatccaggaagtttttcatttttagaaatttatcttactatttcccaagcaaaagagggtagttacagattcactaagaatcatgtgctcacaatttttatttaataattattcctccttaaaatatattaatcacctgacttacaatggtggaaccatgagtgcatttttgcctttattgtcaataacgtcttctcagaagtgagccacaaaggtgcatagttcttggagttaaaggtctgaattaagacaatccagcataagtctcattaatgtgtgattattttgagaaaaggcaagaagtacctaagaatctccccctcactgtccagttccctgtttcatttaaagattcactgtaagtaactgaaaggctttccttgggaggatttatttgaatcagtctttcacatgcaaaggatattgtagaacatctcgtttttgctggcaggaatatgaacatctgttgtgaggaaagaaaaagtttcatgcaaattacactgccaaagaagggatgttcaagttgagaaaccagtgacatttcttgtaactgtactatgaatcagcgcattttaatcttctagataatatatggaagtgcaggaaggtggtaggaaacggtgttcattttacatatgcgttattttattctgtgtgagtgacttcatggcaccgacattgctgtttttaaatgaggatacagtaaattgcagtccgaggaaggctaactggaatcaacatacccgtagctttagaaagcagtttccgcaccagcgaagagtacaagagcgatggaaccccatgttcctggaagtttgcacatcagagtaaacaaacttgaaaacccctcttgatagcagaattcacccagccttgttccattttctcttaacaaaacacaccgcaaaagctctcacaagctgctttgatgaagccacatgtatttcccccttcacaatttacaggaagttactcttaaaagaaagtgattctggtgtttaccgcctgtgttaaagggacagagttcctttttatttctgataacgtttgagcgaaatacagaaactatctgtagactagcatagtcggtacgtgagtaaggaaaagcaataacctgctgtccggtgagcacaaaattcctgctacgaacagtgccttactgctgcttggagactgcaagtcgcagatcacactaggtattgactgattgtataaggaaatttcttaaagtctaaagtaaaggtggtacctcctaaaaagaggggaagagagaaaactttgtgtggaaggataaggagtgtgtttatagtttcagtaagagtgtacgttttaatttttcttcttcctctgcctctttgccaagtagcctgagtgcatctgttatccagaagtagtattactctaggacaaacttcaaattcttcattctgcgttgcctttaaggaacaacatactttcttcctgttctttttccaaaaacacacgcctatggctctgtgtgtggtgttttagccagcctcctcccagataaggggttcccttccctcctttgcattgaaaggaaagtgcaagtctggacatgtttatcaagaggaaaagtgacttctcagtaatagactgtcaaattcgggctgctgcccgagtgttcgctttgttatggcaggtgaagttcacctttgccccacccagtgtttccacaaaaaggcaaggttccaagtattcatatgaacaagtgttactttaggacttggagggttgggggtggaggatgtttgcatagttgaagccttgggcgggggtgtaggaaacggcgagtacagaggccatagaaaaagctaagactcagtttgacgtcgtcagccggcttggtcttctacccagtgactcaaagcactaaaagtcagcataatcggaactgaagtcagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaaggtaactgacaaaagtgtgccttacctgtttccgccctgatttctgctgattcaagactattctggctaaactgattggattctttttctaactaggcagtaggggatcagaaatcacacacggtaccggctgtgtttattctgagaggtgctggggagctttgggtctgacttccttttacatgcctgtcttctcttttggacagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcagtaagtggattacagaacaaaaaaataaaaaatgccagtaatgtcggttctgcccctttgaactaataacatgttgtttaattatacggctttgtcatgtgttggatgaagtaggtggcttaagctagggactaggaagaggaaaaacattttttgagtccctattaactattaggaaacttgatcatttaaaagtatatatatatatgaggagctaccttgagttttgaattcaggatgttacaggaagaaatatatgtccaattctaatttatccaaaagcagttgggagaattacagggattggtccagacatgctgcgtatgcaaggtatagccctcatctgtggtactttggcagggcttagactgcatcaaaatatttatagatgtacatttgagtgtacagttaggatctgatgtggaacattgtaagatcattgctagaaaaactttgtcataatttttcaatattattctaagtgaataaccgtaaagattttacatcttagcttccttccttacagtaaaaaaactatctgatctcttgatcagtattatagtagccacctatcactttatcttaacaaattctcaattccttaggtttatgtgcttttacttcttttatttgattaaaattgctgtcatgacctctctctgcagagggctgcatcattttggtcattctcaagtgatctctttgagcaatttaagaattgccataagattctaacctctgctgtaactatggttgtgtgttcttggttagaccactaaatcttattagcagttttaaaaattattccttttggtttagaagttaagactaaatgctgaagtttttgtaacttttggttttgatatcatttcaaacttaagaaaacatttgaagaaaaggacaaagaatttccacttaccctttacccaggtttaccagttattgataagtatatccatttgctttaccagaaggctaacttgttttagttctcattttcacctttgagacatttggaataaatatcaatgttaacataaattggaattttgactttgattttaggaccaatgaacaagccaagtacttaccctagtcatatataatccaactgtatggttatttggtattcattccacacttcattttacttgatctcccttaagattgcaagattgtgtttgcagtttttctgaaaatctggggctataaaagcatcaggacctcccccgtaggggaggtcgtgtgtttggggtccttacacaacaggttacccttgagcttcaggaaaagaactggctctcagttccccagttccagcttaatgggtctaattaggtcctgaccaaaaaggtggcagttcttttccctcatgtctcttcagcgctccccgagactctggagactctgtcatatccctagggctgagcctcccaggaaccattcggctgttgtggcatctgtgtatgccatgcccagtgctgaggacctagtaacaaacgacaaatgcacaggcacagtggcatttttgtggaactcgtattccagctgtgcgtctcagaagaagcgcacagctccctcctggctttcttaacatagtgagccacttccacttaagggtctccttacattccttgagtttaatcattcatggattcagaggaaagtcttttgatttttgcttttctttaaacagttcatttgaggtgacctaccccagtgactttgcaccaaccaccaagaaacttttttgcatgcttcccgcaccctgtgccaatcaagggaagggtttaaaggcctggcgtttttattcctcaaagaaaggttttgcacagtattttaaggttcaagtgcttctactttgtgttcagaagcaactgtcatatatactgtgaaatgacaccttttatttatccctttttatttatgcagtatgtccccttttattttggcagaattttttctaaatggtggtttaacattttcaagcacatttcattgtccaatattcatagtaaagaatgagagttaacaataaccagtcacattaaaacaagattcctgctgccagttgtgaaaccggttgtcttaggcgtggcagctgatgattgagactgtgatcaggaaaatttccactatttcatcaggcctaataggtagattgtgtctccaaatgaactgtgttgggtttccatgcttaaagcacaatagaggtggtgcaagaatctccatgagggcttaaatggcagtgatggttcaggcggtagagtttggagaagaagggatttgaaacaaaccaaaggaaagaaaagtaagtagccagaaatcacaaaatggcatttttctaaaaacaaaggaaaaggaataaaagaactaataagtttgaaacccctacccctcccaaatttggcagggggggaggtattttttttctatctatctaactaacccatctagaaaacagttgaccaaattatagacttctaaatgttaatctgctttctcagtttcagttgaaaagagactttgttttgcctactgcagaacttctaggttctttcttatagtcttggggttcttattatagatcgaaaatgtgagtcggcataattaagccattcggagtcttcagaagcagttcactcttgaaatgactccgtccgcctacagccatttaagatttcagaacaaaaacagatcttgattttctttttcatgttaactcaagctgttgctgagtgggagagtcagaaatgacaccagctccactgattactcagctgctgaaggatgattttttaaaatgcacctttactgtatatggacttcctaatttccacctgtagagcatcttagggaggctaacatgtcactctggatgttcttttagaataagatgcaaatctatttttctgaaggcattagagatagcaaacatttattgtgagtttactatatactaggcactgtgctaagtgttttgcatagaaagtttaaaattctggcttttttgttggcccaatcataagtttcatatcagttcaacattcaaattatattaaggtacttaagaagaatccctggctaaatgtgaggggcagtgccacagatggactgaaactttatgcttattgcacatttatgctattattatttgttgaattatagaaccaagggagtgtggaagccactggaaaaaatatgagacttagatacataatttgagtaaaaatggctcaaagtcatgagggtaaagttttttgtatttccattttattcgagcggcatcgtttttaaaaatcattatgaatttgaccctatatagatgtttccaaataattctttttcaccttcataaaattccttcctgtggctgtgagatgccttgcctatcagttttcaagcttagttgtctttctcatcctttaccattttagctttaaaaaacaaaagtgacaattagaacttcctgcctgctgggcctcactgaaagaccgatattggcctgataaggagatatttattttgttttagtggcttcagaaatccctctccctcagcaagctttccatcacggcccccccgtcagcatcttccctgatagcgttcttctctgtgtttattctggggcttcaggctcgcccaggaggaactgataaccgctggcaggagataacattctctaaggggctctcaaattggaatcgaatccctcaagccagtcagcctagagaatacatttaaagggttcagttctggagtttcacagagttcatttctagacctatcagatagcaagtgtggagttctttctcaactaaattcaagcagagacattttttagacgatgaaggatatttgcacaaaggcttcagcatgatcccccaaacctgctgcctctgaaggcatctccacacattgacagccaatgccttcagtgcgttcctagggcaggtgtcctggcttgagtgactgtcctccaataatcagagctcaaactaaacatcgtatgttttacttttggtttccaggcaaggctgagcagggaattttcagttttccctgcccagatgggtgttttttcctgaaggcatcatttattgtgtagcgaggagacagggctggctgtggcagggatagtctagaactgtcctcattgctgctgttcctaaatagtatctttaccaagtaataacgtgccgtctttgggaataagtgctttcctcttagcctgttctgttttcttgggtgcgctaagtaattgaactggctcaggaagtacctattgtggtttggcagaggtgactgtcacgccttgtgactccaggggccagcactgctgggatcctggctagaccagacagagccttggtgaagtgcttaggctgtctgcacatcgcgaggaaggtggtattcacttcgctaagctccttggcataggcagtttgaacagggctttatcaaattcgtattcaacaagagtagaagcgaaaattgatgactgtgtattacttgaaatgagtcttaatctttcacatttagttctcagggtatgctgatttcctttaggtaaaccatgaacatcagaaagacttttattaacctatgacagggtccccaccccagtatttttccactccattaaaatggaagttttttttttttttttcttttttgagacagagttttgctcttgttgcccagtctggagtgcaatggcacaatctcggctcaccacaacctccacctcccagattcaagcgattcttctgcctcagcctcccaagtagctgggattacaggtgtgcgccaccacgcccagctaattttgtatttttagtagagatggggtttctccatgttggtcaggctggtctcgaacttccgacctcaggtgatccgcccacctcggcctcccaaagtgctgggattacaggcaagagccactgcatccagcttaggctatcttactccagcctaaacagcaattttctatcataaggtctgtactaatgaaaacagaatcacccaaggctgctgtttgttctgtctgtgctgccattgtccgcattttgctgaggaggaaacggaactgcacttttgagtgagtggcccagagccttctagaatgagagtgcgttggaagccagatatgtggcgattgtgtcgccagctgttactcaggttttctcaagaaggaggagcaactttggcagttttgcttcagttctctctagccctctgtgtaatcgcccctttttctttatttcagcacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtaggccttgagagagagcagtccaaggggctgtgagtgcatgcttgtgtttgtatttagcttgctttccatggggtatcgattgcatttgcagtagtatgagcccccggttggggatagtgggtatggattccgcctggcttttgccacttctagctctttgactttggacaagtgacttcccttctcctgattttcttctgaataataaaaaaattaggggtttggactagaagattaggtgaaactccctgctagcctgtgatttttgtgcttttaagaaaaacaccattctgaaaacatgaagatttcttctttttaagactgtcttgatgcttttcttaagatatttgcatcaacacttgagtcttggagcagaaatgttaggtctcagagccagcttgagagcagagctaacacatgtggcttcttcccaggtccacctgagagtgcacagtggagaacggcctttcaaatgtcagacttgcaacaagggctttactcagctcgcccacctgcagaaacactacctggtacacacgggagaaaagccacatgaatgccaggtgcgcagtattttctgggtagaccttctgacctttgtagaaaatgtctgtgagtcaccctcccatgtcctatatagcccgtagttaaagccaacaccagattctgcgttgtcccatcctggactgatggcactatggtccttcccagtactttgtatctgctgatgacttgagatggcacagccagcttccagtgggtgggaaaatggtaggggaaataaacagcccctcgtgtgctgtgtgcccacatccccccgtttgcttaataccacactggaggtgccacaaggaggcttctcacctcctaggttgctgggcgttggccggtaagcctgcccctcccgttggcaactcttaatcttctggccttcctgtctcccttccctgctgtctctctcccctacactgtaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaat

SEQ ID NO: 141 - DNA, 24552 bp, Homo sapiens
caagagagagagagagcgtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggtagagtcctcctttttctctctcctaccttctgattctcctgggggatggaaagagagccaggcttccttgtcctgcccagggagctgaggatggaggaagtggctcgttgcacgggcactctgttagacttaggacatggaatttgctactaagctgtgcatattggcagagatcctcatccttccacccattctgccaaagcccctttttctctccattttccaaggctgcctatcacctctgcctcactggggttgccaccctaaaaagctttctaggaagcaaagaggaggatgaacatcaaagaatgcagagaaaagagtctactgttctccaaggctgtagaaaagtgagaggagttttcaagtgggccgctggcatgcacagctcaaatcctagatatgcagtttcccaggagacagccaatagggaaggggagaaaaggggttagggaaaagttaaaaaaaaaaaaaaagaagaagaagaagaggaagaaggaggaggaggaggagaaacccaggctagcatagaaggatctctctactggggcactgcctctgttgctagcacagccagcaaggggagatgctagaggtccagccaatatctctttgcttgtggcttctggataggagcaaggaaatgaatgaggaggtggctctggaaatttgttggaagacatttgctggtagttcatcttagctctggggaaaccagagagactgagatagggattgtgggagcatttggagtctagattgtgacttccaagtccaaaggttttagcttgaggattaccaaaaaaggagtgccctgcccatctcacagcttctagggttttgttctgcaccacactcttgacatcccttgctgtaggaagccctcctctttctcatccgacatgtatccgtgggttaaaattttctcaaccttcatagtttaaaaacttcattctttccttagcacagatatccacaagggttttcaaaatgctgcagccaaaataaaagtatataaatattgaacagggcgtatatcctaagcctctaataacggagcagcaggctgggatgagtctgggtggagacctctagaaggcacagaatccagtctgctgctcaagatggtgtcagagtggctctgactgcctggaagtttgtacttttcttaggaaggaaattactcatggcttccatggtaacctggtgccccatcccccttagaggaagagcacttccttcctatctatgccaatgacctcctaccacaaaggcctgaaagtattggacatgttggtgagcccagtacttagtgatcccagagctttgcccttggatctgtgcccctctagcctgtgggagacgtggaagggaacagggcatgagttgccaggactcctacacctacactgcagcatctgggagagaactggagctaacctctctgcccaggcacaggacatgcctctctctgggtgtaattagagaacacccaaagatccccttatcctaccaagcacccatctactgcccaccacagccaggtcacctccaccattaacgttctttttggcattgatgtgccaggcattgtgctggggccatggggaatgtcacagtggctgagcacaacggaaggaaagaggaggcagatctgggatgcaccctcagctcaggaatgcagcagaagaccacatggggtgcagagtagctagcggggaagggtcttggaaagccattgggctcagcaccagaagatgtagcactctcagatgaccaggagtccttgggcacactcttagagcctcagtttcctcacatataaaatggaaatgatgatatcaacttcacagcattggggaattaaacaagagcacttctgaaagaacacttgcccagaggttggcatatagtaggcactcaacaaagtctgaaaaaaagaaaacagctaaaagaacagcaagaagagcctaaaggccaaaaagtgagagggcgagggtggagcagccctacagaggagaggtgataaaacacacttcatcgccttaaccattttttttttttttggccaaatacagctctattgagtcctcaagttctcttttctttttcctgtagctattggtcaaaaaagtcagagacctgggaatgtgtaagcaggcatggagaagagctctccttcgggtgcaggcttttggtaaatagagggatggagggttcatgcagagacgaaggcatggaaggatggctggacggataccacacaccaccagagcctgctttcactcagaagggagatgcagacccatgtaatcctccccgtctctgcttcccaggactcatctgatgatgtgagaagagttcagaggagggagaaaaatcgtattgccgcccagaagagccgacagaggcagacacagaaggccgacaccctgcacctggtaagtgttcagatcaatcttcatcctcgtgagctttaggctttgccctccgccatctgggaacccttggaccatagctttgattctgcttgtgtggggatgtgtatgtggggtgggttagtggagggtgagggccgtggggtgaggtagggaagggaagctgtcgtgagagtgctttaagaaggctctgtagtccgggcgtggtggctcacacctgtaatcccagcattttgggaggccaaggcgggtgggtcacctgaggtcaggagttcgagaccagcctggccaacatggtgaaacctcgtctctactaaaaatacaaaaaattagccaggcatggtggtgcatgcctgtagtcccagctacttgggaggctgaggcaggagaatcacttgaacaggcagaggttgcagtgagccgagatcgcgccattgcattcaaacctgggtgataggagtgaaacttcatctcaaaaaaaaaaaaaaaaaaatagaaggctctgtagcagggaatgggccaggaggctgaacagagaaatgggcctttctaccccaggagggctcaaggggtgggagaaggcagagctgtattgggaaagaatttagaaggtatcaagtgctttggggacggcccattgtctcgcagtgcaaggaccacacatagtcgcatcccttggcagagacccaaatgcccctgcatttgacacaaggaaattcacagggcgctgtaccagattcctcttttcagagcattattaaagtcttattttgaaatttctgtctttaatggtatcccaaggggtctatgaaagatgcaatttcaagtgcccttatctgggatgatcaccatcctagttgagttgcctctagtcccaaatttttctagagaaagcttttacctctgtcttgagtggtccaggggccttgagcagtgctgaactgcagttccgccagtggccaaggccctagatggtgtttctaggttctggctgtgccccttataaagtactgcttcctccccattgctcataccttaccaccttacctctcttcactctgcccccagtatggttcttgttcaaccaactcttcactagttcctttctctccatcccctcatccccttccctagcaactctaccttcctgcccttgctccagaaacattcccttacctctaatagcctagcaattcctttccatggaaaaagtgcaattggcaccaaaaatcaataagcttgtatttatctggaagattagcatgataatcagccagttagaatggctgtgttaaccgtatcaagaataagtaagtaagatgtagttttaggggaaataatgcatctttcagctttacaaggaaacagagcagactgcaccaacagctctgattgggtgcttgggttttatttgaaatgtattcagcttacactccattgcacactaacattaaattcacagctatttgttaactttttggaaagaatgaatgaacagaaagtctgtactaactgtgctcaacagtctgaatgtcaagtttttggtggccctgctgcttgtatgttctccatgatttcactgtgtccccacattctggtttaccaccttaagcttgaacatctatgatccttacctctttctctatcagagtctgattctgattcactattctttagggcaagcaaacagaccaatcaaaatttaaaaggataaaatcttccttgtgtacaagtagacaatgtcctcagactggcaaactgctgtaagctttttaagtgtgtacctgttttcttaagtggaatgtaagtatagttcggcagctcagcagtcagaacagggattgaatcccagccctgctgcctactatctgtgtgacagagacgttcttggcctcccttgggcttggtttccttatctagaaaatggaaaatgacaataactaccctatacagatcgtacatttaaagagcccaacacaatgcctgtcattcataaatactcaaaaatttaagtataataagagtaataataattatcataagaagcaagataatcacaaattatacacacattttatatatatatgaaaacatatatacattttgtgtatatttaatcacagaagctcagggttgaaaggtttcttaaaggctagaaagtttagacataagtttgatgcttcagacttctctgcaacacctccagccaatggtcccattgtatgcctggtcacttctagggctggagatcttcctctctcccaatttatgaacagaagagtctttcctatgttaagctgcacccctgtctccctgtaaattcaactcactggtcttcatccaaacccttggggaacgtattaatgagggtgacacagatgtctctttgctgcggcaaggctttcagcactgaatcagctctctccctctccaagacaaatgtcagagcccaaagagtcagctcatctaattatacaagtcatgtgacattagggtaatctctagagcttgagggtccacagagccccaagtcatatagtcaacatatccatagccacaccccagcctcagtttctagaatgttccaatcttccccacatctgaacacagattcctcctccactgctttcttttgagcaccacagcatcgtctttaccttttgcccaatgagtaggtcgcagcggagttgatgcagcaagcctgcggactgctgccaatgcaacttatgtttcttggcttcaggtagaagcttttggcagcaacgtgttcaatctgccctacatcaaattagctgtggtttgacatcttcctttcctccgagatgacaatcacctatcttctccatccattatcctcttaattatgtctgagattcaggtgaaaagtcttctggtttaccaccagtgtcagggctcagtgtgtggtttgcccttgactcctttccatgcttggctccacatgctggggttgttctctggccctcagacatggccataggcctcgcctaccagtgctttacagatgagggtttgggagctactgagagtaccatatcaaaaaaggaccacattcctattagggttctagcctcatatatactggtatgttttcttagtttcaactgctgtcactattatcaaccttaaaatactgaaacaattatcttgttcctctagtgagagtgtgggatgcttactattcgacattttcagcatctatcctataaatggctggcaccaagacactgtacatcgattgctttaaaaattgacagagtagggagagagcctctttttatgattgtgttataaatccctggccttgactatctctgacataaaatggatcggtgattcctttcgtaattgtgacatcaacaaacaatctaattctgttttaattctccttttgttgagcatctcacacaagcaccctgcacacttagttccttttctcctgcagacaactgtagggttcattgtatatagtacagatgttgattaaaaaagagaaaggcataacttgaccagttagtttctaaaagatatcaatagctaataagtggacctaagataatcagctgaaaaattatttgaaataataagagaatgcagtcagcttctaaaattaaaacaaaatgtaataacgttcctatatgcaaaacataaccaattaggaaattaatggaaggaaagatcctgtttataataccaatgacaacagcaaatggaaggaaggaataatttaacaaaaattatgaagagtgtatcctaaatgatttttaaaagattcaaataattggaaagatataccttatgtaaagttagcaattttccttaagttaattgataaatttaatgagatcccaataaaaaacccaatagggttttctgggatttgggcaagaactagattagctattctaagtttccagtgaaaaaaaatcatatgacaattgccaggaaaattctaaagaagaagtataatgaaaaaagattaactgaccaacatattaaagtgaaacacaaatacagaaatcaaaacaatgtggaaaagacagaacattgaacaggatagaatatggaaacagacccaaaaacaaattcagattttaagacccaaatacatatttcaactcctaggacacaagtataaatacaaaatgggctgggcacggtggctcacgcttgtaatcctagcactttgggaggccaaggtgggcagatcacttgaagtcaggagttcgagaccagcctggccaacatggtaaatgttaaattttttaaaaaaaggaagctaaagaaacttgaaaagacaaataaccattaaaaatttatcttggaatgaggaattattttctaaataaaacataaaaccctgaagccataaaggaaaagattgatatacattacttttattcataaaaagtaaaagtttctttatagatcaaaatactgtatgcaaaatcaaaggcaaatgacaagctgaggaaaaatatctgtaatacatatgaccaaaaaaggtatgtttacttactatatgagagagctcttatgaataggagatgattaacaacccaaaagaaaaatgaacaatgggccgggcgcggcggctcacgccttaatcccagcaatttgggaggccgaggcgggcggatcacgaggtcagcagatcgagaccatcctggctaacacagtgaaaccccgtctctactaaaaatacaaaaaattagccaggcgtggtggcgggtgcctgtagtcccagctacttgagaggctgaggcaggagaatggcgtgaacccgggaggcggagcttgcagtgaaccaagatagcgccactgcactccagcctgggagacagagcgagactccgtcaaaaaaaaaaaaaaaaaagtaaagaaaaatgaacaatgactatgaataggcaatttacagaaaagagaaataagtggcaaataaatgtgtgaaaagatggtagaccttatttagttaggaaaatgccaattaaagcagcagtgaggctggcaaagatgaaacatgttgttgatacacgatgttgccaaggtaatggagaagcaggcaccatcacacacagctagtagtagagtctgcataaccctggtagaaggcaatttgcccacgtccattcaaattataggtgcacataccctgcgactcagcaatttgacatccaggagtgtgttcacaaacaaatccacacatcatacaattctgtacatgtaaagataatcattgctgcattgtttcttataggaaagactgaacataagctaaaaaaatccaccaataagggattcaataaattattgtccattctgtggaatattgcagatatgttaaaataatgagttacatctgaatgtgctaatctggaaggattatcacttctgtactttaagttaaaaaggcataaatatagtccatagtttgctaccattagttttttaatttaatgttttatttatttatttattttttatttttagagacagggtctcactatgttgcccaggctggtctcgaactcctgagctcaagtgatctgccctgcccaccttggcctcccaaagtgctgggattacaggtgtgagcaacagcacccagccccttctgtgtttttaataaaaagaaaaagttacatatatgcataagtataaatgcaaactttttcaaatagattataaaaaattgttaatgatatttatttctgaaaagtaggactaaagatctaaagcaagagggagatacttggcattctttaccttttatacagtttgggattttttatcacatgcttttatctttataatatagatatcaaaattctcagcattgatcattaccacacatgcattaggaggatttcttttctaattttgacatcaaacattgaataatcttccatcacgacatggaagagtattcaatcttgacgttatcttttgaacatcatacataaatatctcagcccttgggagaaccaactgtaagttgggatttgagtgactctaaggtccacagtactatatgataaaagatggcaaatccgtttcctttgtgtagccatcttggttggttggtcatggctatctggtgccgtacagctggaaggatttcaagtcaaagaccaggatcagtggaaaagagagctgaggtcaattaagaagctttattcatgaaaaggctaaaatcagtggagttgccgggagcagtggcaaatagcagtgttagccctgagccgagctgttgacaagtcatatctggcctggtggatggagctgaaagcaagtgagagtaacagccaagtttgaaagcttgagatttaggtactgtcttagatggaagtgggccaggtgcttgcctggggctgcctcctgaaggagtctcacaccagtataagaaaaaagagaggtttacaggctccagggatgtgctttgtcatatatgacagaaaagtcatgagtataaattatgcattaaatgaagctttgagctaacactgtgagaaatacggtatttacaattggagaaaaattgagtaatggaggaaaagatgtttgggtagcactattgttcttggccttctgaggaggcagagaaggatgcttacggtcctatttcactcctggaattcttttgctctctctgggagaccatgccataatgtttgttggcacagataagtcacaggtcaggaatgttcaggctagttccacccttaaaaagttcaatgtagaatcagtgaaccatctatggaaagagatgcgacccttctgtctccattgctatgaatttcttttaagaaaaaaccatgttaattgaacaaacgactatgtattaaccactgtgcctcaagtgctctccctgcagcatctcatttaatctgcataaaagctgtattttataattccttgcattaagtaacttgatggagatgacacagcttgtgactaggtctgtctgacgtcagaacccattttcctaaccattaagttttactgcctctttcttcaaactctgatgaagatgtattcatcttccctaacctatattttccttgaatctctacatgaattaatttttttgtcttttaagcaatatcctccaaaatctacactgtcccccagccatcatcaggcgtgatcaagaaagtaaagacatgtttactttcaatacagtatatccattgtacaattgatatcatatatgtcatatatatcatgatatcaacatatatagataggtactatatatagatagatacaattggtatatcaaatgatacaatatgtcaattgaaatcttttttgagaagtctgtgtagcaataaatgttaacatctttcacaggaattacctttgacacaacagagtttgaagaaaaaataatttacaaagatgcttagttcatcattatctgtgaatagtaaatactttaacaatgctataaaacttgacagggggcttacaacagaagatgaagcatattatgatacattcatacaataaaaaaatttatgctggtactaaaaatgattatgtagatctgtatttatcagcatagaaagatgtcagtgatacagcattaagtgaaaaaggcaaattacaaagagcatgcagagtataaccctttcacgtaaaatttgtgggttttgggcatggtcgcatgcataaagagatatccggaaggatattctccaaaatgctaatagcagttatgagtggttgagtttgggtagttcatcttattcttggtacttttctctcttttttattataatgaatgtgtgccattttaaaaatcagaattttaaaaattaggctattttcatttggggagggaaaacacatcaaggaaatccaccacccctaactgcttgtcttaccgatgacgggtcggcatggctaagtttgggaggcatattggaaattgggagtccagctccatgctggtgttgatgctgtaaagaacgactgtttgggaggccaaggtgggcagatcatgaggtcaggagactgagaccatcctggccaacacagtgaaaccctgtctctactaaaaatgcaaaaaattagccaggcgtggtggcgggcgcctgtagtcccagctactcgggaggatgaggcaggagaacggcatgaacctgggaggcggagcttgcagtgagctgagatcacaccactgcactccagccaaggcaacagagtgagactccgtctcaaaaaaaaaaaaaaaaaaagaatgactgtctgtctacataggatgatggtcctaggtcacaaactgacagctgcctgttcagcagatgtcttgatggagctattctcagcagcacccagacttccttctcttgagcagaatgggagtctccccagagtgcccttgtgcaagcttctcagaggttttcttactcccctcttttgaacttagtctagtcccctgcttcctaggaggggtgggttgggtccacagtataaaggccccttcagattgtgggatatctgtagagggttccactacgggttcacatgatggcttgtggagggaataacaatcataatagtcatactaccttgttgataaaatttcagaattaagtgggaactcagagatcttctagggtgacttgccacatttccaatgaggaaactgaggacgcccaagaacccaaacctcttgccttcccaccagtctgcttttgtttcatgccactttgctgaacagagctttactaggcaggtgtttacataaggcctattgcaaaggtgggccaagaagcaggccattaaccagaacacttgaactgcctagacactcatcagctccagaacatacggctatacatgagaccagaaagagagtgagtccaaacttgacaggggctgaagtgtaaatgtttctttgtttaaagagattttaaagttgtaatccaaaattagaaagggcagtgacatattggggaaaatatttgcatcaaattaaagaaatgaaggtttaatatttatgctacagaaagaaactcttataaagcaaaacatcaggactccaatagacaagtgggcagaggcaatgaacagaaagcttacataatatttttcctaccaaaatgaaaataccctaatttcctattctgattatgaaaacgatacacactaaggcagggtttctcaaccccagtggaactgatacttcgagtccgataattctttgttgttggggattgtcctgtgccttgtaaaatgtaaaatttacccacaagatgccagtagaacaccccctcaccctgcttagtttgataaccaaaaatatttccagaacttgctaaatgtccctggaaaggcaaaatcagtcctagttgagaacgctacactaaggagaaagacacatggaaagttgttctttctccttaatacttgacaacctgtaacattaacatgaaattaagaagccttcatcaagctaattggcaacaagtaaattatttaaaattataacacctaaatgccagtgaggttgtagtgaaatggatagaagcattcgctagtggtgacattatatacttgatatgaccccttttcagtaatacttctcaggactgggaagattgaatgcctcctttgcctcattcatttcattcctaggaatttctccaaggaaatcactgaacagagacaaaacccagtgtgcatcacgatgttcatctcagcattatttttaatagtgacaatttgatagcaaccaagatgtccagcattagaagaccactttaagtaaattgtggataatcaatttgatgatgcagtcattaaaaattatgttgactatgtagatgtgacaaagttatgacagaaagcaaaatacaaattgtatgtgtactatgattgaaattttgtaaaaataagtatgcatgtttgttcaaaaggatgagatggccaagtgggatggttcatgcctgtaatcccaatacatacggaggccaaggcaggaggatgacttgagaccaagctgggcaacagagtgagatcctgtctctacaaaatataaaaataaaaataaaaataattagccaggcgtggtagcttgcacccagctactttagaggctgaggtgggaagatcacttgagcccaggaggttgaggctgcagtgagccctgattacatcactgcactctggactgggtaatagagtgagaccctgtgtcaacaaaaaggatgagatctcaatatgtgtaaatgaaaacagctgtattaagggactaggatcatgggcgtttttaacttttaaaaaatatctttaatgtagttatactgtatttttttatttttaaagaaacagaagaaaatggccaaatagagagctgaaggaactctggaggacatcaagtacaaagagacaatattactgagctcgaatttggggatcaggttttggtaggagaccttataatttataccccaaataggaatacttcgagagtggaagatggaacttgtaaatattacaccaggaaaacaggtgtcccagtaaatgtctggtcaccctagacagggaaaccaagaaagatgacatgaagctcttatgaaaactcagaagtgataaagttcagagtcaagtagaggggactggattcctatgaccaaaatgtgatttcctgcaactgaggaccctgtaactaaaaaagggtactcagctggcataagaatatgtcttatcattaagagagtaggatgacacagaaaattataaagcaaaggccatattatcagtactagagctgagatcagcggaagtgattcatctactcaacaaatatttatcagccaggaacagttcgttctaggcactgagaatattgcagggacaggacagacagagtctctgatttcacgaaccttacagtcagttggaagtcaggctggaaaacaaataaacacactaatcacatgacatgtaaagtgcttcaaagaagatgaaatcatgcaatgtggaaagtgtctaagggacgggattggggcagcgatcaggggaggccttcctgaggccctggaatttgagatcaaaggtgaatcaaagaggagactggaaagatctggggagagggtgatctcagcctagagagccttgaggccaagctgcgaggccaggcaaaggtcagaaaggtgcttggtaaggtggagaccaagttcaagaccataagggagtgaggaggaactcagtaataatggcaattgtagggctgagcacagtggctcacacctgtaatcccagcactttgggaggccgagttggttggatcatttgaggccaggagttcgagaccagcctgagcaacacagtgaaaccccatctctacaaaaaaaaattttttttaaatatccaggcatgcacctatggtcccacctacttgggaggctgaggcgggagatttgcttaagtccaagaggtcgaggttgcagtgagttgtgatagcaccactgcactccagcctgggcaacagggcaagatcctgtctttaaaataaaataaaataaaataaaataaaataaaataaaggcaattgtgctgctaggagcaggaactggatggggcatgtggtggggacccaactaattcaaaccctgcctgggggatttctctgaacctaaactctgatcataagttgagaagcaatagcacctcactaggctgtttgaccgtttaattgagagggcaaatgtaagaacaaagcaatattgtcattttttttttacactgttcctttgtttaatgcagacagcctgcccttttcctagaaatcaatcagatatattatcctacatgaacacacacgttcttctttctggttgcttataaactctttaaggatatcagtagtttcaggggcttggcctttcacaactaggcaagtctcctttgttgggtatgaatggagagagggtcaaatttgaactagggaaatggcacgacgaagttcttaaagtggttgtaattctgccactcccacgctgttggttcagtttggggaataaacagaggtttgacctaggccttttgaaaaaatgaatctcttggattcatttggaagtatcccagatttacaaagtagaagctattaaagtgtttgagtggtggttaatcactctctaggaattctcatggacatcacagatttactcagctgacccttcttcataggcacatctcagattttggaaaattattccagattataagttggcagtcaagcaacgtgatttgatcgaacacttactctatggcaggcactgtccttgtcactgagaacaaaacagtgaagacaataatagctcctgccctcacagagctcaacaatgtaaatggtaaggaaacgaaacggttaaagttataattaatgaaacacgaatagatccctgagctcttgcctttccattatatgaatgaactgtgctggactatttagaattgtttccaccaatttaagaatataatagtagtgtgcttaaatggacattttgttttagaaatttttttaactagaaatagtctcccaactctttaaattttttaatattatactataaatgataaaataaaatacatatttaataaaatgaaaatatgtaaaaatataaactctttaaggatatcagtagtttcaggggcttggcctttcacaactgggcaagtctcacaaatttaatttgtttgttaacaaacaaatttaataaaatcaaacactatatagttatgttatatttttattattttgagataaggtttcactcttttcccaggctggagtgcagtggtgcgatcatggctgactgcagcctccacctcccaggcacaaatgatcctcccaccttggcctcccaaatagctgggactacaggtgtgtgccactatgcctggttaacttttaaattttttgtaaagattgggtatcactatgttgcccaggctggtctcaaacttccgggctcaaatgaccctcctgccaaagaagcctcccaaagtgctaggattacagcaactgcacctggccttatgttattattaaaaggaatccactatgaacatgattttttgcccatttggctcacttaggaagcatttttaaagtcttgatgcctgcaaccactccagaacaattaaattggaacctctgggggtctggcatccaggaatccagactgtttaaggctctccgggtgctggcagtgtgcacagccagggttgagaatcagaagcagtacatttgcagcctatcaggtctgtacctgaatatgtggagtgagtagaatgtgtggagtgagcagaatgtgtggagtgagtgtggggcaattgtgtgggtaagtacacagatactctgtcacatacagtggcctgatggcttaaaacaaaacaaacggccaggtgcggtggctcacgcctgtaatcccaacactttgggagcccgaggcgggtggatcacgaggtcaggagatcgagaccatcctggctaacacggtgaaaccatgtctctactaaaaatacaaaaaattagccgggcatggtggcgggtgcccgtagtcccagctactagggaggctgaggcaggagaatggcatgaacccgggaggcggagcttgcaatgagccgagatcgtgccactgcactccagcctgggcgacagagcgagacacggtctcaaaaaacaaacaaacaaacaaacaaactattcaaacccttgctttgatggcagttattatttgttttgttgtttggttttgaacattgataatcttgctagtggtaacctttgtaactcgaagcatcagtatcagccaagattgcatgcattcagagacaagtgagagaccagccatcaaatgaggaatcaacaaatcatggcctacttttctcatgtaacaagaagttcaaaagtggagagaccaggctacagcaaggaagaaccaagctccttctctctaagcagccatcctcagtatgaggctttcattctctaggctgtgagatgggtgccgagcctctcggcatcagtctatgttgaaggaaggaagcctttgtccttatgagcaggctgtgcctttttggtaggaagggaagctctgccttcacctccctcccgcccatcaggtacttctgcttacgtatctttggtcagaattctgtcacatggctacccctagctacaaggtaaggtaagctggaatttttttttttttttttttttttttttagcaattcttttcccagtctttctagaggaaggcaaggcagaaggggtttgggatggacgctgaatgaaccaaactatagtttttttcacatttgagggcaatgaaatcatagtcttgaaaaccaaggaccaggcgatagccttttcaccctgtgactagacaggtccctgagggcacggctgatgtggccaatcttctgtaaatgcaaaggtgcttatggccctagagcttcagctctaagacatgaaagtgaaggttcctccagaatcacacacgtgcattattcagcgcaaagatctgtggtttggtgattcttcttctcctttcataaggtgagaggcagcagttggggtgaatttccccaggaatggtgggagatgtgggcctagatcctcccgctgcttgggaagagtcgtacttttcagttggaagcctgctccaggaatggcgggctccaccctctgcatgtgacgtacaggggctggtaactgatggagcctgaacatatatctgggtgtgagggataagcttcgaacgccacttaagtgtaggtgggagccaaaaggtcaccctgccaatacatgattacatgtcctgttgaggagaaaatacacagggactattttcacccttctggaaattgtgattagaaaatgcaaggagaaggccaagacactaaactggagctggtagggaggaagcctcagccctgctcagggtgcctggacagtccccaccagggcccagctaggaaatgccagccttgtccttggtcttcgtccctaatggctcccggcgggtgagggaactgcctggggattccccatcgttgaagcgctctgtgagtgaccccctcctaagcccctccagtaggggatttcccagaatgttcccacgcccccaggaagcctcttccttagccacccccaagctgcttgcggttcatggtagaggtaggtggcatcaaatgaccccacaggtgagggatttgcctgaggtgggaaaagagggaagataaaattggaaagccaccggggctgaggaattatctcataggagagaactgtcaaacagtataacgtttaaacagactttaaaggcaagaaaggatggagggcacagactctgaagccagagtgcctcaattcaagtaccggtgctgcaacttccaagctgcgtgatcttgagccagtgacttaacttctctgttcctctgtttttcctcttctgtaaaacggagataatattttctaccacacaagtttgttgaaaatatcaaatgtaatgataaccataaaatacttaaaagagtgattggcacacggaagtattcaataaatgttagttattggccaggcatggatgattcacgcctgaaatcccagaactttgggaggctgaggcaggcggatcacttgcggtcagaagttcaaaaccagcctggccaacatggtgaaaccccgtctctactagaaatacaaaaagttagccaagtgtattggcgggcacctgtaaccccagctacccagaaggctgaggtggggagaattgcttgaaccagggaggcagaggttgcggtgagctgagattgcaccactgcactcccagtctgggcaacagagagagactctgtctcaaaaattaaataaacaaataaatgatagttaagttaacctaggctatttttttaaaaaaattttggtttctatccacctttttcgtataaattgagccaggttacaccttagacctattagatcagaatcaggcatcaggattgctaaagctccccaggggaccccagtgtgtggatgaggttgagaatcattgttttggtccagtctttccattttaaagtgaggcaactggagctgaatagggaaatcgagtcactgaggatcacccagccaggaccagggcccaagttcctattcccatttaccgctgatggagctcaccgtggtcatgagttcaggacctggctctgtgtctggaggaaggtctggcctcgagtcagcccttgtccagaatatctggccaggtgaccccctctccatgcagcccaggaggcagatggtcagctctatgattggaagaatgtgagtgactcagggatcttgtgttgtgttgtgttgtgtgtgggtcaccaaaaccgagacccagctttctcctgggagacaacagggtagccaaggacttatttttttgttttgttttgttttgttttttgagacagagtcttgctgggttgcccaggctgaactacaatggtaaaatcttggctcactgcaacttctgcctcccaggttcaagtgattctcctgcctcagcctccggagttgctgggactacaggcatgcgccaccacgcccggctaatttttgtattttttgtagagacagggcttcaccatgctggccaggctggtcttgaattcctgacctcaagtgatctgcccacctcagcctcccaaagtgctgggattacaggcgtgagccacagcacctggccaactttctagtgttctcgggagacctttgcccactcaagtctccagtctctcgggggaagcagtcagtgtgagagaaggaacacagggccccgagccaagccctgctctgcgcctccctcgcgggcaatgagtctttgcatcaaacactcaaagtttctgaacttctgagaaaacaagtgccttgaggtgaatcctatagcacagctgtcaccagcctgtggtcattttggagggtatgtggcataggtttgtcccagggtctcagttgtcctcatctgtagagtggggataataacagctgaccttccctatcccacacagagcgttattgtgaggagtctgatggacctggatgaattctgaataggagaaagatgggtacatggatgcccaaatgcaggctcacccccacccctctcagtagcagaagacatgcatatgggagaagctgcatttcctcccagcctcactgtgctctaggtgtccagccctcattgttaggggatgtcactgttgtacctctggataaacagctgctctcatgccacctttgccagttgtcccttcagctgggcgagccctttccagggcatgactgccccaaggagggccagaggggactgggcaatagcagggacatggagggacgaggccccagatcagccacttcctcctgcaagggaagtcaaaccctttctctcataagtgtcaggctggctgcacggtccctgggctggcagggcaggtttcttgggggccctagcaggaagcactcttgcttcccaaggtaaagacaagtttcttatcactggcggtggttttctggttagaggcagcaggcagcggttacaaactttgcctagagctctgggatctgcaagccagggagggggaggcagacgacagagctagagtgagctcagcagagcttgcttagggaggaaggacccgctgtcacttcccgaaagctgggccagcctctaggcggggagaaggtcagagtggccctcccttctgcctcggggtttgcccaggctcttcagagcacagaatttacagtaaatgttgtcaccagtggaaactctcagagggggcgaagaaaagggctagaggaaggagccaggactcccggcccccagttcccgtcttaccaacaccccctagtctcatcgtgttgcttgatcttacctttcggtaaagaggggatgccctccttctgggatgtgccaggaaatacccaaatggtaaaatgaatgagccggccacaccttgcagaaggcagggctgtgactccatcatcgtggctcttgataactcctctgccccgttttagaggggcttcctttgtactgaccttggcacactttctagctcagagccccattcaagaaatgccaggttgaggctgagcatgcttgtgtctgtccttcacagatgatggaacctggcttgatgagcaaggccatgttggtatatgcttctctgccatttagaaagaccccccccaggatgtggggtttaagatgattgacagtataaccgattaacctcattagcctacagctcatgcacctgatggattcgttagggcaaattttattttattattttattttattttttgagagaggacctcactccatcagtgaggctggagtgcagtggcatgatcatggctcactgcagcctccaacccctggtgctccatagctaattttcttttatttttattattgtagatactgggtctcaataatgttgcacaggctggtcttaaactcctgggctctcaggaggtagaggttgcagtgagctgagatcgcaccattgtactccagcctgggagacagagcaagactgtctcaaaaaaaaaaacccaaaaaaccaaaaaactgctgggctcaagcgatcctctcacctcggcctcccaaagtgctgggattataggtgtgagccactgcacccagcctatttagggcaaattttaaatgtcaagttatcttacatctgctcaccacccaccctatttttgagttaccttcttcattccagcagatgatgtcataagtctgtcagtcaacaaacatctgagttcatactatgtgccaggcattgagccaggcattaacaaataggcatttaataagtgcttgaataattaaaacaaatttaaaataatatttaactagtgctttccaacttgcctgatcattagaatgacctgtggcactagttaaaaatccaaatttcactccctagtagtctagtggctaggatttaaaaaaaaaattattattatttttttaattcagctctgcagccaggcatggtggctcacgcctgtaatcccagcactttgggagaccaaggtgggcagatcccctgaggtcaggagttcaagaccagcctggccaacatggtgaaaccccgtctctactaaaaatacaaaaactagccaggcgtggtggtgcctgcctgtaatcccagcaactcgggaggttgaggcaggagaactgcttgaacctgggaggcagaggttgcagtgagccaagatcacactactgcactccagcctgggtgacagagtgagactgtctcaaaaaaaaaaaaaaaaaaaaaaaaattcagatctgcagacttcactccgcaaatcccaaaaccactgattcacattcctagattttaggatgggcctgaaattctattcttaacaagccttcaaattaattctcatgatatggcaagtttgggaaatactgacctaatccaaatagatttagaaaggtaagacctggtctccaaatatcaggttgccttttgaactgaaattttttttttttttttttttttgcatctccaatgatatttgcctttcctctgtggttaccaatgcttagcagagaaagtctgtttggttgagtcgaataatgtaaaccttaaaattataccggaattgcgatctcctgggctttctgaggatgggattgcttttccataattgctaattaccagattgcaattgttgattaattaatgatgtgatcagaaatcagcacttcttagcaggcatttttctgattagcatgtatttgatggttcccccaagcaacagggaaaagagtttccagaaaaaagagaagctcacaggcttgggacacccccaaaataccgtcagaatgctttctggtaggccggacagggtggaacaaaacgttgtagcagactttgaccatttagtatttatttatttcatttttatttttatttttatttttgagatggagtcttgctttgtcacccaggctggagtgcagtggcatgatctcggctcactgcagcctctgcctcctgggtttcagcaattctcttccccgagcctcccgggtagctgggattacaggtgtgcaccaccacgcctggttaatttttttttttttttttttttgtatttttagagacagggtttcaccatgttggccaggctggtctcgaactcctgacttcaggtgatccacccacctccgcctcccaaaatgctaggattataggcatgagccaccgcacctggccccatttactatttataaagaccctgagcattctagaatctgggtgcagtagacaagtatccagtgactttatttgtaagacgaaatgcagacaccgggagcttttggaaaacacgtggcataacacagtggaaaagagtgaaactggtgtaagacgttctcacaaacgaccttccatttccttaggctctggcctgccagctgctttcccttgctgtattcccgccacctcccacccacacaccctcacagagacccctacatgcatacacgcagaggaacacactcacacacacccctctatcaggttgaaccatatgaaattgcttttttgccgggaggagagatgtagtcttgctgtgttgcccaggctggagtgcagtggctcaatctcggctcactgcaacctctgcctccctggttcaagtaatgcttctgtttcagcctcctgagtagctgggactacaggcgcactgccacacccagctaatttctgtttttgtattttagtagagacagggttttgccacgttgcccaggctggtctcaaactccccacctcaggcaatccgcccgcctcggcctcctaaagggctaggattacaggggtaagccaccgcgcccggcctgaaattgctattcttataggtcacaacagacaaatatcagcagcttcacgtggttcagcctcatatctatgtgtatacatgcacacccacccatgtgcttacgtaaacgcgcccatacacacctacaaacatatatacacttgtgcacacattcacacgtgcaggaaaattctctggtgcccttctccatggctgtgctagtgaacaactaatctggcccctcctgtgtccctccgcaccccacccaccttgcctccttcctagacactaacctccggtgctgatccccacccctacaggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctgagcttccgatgcggggagagcagagcctcgggaggggcacacagactgtggcagagctgcgcccatcccgcagaggcccctgtccacctggagacccggagacagaggcctggacaaggagtgaacacgggaactgtcacgactggaagggcgtgaggcctcccagcagtgccgcagcgtttcgaggggcgtgtgctggaccccaccactgtgggttgcaggcccaatgcagaagagtattaagaaagatgctcaagtcccatggcacagagcaaggcgggcagggaacggttatttttctaaataaatgctttaaaagaaa

SEQ ID NO: 142 - DNA, 344434 bp, Homo sapiens
tgggccgcagccctccccgccccgccgaccgcggtcacacactctcggagcctccccgtgagcgggagcgcggcgcacggcgatgcgccgaggcgggcgctgaggcggcgccgcgcgagcagcagcagaggcggcggcggcccccagcccagcccggcgccgccgccgagcccgggccccaaggtgcggcggcgccccaagttcccgccatgagcagccggctcggggggctccgcggccccggggactcccgccccgccgggcgcgaccgcagcgccccgcggccccgacgcgcttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcggtgagcggggggcggaaggggggaccgccttcgggggagagaacgcggatctgtaaagttggcgctgggcgagccggggcgcgagcgcagagcccgaccgctggggggcggcccggccttaccctgcacggcctagggttccagtggctccggcgacagaggatcccctaggctagggcggaagaggggactacagcactgggaaggaataagattccactcctttggggtatcctgattcgggggcctgtctgcccacctctagccttgaaccctacttcaccactgttccccctggacagccccagtgctgcttcacacccacctgttttctttcccctaaactttcccaggcactgtgttctgcagttcagcttccctgtctttcatcctgttctccagcatcccaaaggagccccaaccccttccaggaaacccttcctctccttatttcccacactctcttggtcttagcgtgaccttctctgacatctttgaattccacaggctatctgcattctatgttgcatcctttttctcacatcttcagatactttttgccagatacttttctgagttgccttctgttcaagtaatctctaatctcgagttgtcctcaccccgtagctttttttctttttctttcttatccactaggcatttattcttctctgggtaaacctggtgtctggatttctttttttttaaattaaatttaatttaaagtcccgggttacatgtgcaggatgtgcagatttgttacataggtaccaaacgtgtgccatggtggtttgctgcacctactaactcatcacctaggtattaagcttcgcatgcattagctatttaaaccgctctgtacttcttgcacctgtacctcatcctttactctctcctcaatggattctctagtgctttctctctcacattagctatttaaacctctctgtacttcttgcacctgtacctcatcctttactctctcctcaatggattctctagtgctttctctctcacattagctatttaaaccgctctgtacttcttgcacctgcacctcatcctttactctctcttcaattgattctctagtgctttctctctcattttttggtggcttctttatattaggcccttcctaaatatttgtggaatgaataaatgcctctccaaacttgtggtcatcttgggatgtctgtatcagcagtttcaggtgtacaacaaactccccctggttgtaggcatccttccagaggagtactgccttattcctgcccaggcatttcagctacccttggcttttacctcttgcaggaatgccagacctctgatccaatcttaccgtgtctgggagagctctgttttaaagaaatccactctgttgcagacagaatttgaaaaagattcagcgtcaaacctccacccatcttttatgctcaccctgaccttggatacaagagctttagctcctcctgacagcactttcacctgcccacccctaggacttttacttttttaaagtttccgaaatgaatctgaacactgatcttgtttgattactgttgagtctctcttttgagattactactgcaaatgatggtaggggggacctaagaaggagtggaaccctgaggggactgagtacgggtaccagacaggtctacaaatattcttgtggcacttgtattaatggagaatgatttttttcttttacgagacctgattgaagatgtataaatcacttattacattatttattttgaactaatttaattcttaggaacacatattgagaaacagtcatcttcctattcttgtgtattttcgtatttgatatatctttctgccactttttctttcatcattaacctagaaaacaatcctcagaatagattggctactctttgctgttcttccctgccaatatttcccaggcagcgtaattttataaactatttgatgttgcaaattgttgaaaatatttatttacaacaggagtccaatgaccccgagcgtctgtaggcttgtgtcagtacttaaagcaacatttgtgcaataaaatagttatttagtacaacagattcttatttaatgaaatgattttgctaaagataatgattagtttggggagaattgttgatataaccttggaggtttttttttttttttttttttttttttttttttttttgcctaagagaatttacagatttctaaaaagtaatgtcaatgcctctgataatgctaatttaagctaagactattttcaacaacttacatgaggagtagataaaagaaactgagaaatgcagtattttctgctagaataagaggaaggaaatagtctctgatggttacttttataagttaaatttgaatgactggctttttgctggatgaaaagaatgtatccagagaatggttttcagaataagcaatttaaaaataattgtgatgatcaaataaatgcaacagctctatatactttccatgccatagttgttttctattatgaaaagggtctgtcaggtggacgctgagaacatacaggtgaatatactgtaaacattttcaacataacacatgtatagaaaaattctccttggttaaccatatcatcaatagacttagtgacacaaataaaagagagagattatatttcaaagcagtgactcatttctgggcagtccttaccttattttatttggcaagttagaacactagctcaaaaagttccagtagattcattttttgacattgtcaggatttgaaacttctttgaatactcttcaggagatggattatgtcctctctattctctcatgaaagctggacatttttttgtttttgaaccactgagagtagccattaccagagcctttttagatgggaatttctagttgttttgaatgttgtgagctttcttgcatgccatcacaatatacttcaggagaaactgtacttgccatggaagctcctgttttgtcagttgtctcatcgtggcatgtctcagtcacttgggatttcttctttattcagaatgatttgcaaatagaaaaatgaaaatttatttattaaactagttatttgacccatgggatatccacactcaggtttttgatgcttaatagtcactttaagatgcaccgatgttgagtataaaggttataataatttctaatactatttaataagagtaagttgtattggtgaaattgaaaaaaaattccagaattcgggagacctgattctaattttgccttgaacaatgagaaacttacatatctctggacacattactttaaatatctgggatttcccaggctttggacaaactgtcatattggcatatgaaagggaaacatgggccaggcgtggtggctcatgcctgtaatcccagcactttgggaggccgaggcaggcagatcactaggtcaagagattgagaccatcctggtcaacatggtgaaaccccgtctctactaaaaatacaaaaattagctgggcatggtggcgtgcacctgtagtcccagctacttgaaaggctgaggcaggagaattgcttgaacccgggaggcagaggttgtagtgagccgagattgcgccactgcattccagcctggcgacagagcgagactccgtctcaaaaaaaaaaaaaaaaaaaaaaaaaaaaggaaaacatggcatatattataagttttaaaacttttgaggaaagtagtttactttttaagataggggcaccaaaatgctatttaatccacccaattatttaaaaaatattgtagtatctatgtggcaggtattgtgcagagcatttggaaagacaaatgctgaacaaaacatatctagtctttgatttcatggaacttctttaatcattatctttattttaatgaaactatataaagggaaaacataagaactccaattgtcttggcgaaatctaggggaagttttatttgtcattcactttgggtagttttgttcattgtgaatctctggggtgcagccataataataaaaataaccctccaattagcaggtcatgatgatgcacgcctgtaatcccagctacttgggaggctgaggctcgagaatcgcttgaacccgggaggcggaagttgtgatgagctgagatcacaccactgcactccagaccctgggtgacagcgagactctgtctccaaaacaaaacaaacaaaaaccctcaagaccttaagacctgattgaagatgtataaatcatttattacattctttattttaaaataatataatagttgggaatacatattaagcaacagctggggatttcacatcaagggtgaacttagcgacttatttatttggattttattcttaaatgagagttgcttagttaccctatcactgcgacatcaattttgggtttgctggtgtcagcctgtcagtgaagatacaccactagagtcatataagggcaaggcttctctaggtttcttgacagagaacattgcaagtggctttgaagacctcagaagctttagagagcagaatgtcaggaaaaaaaagtaacagaattggaggagtggcaaataaggagaggagagctactgacctgtggagttgttcaagaaacagagactagtgaagaggaaaaaatgaaggtggaagcttagattcaagtgacaaaaaagcataaattattattttggggaaggaaattatcttaatacatgtcaaggaaagaatgaaaaggcataaaatactttagcttctgttgatattaaataaaatgagctctctgacatgtataaaccttgaaaaaaaaccttagaaagtatgtgtgtaactaacatgtagacaatgaaaaatgtaaaaaatatattcgtaaggtaggctattggacaaatttaggtagtttaattaaagctttttaaatttggggcttaatttggctaacaaagttatagaaacagattcattaccattataaaattatataaagtatatttcagttgtttaatgttttcacatttgttgaaaatagatactataatctgaaatcagaatttaatggcaatctattgcctttctttaccttatccccaatcatttagaaacaacatgacagagttgaaagcacaaagttttggagtctgacaaatttcggtttgagtaatcctctgctgagccccttactaagtatgagtccctgggaaagctaactcttatcttctctgagccttagtttcctcttttgtgaattaggaataacaactaccttgtaggtttgttgtgtataaggaggaatattcttcttaaagcttcctaaactcaatagatgatagtttcagggtgagatctattaattttaactgaatttgaatgcctcaaagtgatctaaatttttcattttctttttttctcaataattcacttgctagtcacctaattggaaaagtttatagaataggttaacagatgtcaagtacgaaaaaaaaaaaaaaagtaataagaagcactgtattttgtcggcatagcccagacaatccattaaaaaaattaaaactggagtccctttttggcccctgggtatgactcatgtgtgtacacagacatataaaaattgcagatccaaacatttccatcagattactgactgctgtgtggcaatatgaaaactactttataaattctataaaaatacaaggacatatatatttggtagaatgtagatatttcatgacaagttaattttaaattagaaaaattgtaggtgaaagagaagttatttatttcagttgcctaagaattccaagcattcttcatctactgcattcaaactaatctgtatgtgtgttcaaaggccttgatagtgagatgcaacaattacatagctaatgctgtttatattttatggtgctgccttcttgtttggctattggttcaattgctaggctttcttttgtctttttctttttctttttttttttgaaatagggtcttgctcctgcctcagccttctgaagagtagaactttcactttaaagttacattttgtcaatgagaaatgacatcagtgattattaggtttgtaagtagaagtcagacactctgactatatattatagtattatatattatatactcctttttatatatattaaagatatatatttatatattataaatatatatgtgtatatattataaatatatttatatatttaatatattaaaaatatattttatatatattatatagtcctgattatatattcctttttagtgtatagtttatttacctttaaggactctaagatgcataggtgaagtacttgagtgctattatatatttttcccatctatgtcatcattagtctttttgttcacctttttgtcctgttgccgttaattatacagagctctaagtaaaataaaacataaatattttattgaatatgataggaaaataaatgcactgtcatttgacacatacattgttgatcatgagttactaggaaggtataattttcttttttgagatttcacacacatgtaggcacataggccgggagaatatttgcaagggctatctattgagcaggctttcttcacaggccctttgttcgatgcatgaggcagtgggttaatttaacatttaaagcctctgtccttgatattcttatgtttaacttgtgtttagcatagtatggttgttcaataaaatgcttaggagggccaggcgcagtggttgacgcctgtaatcccagcactttgggaggctgaggcagatggattgcctgaggtcaggagttcaagacgagcctggccaacatggtgaaaccctgtctctaccaaaaatacaaaaattagccaggcgtggtggtgggcgcctgtaatcccgctacttgggaggctgaggcaggagaatagcctgaaagtgggagggggaggttgcagtgagccgagatcatgccactgcactccagcctgggtgacagaggaatactccatctcaaaaaaagtaaaaaaaaagtgctcaggagaagtaaatacatgtttttgtttaattgttcaattttattaatgtttcttttgtgtttaatttttttttggtggtatatttagttccatcaaccaaaatatttagatttttcatccagcctgtgatagacatattcaagtatgcgaacctgtttgaattttgcttacacctgctatttaaagcaaaacttcggaaggaagtcgttttacaaaaagagcagatggaacagtatcctcctccttggactctttgagtcgtccatttatataatattttaagaagttaggtaaatgtaatgactcttctacagtctggattgcttatattttctgcccaattctctgtcaaatgagaagaaatgtttgtcaacaagtaggctactgttgccaaaaatgcactactaggagatggaaatgacataattatggcccttaaacatcacttcaggacaggatctgaagatctagaattatgtgctgttagctcagagtacctcataacattgagggctagagtcatttaggaggtagggcagtgggaaatatcttggaaggcgggaaatttgctggggctgttgtagggaaatgagaaagagtaaacattcttataaatagtgagaaatcacttccagagcaggctttatttgaggcttattaaacagttcttcatttaatctagtagctctcaagcttcattgaacacaagacatacctgaggaaaattgttagaatgcagattcctgggtctcatcctcagaggatctggttggatagttccagggaggggcccaaactacattttgaacaaaactccaggtaattgctcagcatgctgaaggtatgtctagaggtgactgaattccagaccttgaggactactgagcagtgagctctatgggctgatttttgggaagaatgatcctgaaagtcgcttcctttgggattaatgtatcccagacaactattacctttactgggttagggataaaggtggtgaattggtgctgttatccccacatcctatggctgtatcttttgtggtcgaaataatcttactggttgtatggtagaaggtatttgaggtttcaccatttgtagctttaattatctgtggactctgcccgtttttcccgaggatgttttgttaactgcttatgtttatgttcagtagttcgcatgtcattactataagtatcttgtgacccctttttccaaaacagagaaacagatatttgaaaaggttggggattgtagaaaaaaagaagggtggttgtgagggtgaatttgacattatcaccagcatttgtgtttttcagagtgagattgacacaacatttctcaaatgctccatctactggttcattttggaggagtgatttgtttacatgccaatgaaaaattaaaaaggtaaagggagaaaaaacagatctgaatgccagaattttttttttctagaaagaaaacaataggaggttcagatatcagatatatagggccacctctcaaaccttaccaaaatatgacactaacattaatgcttcctaatctctgcatccttagccgttcattcagtggtgaagttgggtgggggtctctcatttagttctccaagtaaataaatggtgatccaacatttgaagaatttgtatttgcagacaactctaataatctatcatgaaaggaagttatctgtgtggaggtcctgatgttaccttaattgtaagtccataaagtccacttgactcattttcctttcactgtataatatttgttatgcgtgagtctactgtggccaatggcaaaaatcagaatgttctaaaacatccttccattccttgttgctttatgtctatgcttcttcatacatgaaccctccaacttaatactgggagaggatggtttttctgactgtttttatgtacacacgcacacgtgtatatatatcgtgatttctgtcactccattttttcccctatggaatcctaacttatcactcacatctccattatgggacttattgtattgtaccttgattttggtttattctgcctctttgagatggaaatcctgtcttatttatctatgtatgcgcatgcctagcagagtatctgaattataaaggcactcaataaatgtttgttaaaagaatgaataaatgattgaataagtccttgtgtagtttatgatgtatttggtactgctcttttggctataatgattttgtgatttttaattgattattttatctgactgttctgtttgcagctttttctcagacataaacgggaatatagttataacattattttttagaatgcgttaagattttctaaacattctcctacctgacattttattgggacttcataataatctgtaggttttatgcaaattgcctctcactttgggtagtatgattatctttttttttttttttttttttgagatggagtcttgctctgtcgcccaagctggagtacagtggcacaatcttggctcaccacagcctctgcccaccgggttccagcgattctcctgcctcagcctcctgggtagttggaattacaggcgcatgccaccatgcctggctaatttttgtatgtttattaggggtttcgccatattggctgggcctggtgtcgaactcctgaccccaggtgatctgcctgccttggcctcccaaagtactgggattacaggcgtgagccaccgcaccaggccggatagtatgattatcttaaaatgcctgtagacacaacagttatttggggttgctgatgtgctgccacttacaagggtgtctatattatctcctaaagaaatgtgtatctgtaagctagagggacagtaaatctatcatgctgtgttgttcattattattttagtatgtaagaaatcctgtattaccaaacattctattaaatacaattctacaaaccagcatatccatatatctatcttacaataatcattagtggacacaatagtggcacagggagggatagtgtccttgaaaaaagtgtagagttagaaattgcttgtttaaagattggggaagagaactgcctaggaataggaagaagtgttattgggtgttttttgagggcccacttgaggttggagataatgagtatgtagatcaaattgggaagatgagtatgacatgcagaggtataaagcaatgatagtattgtttatgcattagaaggcctatatgtcagattgagcttgaggtgtttggggacaatccgctggagtggagggttatgtcttcaggaataatgagtgaatgtccaaacggggaaagctgcaataatccaaagacatttctagcctttctgtttgaacaccgatctgaaattaagactatttagaatatatctagagcattctttcactattcatttcactctctcggagtagctgatttgtttacccctcttctaaaccagaatcaggtaacctggtaactagttagtctttgagaaactcagttctaattaattgcttgattagtatttacatcatgctttcaaagttaggactaatccttgaaaagcccaaggatatttagctacatcattcatgcatttttttttatggttccaatgagtagttggtatactgtacggttttcttggctcagacttgatacatcactccttgaatataagacagtctacgggttttagagtagcagtgaccaccaaaacatttcaggttgtgttggagagtgcagtggatattttccttcttaaaaaggtagaaattcgttctggtgaatcaaacattctaagtgagctatcacatatgcagtactgatttgtaagagagcagatgaaattctatgaaatgcacttaagagtgaaaggattttaaatttgttagtcagtccttcataatcccaaaggttcacctgtgtgtttcagtgcctcagtgttgtccttatgagtattaactatcactctgctgtagattgtgtgaacatcctggtgtgggcagtgttttagataatcaagtgcttgataatagcaaacttgctctatgtagaagcactgaggaagtaaatggtacttgtggtctgaccaagttaatgtgcataccatttctcatattccaccagggagtctcttaggcaagggaaagatattgtgagtagattttaacaaaccgttttcctatcttttagacttctgtataatttggtgaatgtgcttgtcttgttttccttgaaaaatgcctatcagcccatttgtatatatacatgcacagaatggttggaggctgatcctgcaactcaatagatgctgcattctgatttttgttctaatttgactttggggaaataacttttgtctccacttcccatctctgaaatcacatctatctcactaatctctcactcaagagtaaatatgtaataaaatgtgaacagtgaatggaagacattgtgtttactattactcatgacttccttgttctgcttcacttctttcttgtaaaacaaaatattccttcaggttctttaactctctgcattctgggaaaagaggagatttgcagtctggcaaactcttcttgttatcttgggcatcactggataaattcgcctctctgaggatcagtttgttctgtataaaatgaggtttacaattcataggattatgaagattaaaagtatagtaatgcctagcacagtatttggactatagcatacgatcaatagattttggtgcctttagctaacaccttcttaccagttatcctgatactttcaattacctctagccacaatctttggcaaagtctctagataataccttttgtcatggttcgtgtttagtgctcttatgctttttatgggaaatatttccaacatttttgggcatatgacatttcagggttatactgtaggggtaatatacttataaaagatgttctctttcagaaatcttaaaaacaaatgcgatcttaccaggttcttgtttattcactcattcagttacctctcacattcattcattaattcagacagcatttattatcaaatgagcacttactaatttattcagcatatattccatatactttaaacacatgaatgaagtaggggctctcagaaaaaacattttacattgtcatttttgtatttaaaaatgtaaaatcacgcctgtaatctcagcactttgggaggttgagatgggaggatcgcttgagcccgggagtttgagaccagcttgggcaacatagtgagatcttgtctctacaaaaatactgaagaattagctgggcacagtggcatgcacctgtggtcctggatattcaggaggctgggtgagaggatcacttgagcccatgtggtcaaggctgcaatgagctatgatcacactactgaatggcagcttgggtgacagtgagaagttgtctccaaaaaaatttaaaaaatgtaaaatcacatttaaaaaattaccaaattatgtccacagcagctattgtctgcccctctgtctgtctctgccccttattctatgctgaccttttctagttttgtgtgatgtgtgggacatagggtcaaagtacagtgtgtatctaaaaagatcagttgaagctatagtaatgatgataataatatttatttgttgagtgcttaccattatcgggcagtgtgcttagtgttccatgaattttattccattaaatactcacaatattaatgcaggggtgatgccttaccatggtcataggactttaacagagaacatcaagaacctatgtctctaacctcatcttgtactctatatactcatggttctatgatgcactccttgaatatgctaagcaagcatcattttgccttaggactattgttcggttcctcatgtcagaaatgtcctctacccacatcctttgcttggttctcccaagattggctcttccttagttttcagctttcagctcagtgtcacctcatcagacagtagtcctcctacaccaaccattctgtttcacatcactgtttgtttattcttttcatcatagcttcactatcataaattatcttatttactagtttacctatttattacctgtcttccctcttataatttaagttacacaaaggaggaaccttgtcagcgttgctctctgtgggctttgcagcacctagaatagtcctagctagaggtagggtctttatataactttattgatgtatagtgtcacttcagaggaagccttagggcttggaaaagaaagagaatatttaaaaataactcatgggggaggggagaaggagaattaacatgtattaagcaactgctatggagccagaattgatcaaatgcttttataatatgtatcactaaattttcaaaatctcataggaaaatttcgattcagagaagttgagtaacttgcctatgatgacagttaattactgacggaaataaggttggaatcttgttctgtttaactccaaacctcatatgcctttcagtattttatatatttcaagctttggtgaatgtggtggacgtcatgattcactgcctagatgcccctttagtaatgaaggactcattcctctagatgctaggggttctgttgacagtcagccctcaatcattagtcctctctatatattgcctggcctgaggagaggggccttgctcaaagtcatgccccattcccatgattaatcaccatgtgataagaaagctaggccttcttgctctaatttaggcaactctgagatcagagctctatgtagggtcagctgagacttccattgagtcttcatcatagtccaacttctccttgtgcccaattctgctttcttctctaccctttcatggttgttgatcccaagaacactccctaataagtttcctgcatgctaatctccttcttagagtctgcttcctggagaacccaactcgtgatggtgagtttgagaattgtcatggcattaacaaaagtgcaagattcagtaatgggaaggtggcatttgggagaaatataatgatagctttggatttggatattttgaatttagtaaaaatgattagctctggactgtgagatctttaagggtttgtttactgaatgaccaagctcagttaagtgcctgccagttgatttaataaatagaggattgaagatatgggattggaatctggctaagagcttgtgattgaagatagttactttagaggtgatagctagtatcttgaaaattgacaaacactctgagagagaaaaaaataagaacaacggagaattagggggaaatatacagaaagaataaaaagaatataggtgacaggatttttttgtgtgtttgtaggatgggaggtgactgggagcagctgggagcaaggacccagtggttgatatttgcaaaataatgaaatttaaggatggtcttttcaaatccagtatgattgaggttgctagtggccttagaaaagcgatgccaatcctgcaactgagataaagacctatataacaaagtttaaaaagggaatatatggtgagtaaacaaaggatattgtcggcatacatctctgactcaagacatttgataaaaatagagacagcagcacctgtgaggccaaatctaagtttattagagttggaaattcatgtttgaaggtaaaagataagtaaaaaaaaactggagatggatgagataagacttgatcaaggatagggtctctttagaggcattctctaacctatttcctaagaatgaggacacttctttctttatactcaaggggaatgtaggaatatggcagagtaggagtacagtgcaaaggctactgtcatattttggttttattcatacctaatttattattacattcttgtctagattttgtcattttaacttagtcattggccagtaattttgtatatctagcaattatcacatttaaattgccatgcaatttgcagttctctagatatatattaatgatggcagctgcactgactatgggatgtcaaatcaggtatgaaatgtcactaattcatccttcagtaattttactcaagtcatggagagtacattatttcatttgtataatccactgcttacataacttttggattgtcttatcaatagctttagacttcgggttttctcctatcctcctaaaaataagcatttataaattgaacaccatatggagggaactgtttttttatttgtgtttgtattagcttgttttgttttacttataaaagtgttttatatatatatgtagttataaaagtttatatatttatgcgagttgtgtatggacacacacacacacacacacacacacctgttcttattctctccatgtctgatatgactttgttcagtgttagagctctttttgacacttttttgatactggtagaaaggtcactaatggagggaactctcgaggtattaggagccaagtgaataggactctattttgtcggtatattaaatatattttatactgttgaaaggtagtgtggaaggtgaaataaggccaaataggacatatgtcatcaaatgtagcttcttggctctctttccttttctgggtgaattttaatcaatttcatcaagcaaggatttatatctattttatgtactgcaaaattttatgactacaatatgcctggcacattgtggttgggcaacaatttttttttttttttgagacagagtctcactctgtcgcccaggctgctgtgtagtgttgcgatctcagctcattgcaacctctgcctcccaggttcaagcgattctcctgcctcagcctcccgagtagctgggattacaggtgtccgccaccatgcccggctaatttttgtatttttggtagagatggggttttgccatgttggccaggctggtcttgaactcctgacctcaggtgatccgcctgcctttgcctcccaaagttctgggattacaggcgagagtcactgtgcctgggcaataaatattttttaaatgagtaaatttagagtgaatgtaaagattttttttttaagtataccacacaaatgttgtaagaaccaaaaaagggaatacaaatccacttaagaaaaataaaatcaacaacagcaaaaacaaagtagaaaaacagagaatatgcaaatgtaaataattattatgtcctgttattttaatttttattatttcatatatttactgtatgccccctatgcatgcttaattttactgtgtcatgagccagaaccctaaatctgtggagcaaaaaatggttccagtcattagcccaattaaaaaaaatgtattttccttgaatgcttgatcttctacaccagtcaacttacattatatactaggaagaaaaaataagttctgtctacatgatctaattatattttaaagaaattcaatagtattttattaagcagatatttgttgtttctgtgccagggatttgagatgtctcagttatttggggaaaatacttataattctatatccccacctactgctctgctacctattttcttgtgattctgtttcaaacatttcaggaatgaaatttcagaaagattttatctttcttccaacttctttcttgtataaagtcttcccaagagaaatccagaacttgtggaagaaaaattcatattaccccttcagcaaatttaagaaaaacctgtcattgtactagttagaagcttattatcttaattcagtaggtttatgtagaccttaacaaaaggaaataaatatcttgtaatgagtattgaccaaattctctcagtgcatggtcactctgagtctgtttgccttcttccaatttcatttctttcccttgtgtgattggtttaatttgtgtatgaatcatgtcttgattttaaatgttgtcttaccaattatttgctttttggcttaaggagtttgttattttctaaaaaggaaaggatagagagagtcttacaaattgtgtttttatcatagtatttacacatgtaaacccaaatttattttaataggatatttgaaggatctgtatttatctatttatatctatgtatttatctaccaatctactattgatttcatagggcaggagagagggagagagatgaccctgtcattagattctgaatttaaaagtatcacataatagaaatctggagtaggtataattacccttattgtatctttttaaaatttgccacaactaatgaaaatgtcttttacttccttaacaaaagaatatgcctccaaaggcattgttgtagggagtgataatgatgagatgattgggttgtaatggaacagagatggagggaaagagtaaaccttagatacagactattgtaattccatttgaagcttcagacagatatgagggagtttctagtgtggaagttggagaagagagatttattgtttccacctgacataaagatcagtaaatgctttgtggacctgacagtgtttgcaagctataaagtctttctctctttttctgtgttaacttattgccattgtaaacacatttcaaagaaaaccaatcttcccctttgttctgaattaaatttttttctccaaaagtatacctgcaatttataaacctaactttcctgctgaaggagaatggatgggattctccagcagcttattgcaggtggctaactatatgaattgtggtggaggaggctgctgcctactgattttctaaggacttaggcactttatctccttattcagctgcattcttgggttgcgggtgagggaaaaatggaaggaataaaatattaaattaagttgtaaatgtaattttctaccatcaatctagctttcttgactgtttagaaaaatctagataatctaggtctcaaacacctagtgaacacaaatatccaattgttttgattatacaggtggaatatatcaccttaatggtgctaatggcaactatagtgatagaaattaacaattccattggacatgtaattggaaaaagtattgtactacaagttaccccaagaaacatactttttcaaagaatatatactagtaagtcactttcaagtatgagtcaacgaaatattaccaattgtataactataaaatatgaatccgctaataaggatctacaaataagatcaaaccaacacattttggccattagataaggtattcagctactttgtgtgattataaatccacaaatcttataaaccatgtaaagatgttacataacatcaagaaaacatcttaaaaacctaaaataacaaagtttattatggttttgctcttccagagtgactaatagaaatgaatcatgggcatattaaagtcaagcctatcagtttctgccttggtattttatactagttcaacctctgatatattatggattaaggttacgaaaatgttaagtgggggcatttacttttagtaatccttattctctctctctgtctttattcctgtatcagaacctcatgccacaaaaatctgctgtaagactctcccagataaattgtactatgtacattttaaatacctaatgtaaaattattaattcaaaagaacctctcttgattgtaaggacctgcataggagtggaaagtaacctttttggaggaacatggggttgtgggtgggatggagatagctctcctggtgctcctaaaatcaaatctagtgtctggccccacaagactctgccacgtagtgatgactatatagcagtgatgcttctgggatctctcagtcagccatctggagatctcctttgcgacggtaaattatttaacgttcttggtctgtagtgataacatggatacattgggaagtaaaaacaaaataataatatatagcatttttgatgatgtggcattatacttttaaattttggattataaactgttttttttttaatgaactattactgctactttagggctcattttaaataaggttcaggaccaaatggggctgatgttgtccttatgttttataatgcttagagattccagagattttgctatttataggaataatttatggattaatatgtgttgtggtaataatgcatgccccatactgggtttgccttggaaattccagttaagagtcgttatgcatgcaaggaagttaaaatgtttttagaagctggaaaatagtaagtgatatccaatcagtaccttcttttcaagcatcataacattaaaattccggtgtgaatatatgcacatgcttacttatataacttgtgcaggacaacgtttgacagatatttgtaaagctgaatggtagagcaagatatttaaactgatgtaatatctaggaagaatttgaaaaaacatgatgccatgtcagaaacatttcctctcctctgtaagcagctgttcccaatatccctttcttattcacatcctttcaccctctctctctccttttccaagttactaattttccattaggtaatgagacaaacagatggccagaaatactacatagtttacagtttggttctcaagtgagcaagttttgatgtcttttgctggaggtcttcgaaaatgtcccccacaacaattcacatcatgatggccattttgtgataaacagcttattttgattagtttttagagtaagcagatttgaagagaattttgaaaagccaggactttgcccaactatactgttttttttaacacctaaagatacaaggcattagtgacatcactttatttttttcttttcagttttccccacctcaggactgtgagagattgatgtgcggatacatactttccctacagaaaagacagtagcaataagtgacatctctttagcgtttctaaaacatgtttttcacatacattatcccacttagattcacccaggaagtatatgaggtaggcaggacatggattcttgataggcccaatgtaagggtgaaggaaccaaggcccaaagttggtaaccaccgacattttagtgcccggttctcctattgcaaaccctaagctctttctaccatgctattatttctcagcatagccacgaagaggtctaaccttaatatatagtcttgctcgggtggggggggggggttccctatcttgcttcccctatggctcctactttgttgacttgttaaggagtggtggtagcgatttttgtgggccttgtacctcttaccagttgtttagttccagactgtgtgatgagtttacacaacataggcctgtgttagaaatgataaagggctctttcttcctcaggattctgcctctaggctgacctagtttgcctgtccgctgtcatgtttgtatgctctgggcttctgtgggtgaggcagctaggagcaaagtgacaaaagccactgatactgccaacagcttagtttatgctatagagtgcgggaagaagaatgacattacctgacatttgatttctgaatatgaaggaagtcttgattatcagataaatagttacatgcataagggtatatatttctctacctatattgtatataaactatgcatacccatacatccatgtatcttggcataaataatttattagaaggaatgaggaaataatataatatgtaatagagtgatagctagtttaaaaaatgtgctcagatagtttagagttaaactaaaaaagactttttatgttatgcagtattaatcttctgcctgcatgaattttttttccagaaaaagtgattattctgtatctctaacttaggaatctagtgcatcatagacactgatgatgtggcagtcattatctgccaaacatctgcctagtaagcacgttttatatccgtttggatcatcagattatagtcaacactagatccaattatattcagacccttactgagttttttctttcaagagaagtggaagcaatggagctaggcaggacccaccctgagtagtatgttgatgatttctacatgtctcagcatctgagacttttaaagtccaaggacgtgttcttgtcagtgtcctgaaataatcagtctcttagccactgactggctaaacaaaatgcccatggcactttggttgacatgtaaatgatgatttacttatttacaaggagaagtaactgtgaaatgtgtcttattactcaaaatcttaatgctcagcacatttcttacctgatcagactatctgaggaaccaagtcataattagaagtttgctttaatccatttagagtcaaagcaaaattaatttcatgctaagttctttaatccagtttatagagctttccagctgtagggaaggccttgccagtgagaactgatgttcaagggcattcataagactcatttttagttaagatggttgaatcatttttcttactttagggataatctttctcactgtgacagagggcccatatgctcctaaacagtattagatataatgtttcataaacaattcccctccccttctttttcctatgggttgccatctctaattttaccacttcctccatatcctccctttgttggtcacctttagatatgttgcttctattgctcaatggcctactttgcctggagtgaaacccaggcatgcgactggagcaaattctctgccactggtttacaaattactgttcgagttagtgcatttagggttgacagcatatctctttgttttatgtgttaattttataatttaactgtcaggcagaaatattacttctttattctcagactcttcttgggaaataccccactgaaactcccaagtactgggcacaatagagaattctttggaaatactcaaattgaagccacaaaggtgtctgaaagactagaaatgattttctcatgagatccattcctatccagtagggtacctatgagctgaaatgtcactaattagctttgcagcatttactaattggcatctttgggctgtaaggcatggctggcaacagtcctagatgttagacatggtcagtttagttcaatttagcaattttttgactacttcataatcaagagatttatacattgagtttaatcatcacataacacatatttgtgtaatactttatagttttatttcattttgatctttcaacagccctgagaaaaggttattcaggaattttcccattttatgaaaattaaattgaggttcagaaaaataaatcctgtatcccaaatcacacaggctagccaggagttaatccctttcaactataatcttttctgctgttggtgaagatagaacaatgtatttcagcttagaagggcaggttaaggggttggagattttggagggagtcagacctagattggattgtgactcagacacttactacctaagtgactttgggcaagttttttaaacttctctgggtttcattttttcacattcataaaaccggggtaatacttctgactctcttgtaagattattttgaacatcaaattacttgatgcatgtgacacgtagggtccagtgttgcactcagcacaaagctggttgctattacagtgaataacccagaaagcttccccattttacactttgaagactgaatcagccctatgccatctgtgaagttttgtttggttttgggctttaagatggaagccacgtctaccaaaaggcttttgctataccatgatccattttcctgagaaaatgtctaggagcagtgccatcttgtcttatcatcggtattttcattcacactgaaccaaattggccgtgatggtgaccagtgaagcaagtattaatatctcctaaaatctcactattaagaagttaatgagcatactggacctatttaagtaatagtgacactgtttacaattttgggaaaacaacaatctcattttcattccattaaagacaaaaggaaataaggaatttcagttagatacatggtaagtatttcctaatggtcaccaaagtgaaataaattaccaatggaggatgcagcttgtgacagaaagagcacaggagacccacgacctggtcttgatggtgttcctttccagttctgtagctgaggcaaaacactttaacctctctgatgctcagttttttcattcgtgaaatgtggataattaaatctgagactcgtgagattgttgtgagtatctaataggatggaaaaaaaagtgatttgtaaaaaccataatgtgttatgcaaaccgaaggtggtggtgttactctctggagttctttgaaaacatcagacatccttggatgacttaagtgtgttcttgcctgaaggcagaagaaagactaaataactcatacttcagggagtgtatgttttcagctcaaattagtattgatggtattaggttttgtatcaaattgaaattcaatggctatttttggaaaggcattaaagtgatgtaacaaaggggaaaatactgggaaagcaaacatgcattttgtataggaagacttaattacaatattgattatatgttaagtataatcaattataaccaataatagtgatgataaccactgtggtttgctattagagcatacttctaataaggcaaaggttattagtttgaatccccagatgggtcaattagcataatgtcaacatttaccccaagctctaatgaggtcatgcaaatatatacctgtgttcacaaggagaataaaatgaagactggaaaaaatggcccagatgttaaaccagtatggatagaaaaaccctaattttagtgcatctctagctttttattttttcctttagcacccctaggatttttgcattttgtaactaattatctgaacttctagttttgcttagcaaattagtgttgtaggtcacttgaaatggtattcctaccttcctataaagctgctatccttctaaaaagtgtggttatgattacccagagaaggttgtttaaccgccagtatgttccaactctgtatttacgagtgcttaaactttgcagtgctgtacttgaagatgaccctgagaactacatacttcttacatatgtttttcggatgggaaaattgaggcttttttttcccccgaggactttcaggtgaagagatattggctaattttattttttttaaaaaaaggtcagtagcacagctggatttgtaatatagaggtcctgactcaaagttctatatttaatttgcagtcttttttttattttttattttttggcttatatgtagtaagtttagtcagaggctgggaaagtaaacattatgtctggatatctagcaagattgatgactacacaattacctctccttcagaagtaaactggttgtttgaaatgacattatttggattagttttagtgataaagtcagttatataatttgatccattggtgtctacaggcctacctacaaagaaagcatatctaagattataattctgattaagttgtggaatttgacatagggtatcctaagaaacaatgtgttctcatgttatggagaaggtggtgatctccactttgtgacctggaggatgatgagaagggttccttgtccccacaatttatctttctctgacaagcctgtttactaaaattaaactcttaaagattccaaccatcttctatattgtagagaagctcattcacaccatcatttaccttagcaaggattcaggcttgaggttttgagggaatggagttaggattcctcttgagcatcatcttagaacaaggtagtaaggggatttggaattttgatgagggaaagaaagggaatatgcaaagaatggcttttggaaagtttagattatggtggtgaggatctggcctaacagaaaggaacacaaagacgccgggtgctcagagggtggggaaaggtgagctagaggatgacagaaagctaagaaaggggaagtggaattatttaaaataaaatttaattcctgattttgcttataggttttcttgttgatatggctttgatttaaagaatgttgtgtgttctcaagaaaaaaatcaattgtttgaatacacgtgattttgtaattttatgtaacattaaaaaactacttacttattgaagacagtttcctaagagatgacatgttctggccgggcgtggtggctcatgcctgtaatcccagcactttgggaggctgaggtgggcagatcacgaggtcaggagatcgagaccatcctggccaacatggtgaaaccccgtctgtactaaaaatacaaaaaaattagccgggcatggaggcgggtgcctgtagtcccagctacttgggagactgaggcaggagaatcgcttgaacccgggaggtggaggttgcagtgagctgagatctcaccactgcactccagcctgggggacagagcgagactcggtatcaaaaaaaaaaaaaaaaaaaaaagacatattctttttgtacaagagggtttctttacttttcgtcacgtgagggtgaacagattacctaatctctctaaattttgttcttttttagtgataataacaccagtctgattatttcacttgattggtgcaaggatcaattaggataatatatattaaaaatacaaactgtaaagtgctcaaccaaataaaaaacattaaatattgtgtgcagtaaaggttgaaggttacatgcttagatttgggagccatattacctacctgggtttcaatcctggctttgtccctttttatctgtgtgacacagggcaacttaaagtttgtgtctcagtattctccttcataaactgtgaaaaataataacacctacctcatgtggtgatgtgaaaatcaaagaagttcatatacatagagggcttaaagcagtgcctggcgtaaaacacggtagtcattctagctgttgtatttttatgtgcatgttagcacaaaactaaatgctgaattatttgcatgggagtgggttactgtgagattaaagaaaaaaatctcgtatttatgcttcaagcagcatagctctttgcttatctaacaaattcatatttgattataagccattagtgacagttaatgaaagggactctgtttgaattaagcggttatgagtatccatctcagaagcttacttctcttgatacttgaattaagagcctattctcattaatgccgacttattcagataaagttcacagtgtttttgtctttttcatcatatttatatcttaagtgaaaggtttcaaccgtaacgacacattggaagcaactgggtccccccgcaccaattcaactggaaaatctgggggtggcacgtagaccttggtattttttataaagatccccaagtgattttaatgtgaggcagaatttaaaaccattggcttagagcagtagtgattaaatatatacctacattgtttagtttctgaccttgatagatatattttgtcatatttaaataaacaaaataatggccaggcacagtggctcacgcctgtaatcccagcgcattgagaagctgaggtgggtggatcacttaaggtcaggagtttgagacctgggcaacatagtgaaatccccatctctactagaaatacaaaaaaagaaaaaaaaaaagccgggcatggtggcacgcacctgtaatcccagctcctcagtaggctgaggtattagaactgcttgatcctgggaggcagaggttgcagtgagctgagattgcaccattgcactccagcttgggcgacagagcaagagtccatctcaaaaaaataaaataatatggctctttatggatgtttctttaaaggcagacctattgtttctattaagtttgtgtcttgtgagtatatgtcactaagcagaaatgagaagtttgattgtttttaaattatgtgtgtggctttttttggcatgatgaagtgctgtgtgtatcaaataagaatatagactttcagaatgtgaaaggtaagagggagcctcaaaggcatctagtgcaaaaggatacactttgaagtcagttctgttttggagtgatttatttacttactgggtgtgtaatcttgtgacacttgcttaacctccctgagctgcagcttcttcatctctgtaaaattgagacatacatgtattttgtgcgatgacaactgtgtttcacgctgcgcgtgcgcgcacacacacacacacagagagagagagacacatctttactctctgcctcctgcctgatccccgcaccatctggtgcagatatccagagcagggactgtgtgggagcctcagcgggactgtctgagcctgcagggccagctgctggggactgcttcctcccactcttcagggatcatttctctggctctgttgggactatttcgtggttggctgttcggatctcatgacctttcttgagcataacatttagtctgtggggttcagtcactgttggtcaagtatagtgaagctgttagtgagactagagatgaagatggctttttgccgccatatgatggaggcttttgggtaccctctcttggtacccactgtttgaaccacagaaaatatgtgtgcaggacactgatggctgcttcctctttccagctggcttcctctccattgctagtttgtgttgatttgggacactaggaggccactatctatgtcttagtttgggggaaggagagaaaaattacagacctcttgactttctttttatgatagtaggaacagtagattttctcctttcccaccctcgtctctttgatcctccagcatagggctataaaattagtaggccactcagcaatcctgttgcacattctttgtatacaaggaaggaagttcatggttgtttcttattagctgtaaagtaaatgcctggggtcttgaccttagctatgatgtttcagtgtcgttcctactcactggcaggcctggctttagtactatcctcagccttaatattgagaattctgcttgtatcactgtctctctcaactgatcttaatgtttcattggaaatatttataaatctggctgccatttttctgaattttcctctgttcactggaattggtgtcaacttctcataatgagaagtatcggtagctttattgattttttttcgatgatgaagatcttgaaacattacacctgtgggatgagttttctaattgaagtctgtgttcctacattagattatgagactcctgagggtaggaaccatgtttttcagcttagcatagccatatctctcatttattacacaccgactgtgtgtcagagatgttgctctaattatttcagtgcattcccataaaaataaggtacacatatgtaacaaacctgcacattctgtacttgtatcccagaacttaaagtataataataaaaaaattaaaaagatcatttaactaaaaaaaaaataaggtacgcataaggaatcttgtttcagaagagcttaagtaaattgcccaaggtcatctagctagtgagtcatagaacttgcttttgaattcagtttgactttaaaacctcttttctaaatcatctttccaaactccttgcagaaaaggacagatgcacataagaggactgggatcttggcctgtagaatgttggatggttctcttaagtaggagccagttatggagctgcattcttaaagaagaggatagacagtctgcatgttttcaaagcccttgttgttcccactgatctacattgacttgcatcactggcatacatggacacttaataaaagtttgttgagagctggaccctaccaccccagaggcagaaatcatctgatggaaggctttggcccgtttgtgggtcttcacttcatgctttttactcaggtcagagaggctgagattatgtgaatttgtctctcactgatcaggccatgggttgaggccttcagacacactctgaaaactggaatgaatccatggtgataagatattcggaggggccagggctgtgttgaagtcagtcttggattgctgaagttaggagatgctgtgcagtcagcctctatgcttgtggtttaggctattagaatgtgcctgcccactttggcaagaaataggaagtgcataaatgctttatcaacctgaagctttgttggatgtgctcagagaacatttctttttaatgtatgtggaaactataaatttaactcctgctgggagtggaagtaattgcttcacacaagaaaaaagctagatctttaaaaggcttaactcctttcacaaatatgtgctttttaatgactgggaaattcctggtacagaaaaaaaaatgtccttttgtacaaatgaggtcattctggtcttaactggccctgtacactctagttcctgctttctgttccatgttttatgaccagaggttattggaaggatcatccctctgtggatatccactgccttttcagtttgttgccaaggggaaagttatcttagctcaggaactgccaagccagtgcaagaggcccagatccaaggggtactgagctagtgactgatgatgattggatttagattggtcatggactaggttgttaaagcatgctttctgtgtgcactaggatcactatgtctgattcattctctttagatttcttaaccattccattgcctcttcgttcaggaatgatttttctttcctaggtgcataccatttactctgctttgagtctgtttggatgagtagaaacatttgtgccagtctgaggcctggtataagtgaaaagcagctgctgaaagaagttgctctgtacctctcctttgaacacttggaagctgattcctcctaaaattaatttgtgaattggtttggctaatgtgcagtaggtatctgaggccttagatttgtgtggtgaaagggttctcctacgtggtaatgtagagtagatctcagtagatgcccttgattcaatttaagctcactttcctctaactttaaccattgcctaccaaggaggatgttaaagattcgaagagtgttaggtagggagagtgttacatctgtcttggatgtttttatgaagaggtggacatggagtgggtctaagtgagatttgacatagacctctggtgtctttttttttttttttttgaggcagagtctcactcagtcacccagaatggagtgcagtgggggtgatcttggctcactgcaacctctgcctcctgggttcaagcaattcttatgcctcagcctcccaggcagctgggactacaggcatgtaccaccatgctcgcctaatttttggtacttttagtagagacagggtttcaccaatttggcaaggatggtcttgaactcctgacctcaagtgatccacgtgcctcggcctcccaaagtgctgggattacaggcgtgagccagagtgcccagctcctggggtctcctttagacgatatatttttaagacagccactttgaaggattagcaattggaaattgatacttattaactgcttcttaggtatcagcactatgctagaccctttctgcagattgcctttttagaggtagaaggctaccatgctgcctcacatcttgaagggtttgtattacattcgtattccccaagaattcatccttggctgtaatggatcaatgctttgatgaggccttgagtgctttttttctgcttaattgactacaggtttttgttatttaaaacattctctctcttgctactgagaacttggttcttcttatcataacttcctaataacatctaggttctaggatcttggtgtcccattcatggctctctaagtctgaaactccaagttcagtctctgttgcttaatttcttgatctgggattaagaacctctgtcttaagccatcgtggagaagagattatgaaatgtggtcatgagctgcttagatatttgttgcagactccatattttgcctgaagcacttgtggcccatccagtatgctccagaaagaacctttgcttgaattctcttgggacatggaggaagtcaggctgactgctgtgacagtcatggctgtggggccctggatcacctgcttcccatcctactctgcctttttgttagtctcctcaaagaacggggaaaaaaatatcatttaagtttaaaaatatcttttattataaagttgactcttttaactcaatttatcactgcttgctagaccatccttgaaaaccttgttaaaatgtagaagaaaatatgaagacgtgccatttgatttcagttgctcattacctcatgcagattacatatgctggaaaggaaaaaccgtgactcatgtttctgcagggcaccctccctgctatccccagggcctgggtttattgtaggcagccaatgtgtattttattgaacttaatagctgttacaaaagaattgaagaaaacattcctaggaaatactatcataattgaaattgggaagttctgggtaattgccgagtgcctcatattagtttctgtggggaaaatacatggcatgatgcaaaatgggttaatactgtagaaggaaaactctcaagagataaatcagaagcttcacctgtctgcctacgatactcacagtgggaatggtactgatttgctgataatatgtttttattattattattattctgtagcctcagacgatacagcagactctcaagaggacactgcagtattatgaacatcaagttattgggtaagtaaaaattgatttcggttattattggggacaaattaaaggtaattactcaaacatagctgttgagtatgtgattttctgctacccaggtcaacctgattttatagtggctatgttttcatagtgtggggcgtgaaggcttattgggggagtcccttggagtgatttcttttggcttatttgtgcttaattcttttaaatgaaattactttctggtattgcttttcttttttttctcagtcttctcatgttcttactcttttattccgatgttgaatcatataattatgccttactaatgtggtgagctttattggtaccaacccagatgctttgaatgggattttagaatccttaagtagagtttgataagaatcactacagccttaacacagttcagtgagaggaattagtttacttagagtcacgtgctacatatttttctttattatcatctatttcttgaagtggttgtgatgtggtgtaaagtaagaagacttgatgtcaaaagacaggacttcaaggcctcactagcaaatagatcttttactaagtaactttatctcttttttaaactgtgatgataataataactaaatcaaggattagatgtaatgattaaatgaggtaatttcaatgaaagcattttgtaaacagagagctccaaatgagtatgaggtacacctctaattggctgtggcagaaagcagctggcaagtatgaaagcctaaatttacctactcatgcaatctagcttttagattaaatttattgacattagaggcaatgtatatattttaatttaccttgttagtattctttatatggtacagtgatttatctttgtaagattttaagaacttttgagaagtcaagattcaaactgtggtacttcttgaactgctctcaggatcatttaacatttatggctaatagccattgccatagggatcaataacataattttgattattacggtatagtgtgatttttttttcacagaacagaagggaagaaatcttaatggaaaaataatctcggtacctagtacaatgccgtatactttaagtgcttgatgattatgttaattgtcatttaaaagggaattgctttgaaactttgtcatacttatcctcaagagtgtagttctaggaaaaacatattatttaaactcatgagatggcttttagtttgaggccattagtgatttaaaatggtttatcctaatggagataaagaatgtcaaattaatctttctccacatatcctgaaataaaacttaatcactctcattgaatttgccgctttccaagtatggtgtttggattaaattagttagtatacttaaaatagttcctcgtatgtggtgagcactacatacctgtttgcttttatgtttatcgttattattaatatttttatgacaatatccatcatcaaagtctaattttctgggattatgaatgctctttcgctttcgaaataaaataactgatgaaatattctcatttttgaactaaagtataccttcaaggcaaattggagtgggactcttataatgtgatcaaaatagataaccaaactatattgctataatcagaaaagttttttctccattgatagaatggagggagttcccttttatccagctggctgcctcagccctccccttctacctatgtagacatggtctgtggtgcttctttgtctattgcatgaatggtcttttcctagttctgtttattgcatacacagtataaagaaaacagagagtttgactccagtataaagaggggtcttgatgtctggcatgattcaaataggcctattaacatatttttgcttgggtgttggctgatttcttggacttgaagtacctttgctcactgactttatttgcattcatgctgatgcagacaaagggggcctgttggcagcaattttgtcacgtttgcctttcttgactgtattcccctttcttgccttttttctcattgatgactttcctgtccaacttcctcttttgccttttattctccatctttctactttctatttctcttttcacaatcaagaaagcagagcagctaatatcactcaccctcgaactaaaaagtgtttacagctgtatgttgttcctcttaagaaaatacaatttaaggcttcctatctctaattgtgaaaaagaatgtgtttcttacagttaaagggattttgaaatccctgtattgagaattgagagtaagtgccgacaagcataattttagttattttttggcaggtgagggtgggaaggagatgcttttcctaatctctgaaatggggcttgcttaaagctgtcttgaaataactcagcatttaaataccttgtgttgaggtgttgaagcagaacaggtaacagagtatgagctagcccttctctttttaatttcttaattatccttcaaccactaaccttcttttcctttccttgaaaactctgcccttaatctgttttatttatcagagctctaggattgtacggttctgctccttggattcttatactggttgcccatagaaactctctgaggctttttgtgtctgccaagactgagacttcaacgcggagagcagctgtttcgaagggtcacagacagaaggactgggagggagtagctgatggggcttcctgttagggagtaagatagcctctctgtactttatccactttatctttaaacattattctgttccttaatttatccattcacttgttcatttatttattcatagagatcattcaagttggggaaatgagtgctaaaataatttattcatgcaatgtgataaatcttctcttcatctccactatcgtcatcatctctcaccaagacattctggtctaattttctggtttctacttttgtccgccaatatgtattttcaccacagcaaagcaattaaaaaattacatcatgccaccttcttatgtgaaaccaatggttctcaaatgttaatgtgcatcagaatcacctgccagccttgttaaaacacgtattactgggccctgctcccagaggttctgatttcctaggttcagatagggctcaagaaactggcatttctgtcaagttcccaagtaatgctgatgctgcttgtccagggatcacactttgaaccccctgctttaaactatatgatggcttattatggtagaataaagtctaaattctttctgtgatctggcctctgcctacctctgtaatttcatccctttccactttcctttttttcactccatttcaaccttctgttggtttctcaacttaccaaccttagcttcagggcctttgtatgtatcgtttcattcttatgcaatgctctttccccagatgtttgcacggcttattctttatatacatataggtctctgttcaaatgtcttctctacaggaaagcctgccctgatcaccccgtctaaagtatctctccatcacctacctcaaactccaatcgtgtcaggttgactttgtggaaaattttgattactatataaactctacatattcatgctcacttggagagcttcttgttcccatagcactgtctttcctccacctagaatgagcaagggggcattgaatgtgcatctttatgttagttgctctttaactcaaacttctagggaatggactaactttctgggtggtgtggggtggaaagattagtgaggagcagaagaagtcagtagcagacaggcaggattcactttagaaattaaaagcaactgaggatagaggaatgtctgtttataatggtactttttttctgatataattcttgccatagtgccctttcttctctttgtatgttgtggaaagattgtgttttgtaagtagacatatgaaacttactagacatatagtcaggttttgctatgaataatcttgggaaggttacttaaaatacctgagcctcagttttctcattttaaaaatgggaataataacagggttgtggtgaagtttaaatgaaatcttaatgataataatgtatgaagtcatataatcacataaagtagttagcatagtacctggtacacaaagataatcaataaatgaattgaattattattactactgttagtaaatgactcttttgcaattcaacttttgtggattgtcttcagtttatcctcctgctgcaaccttttcctgtcttccttgggccttttaaagtttagaatctgttgtttagcatctggtggtgaacatgcccagttcgtgttctaactgcagttttcttctcacagagaacatctttttcgttgatttttttttttttgactgaaatttctgtctctagagggcttgacccaactgctctcactcatatttctactacatgattcctactggtctatggctcacaaaaatggattgccatggcagggtagacgaagcacagatttcttcagtgaactactatgagagatgtgataatctttctgagatatagtgttcactcactatatattttaaacaataaagaataaagaaatatgtattcagaaccatgccagtaattttatctttttttttttttttgccagaataagcattgctgtgttaatatcatggataggactgttgccaaactcatattagtctgggacaccaattcttatagtcatctaaaattaaattgtattgctccaattattaatgtgggccctatgtttgttttatacagccaaccttctgttctctttttcttttgacaattgaggagaaattaagccagaataatttcagtagaacactagagtgaaattaagaatgggtgaattctgattactctgagaaacaaacttcaaggatattacttaagctttcatgatcagattttgtggcttattttaatctaaaaatgatctagcttcttttttatatatttacatagaaaaaaactgtatctttttgaacataaacaaattagacaaaagctaatatctcttgattgcttactatgtttgaggagatatgctgggcactttccatcttttatttaatcctaaaaatattgcataagagtactgtattaagcacattttacagatgaggaaattgaggttgagagaaaaaagtacttttttaaggtcattctgataaaaatggtggaggttgaattaaaaataaccctgtggggttgcctgtgtttaacatctgtgctccctgttccacctcttgagtgactcctgcattctggaaactgtagtaagcattttgcctaactggtttattggagtctgatctcaatgaggtgtacaaacatgaaacctttttatttttccctccactcacatcaagcatgctaggatacatccccttcgatattagcttagacagattgctctgttttccaagtatttccaagaattatgaagttcactctagaccaatttaaatttttactctcatatctagtctgactctaatgttgctttctctgtctgggtcaggacttggcctaagagacttggaatacaggacagagtgtatgatgtgggttttcactcctcttctccaggccattcttttctgtgtccctttctcttcggatgtattgggtgaggcatgaatgaaatggaaaatggaaaatttcattggggttgtagcagtcctctcttggctgtcatgccctcactagggtgcatgtatgagttccgccctgacacttttggatgccccagctcctgcacctaaggacttcactctcgtggtcttgctagtgggagccctgtccctggctggcagcctctagattggaagagcaccatgacaaccagacaactcaagcttgcctctctcttccctaacccatgggaaattcacatatttgccctgccaaacggtgggcctttaggttgctcccaattttgctctatttcttttccttgtcgataactttctccagagtcttcttcctcttatcagtcagacaggggagtatgatcaggaaatccactgcctctgcagatgttcactggggaatgagatgggtaatccccaatctctaccagctgtggacccccctcaccaactggacttctgcagggaacactccccttttctccttttctaggaggggagggggaaaagtaccatagcactctcttcctaggccaactcctcactcttctgaagattttattttgaagtctttctgttcttttgcttctgtaagctggtggtagagtgacaggggcagtggctgtttagtctcctcttaagtcctgaagaagagctctggtcttcttggctacccctttggaatgtgggaggatttggcctttaatgtcctcagcttttttgtcttagctctcattcagaggcaactcaaaaagtcccagccaatatccagttacaggcattgtgttatttagtcctcacaagaactctagaaggtacctccattttatgagagaggaaatttagactaacagagattaggttacttgctcaagatctcacagatagaaaatggtaagaccatgactcaaattctgccaggtgtatgttatttatacaccatactgctatcttcttctttttttttttttttttttttgagacggagtctcactctgtcacccaggctggagtgcagtggcgcagtctcggctcactgcaagctccgcctcctgggttcacaccattcttctgcctcagcctccagagtagctgggactacaggcgcctgccaccacttccggctaattttttgtatttttagtagagacggggtttcaccgtgttagccaggatggtcttgatctcctgaactcgtgatctgcccgcctgggcctcccaaagtgctaggattacaggcgtgagccaccgcacccggcctatactgctatcttcttgactgtgacaaaagttatggtgtgtttactttcaacaccattgaatgccaggacaccaaattaacattgttaacttttccttttctaggcagcttccttatagaaacagatcactagccttgatgaagtgctctcagagtgatacattagctgtacaaagctgatatattttttgttctcttcaatttttttcacacatagctttcttgttaacagttgcctccagttccaggtctacactgcaaatgctgatgtgaatggtgggttatgccagaattatgtctcaaagcttcacttattttaaaatgtgactatgatgaaagcatagactgcgtgtgcttgtgcgtgtgtatatgagttgcattcgcagatgctttcaaaaatttctccttatgctaattttgttttcttcttagttacagggatgcagaaaagaatttccacaatatctctaacagatgctcctatgcagaccactccaacaaagaagaaattgaagatgtctcaggaattcttcagtgtactgctaatatactcggtatattaactatatatatttatatggatgagagagaatgaaagagagggaaagtcgaggtggaagtgtttcatgttctaccaaagagagatgtggagaatatggcaagttgagacccagaccttgtgaagtgatgggtgttaactctcctgaagatgtttgagtggaaattgcttgcatgccacttacttagagatggaaaaacatcaaaacaaaaatacttaaattccagggaaacaatttcagatattcacatgtgaatagtattagctctgtataatccatatttctttggcccttattctcagctaaagttgtaggatctttttttcctctcagtcatactctattacttctgggaggtcctggttggggcagaagggtggcccacaggtactgttaacactctacaatccaatgttcctttctgtggccttgtcagtgaagcaggtcatctcctgaggtgtctgtgccctacttggggttaggggagtgtccatcttaaagatatttgtacttatgacagaggggctgtttttggatgctccaacatggctaaaaggtactgttgtaaattgcagccaattatacagccgtaagctaccataactgagctgtactaccatactacctgacgttcttggtgtgtgagagctacattgtattccatgcaatgtattctaaaagaaatattttttttcctaatgtcttacagatgtttctagtgagaaatttctctttaagttctttttggaattcttttttctttatgacccagataggaatccatggggtgctggagggtgctagtggggaataataaatcttagtgagcgactccacacagaatgcagaatctcttttggggtcaggtgatggacaatagggcaaaccagtttgcatgttctttcttttcctttatagtattttccctggaggcatctgagtttctcctacaaacagtttccaggttaccccaacccaagggtctatcagattttctaaacatgtcagacttctagaggtagacttcttttacattcaagctgggaatccagctgccggttggctacattttcatcctaggtaacttttgtaaacacaaaattgtataataagaaaatgtataccttttgtgaggggatgcatatagatgttagtggtttgtctataacagcatgcaggacagtgatgggtagtgaaaaggaggccaaagattcatcaccttaatcttagaacaactgcagggatgtcacaatacccaagtaaatcttatgactggagaaaataagggatgggattaaaagagacattacccaagagttgtttaaagttttctgattttatattttcaaggactctcctttcagtaacatacatttctcttaatgcattgtgatttcaaggggtggggtgatgatgccacactaaaagggatgtatcagaatctcagtgaagggatgtttaatattttgagaagttgcttcttatccagtttctaaacactttcctgaccctcacgtctttcttctttatgctccctatttttagaatcactgagttagagggaataggaggtgttcaaagataatgattatattggggtgctaaaggcagttggactgtggcttgtaaatgagtgtgcacaattcccacggagagaaaccctgggtcaatttgaaatggttttcaggggacactgttggcccagcacagcttagttgcccttcgaaggttgccctaagatgttggataagtagtgagtgagaagaacagcaggcagtgtgctgcctgatgacattagggtgagtgcagtgtttataacttagaaggtgatcatgtaacagggtttagatttccatgaatagtaactttttctacaaaagagatactaggtctgattattttcttcctctaagtaatgataggttgttttcaagatttaaagcacaatcttgtaaagtttaaatttctgaagattaacattaacattaacatttaatgcctgccacctgtcaaccagatgctggcacagaggtagctgttctccttgaataatgtctttttagaactcttgatatattgactctctgaggacagcgttagcggtcatattcaataaaagctttgtttttaagaagtcactgagctatgattaatcttggcttgtttagatttttatctttttttaaagttgtgtttaaattctcttctgtaatcatatatgagaatgaaagaattggtcagcttactggacagaaaagcatgacataaattgttttttgggaggttgttggggggtggcacaggaaaacaacatttcaaccaagataagaaaaattttgatgcctgggaacctttttttttggatggcagaaggcagtgttccaactccatggtttatatttatcacctttggggagtgtgattagaatattggtggactgagattggcaaacatatatttctcttaccttcttaacctattacagggttgtattagagtctggaaatgtgttcgtttattcacttatttgtatattatttatacttcatcatcaaaaaagacttgaagtcatagatcacaagatatgatcatagtagcaatttttctccttccaaaatgagcatttctacctacttagtataaacaactcctctagaaagtttggtcatttactggctcttcaggttgaagtttgcatttagagggtggcatggaataaaaacgaggacctgaggagagggagaaagtgagttggagaagacctgttatgcctctgtcactcatttgttctctcacctcttccatgggactccctgggagcacatgttgtgccctacaaggtgtttcatgcctctggagtaatgggaaagaactgcttccagatatcaaaatgtttgatgtctgtttccctttcgttggtttagaaactggttgtttctattttctgtctcatcatttacaaattacggatattgattatggtctgtttcttgccatctcttcaccatattttggtgctttgccaattgctgtgataatggaggctgggcccttgaaactctggccatgcaaagaaagatagtagacagtgccctccctgctggaggactttagagttaaatttattgctttatttggtacataatgtcttttgcataccaaaatgatctaattttagttgtccaaaaaatagaaaatcttttctagccctaatctgcaaagcctatttttagctcaaattaaatagtagaaatgtgtttatgctctatgaggcaacatttagtattttcttggaaattgtaatggttgaatggtatgatgaagcatgtattaaagcatgtgtaccatgttttctgctgaaatgttgctacttgttcttatggattgggtttacatagtgttgtaggcagggagacaaagtgagtaggagagttaagggagaaggatgataaattgcatagtctcctttgtcataataagttaaatataaatgaggttatgactatttcagttttaacaagttctaatactattaagggtgttgtgggtgtttcagttgttgtagagctttaaggagctaccagatgggggagttggggtgtaggaaaaagacttcccacagtagtttagagaacaaatagaaatgagagctctaggttaattcatttactgaggagttatagcatataaagatttgcaggtttaggaagcatcagttatttgctaagtattgctcaaagtatagttttatactgcccttgctaagtgcatttcctctcaaaatagtcaggaagtgcatagttctgaaaagatattcattgatgttttctctgttttaaaggtctctctctgtcagagtgttgctttatcttctctaaaaatgtaacacatttaagtcagaatgggagcaatgcttatcatgggattattttattgggagagggctagtaaggaggatagaggaaatgacctttggggcttattcctcacaatattttcttagtatcagggatcctgaaatactgtgaaatcatttataagatgccactgattccacaatctttagctggtatggaactctctgtttttttataagtaatgattttttgcttatatgtcaacttgtatatacttttttgtttcactgtgatttgtaatgtgtatttaggagccttttaattagtcataaaattgtgaagaattagcttaaggttaggttaagactaacttggagattttctgggaataactctaaataatataattgtttagtagataagaatatgtttaacatatttgttatcttggagaactagttagtgtagtaacaacttaccatatttattggtgagttaagattaatagcaataaataacttctgccattatagttcttgttactataacttggtaactgatcaatttcctctttcattaaaagtaaatattttcagtattttactagaatgaattggaattaaggcggttgaaggggaaataacttaataatgttactataatgtagtgatttagagcaagactggagccagactacttgggttgaaaatgcatctcagctacttactagctgcacgaactggaatgatttacttcatctttccttacctcatatttcttatttgcaaaatggagataatataattgcacacttcctagagttgccaagacgattaaatgagttaatttatatcaagtacatacttagaacagcatggtatataacaaacaaatggaacatgaatgtttgcttttattattattgagtattccccaaataatgtttgcatcagatgcagaaggtttgcttacttttttaggtgagaaaactgatactttgcaaggttaactaacttgttgatatctttggtcagagttaacaagccacagaggcagaatttaaattcatttcagtctgattccaaacctcatgttcttctcattactttgtgctgccttccagagttgttgactgtgtcatcactcctctgatgctaattacacaccacctttccagttctctgaattcttagaatcgtcatgatgtcacattttgcttagtgctttgctctttcaaatgtacttgggatacttgcttgtatgagacaaacttcttgtcagtattgaggaaagttcagttgtgttgcaatttggatcatttcagtttagaaactaggattgttctttagattttaggtgttgaaaatgctaactaagggtgatggtgtttcccatcacaacacaaacgtggtttcatagctatgctatagtaaacactgtgacagtttttttgctcatatttcaagctgatcttgctacgtagctggcctcatgtgttagacatcattaggccagcacaaaacctgcaaaaaggctgtgtttctgatgttgttgatttcttttaatggaaaagtttaagaatatcatcatataatcttattaaacaattcctaaacagagactttaggtagtggctctgtgtaaattagagacaacttctgtattctgctctctgcttacatactttccctgagatagttagatacagtagatagtcctgagaaagaatgagaccattgtatatggacactgcttcctatatgtaaaggataaacactataatacaaacatatccttaagttatacaagtcagttttataagttacaaggatattgagtatgtagccttttcgctggcttcttttgtttagaagtgtgaatttaagactaatccatgtctttcacagagagctcattcctttcccacaactgccctgaaaaatattccatttaacatgtaccacagtttgcttatccattcattgattgaaggataccttgattctttccatttttggttattggatattgagtggaatgtggcatagtttccctcttctcctagatattttttctcttttaggaacatcttcttctgaatcttgtgacagactatttcccatttgtcctgctaaatttctccagacatagcttttcttttttgctggaagaacatggcagtcctttttcttaattttaaatttgtgtttctgtgtctctaaagcattgtttcgctatcactagcagctttctgtctagcacctcttctttgtgtgaagggagaacaacccttcagattcctaaattcttcaggttgtcttttgttctcttttctgaactcttcagtaggttggtgtttatttttcgtttccctttaagttttttttaaatgaagttttaatgtagttttaggtttataaaaaagctgtgaagatagcacagaaagttatgatatatcccacacccattttccccatttgacatcatacattaatatggtactttggtcccaatttataaaacaatattgataggttattattaacaaaattccatgctttatttcaatatccttagtttttaaccttttcctgttccaggatttcatttcacattacatttagttgacttatctccatagcttctcttatctatgacaatttctcagacttatgttgtttttgatgaccttgacagttttcaagtgtactggtcagatcttttgtttgtttcctgtttgctttggtatgtggcaatatgcccatcattggcctgacatatgcccatattgtgtgtgtctgtgtgttcatagtgtgttttgagcacttccttacttcccagcactataagatgttccagactcatctttcatactttctgccccagttgtctagaatgagccatttctctcaggagccctgataccttttattggagaatggtattggaaaccatgacctgggcattggttgtactcattgctattggggtgttttgcttctacgccctctcagctgacagagcaagagaatatatgtgtgtagactaactcatatatatatgcccatctataaacatttttatatgtattcatcatatgctaaatatgagttaatactgatgtctccaactttactccattaccatatggatcattctaacctttccctcttgcttgtctatatccttctttctaacaaggagaaacctgactccctttagccatccatttactgaattcttcaattccagtgtacgtttatagttgtttcagaattgttaacagaaactcccaggggaaacaattttatcaactaaaatacagtgcctatgggcagtttgggagtatgtagttatgtataaagctttatagtgtccactcatatccagggttacttaggtaagcacctttctaccccaccacttccagtaagatttttttcatatatttgtaatacagctagattcttttattatagtcttccatcctgtgatactttgacctcctaaacacacacacacacacacacacacatttaaatttgtatacagtaagtttagctcttctgctgtaaagttctatgggtattgaaaaatgcataatgtcatataactgccattataacatcataccaaatacttgcactcttctaaaaaaaatcccgtgtttcacttgttcaaccgcatgtcacctccaaatccctggcaagtaccgatctgtttgccatgctatagttttgccttcaccagagtgtcatataaatgtaatcatatagtatatagccttttcactggctccttttgtttagaaatgtgaatttaagattaatccatgtctttggcagagagctcattcctttccccccacccccctgaaaaatattccatttaacatgtaccacagtttgcttatccattcattaattgaaggataccttggttccttacatgtttggttattatgaattaactgctataaaacattcacttgcaagtttttatgtagactacattttcaaatcagttaggtaaatacttaggagtgcaattgttggactatgtttaaccttgtaagaaactgtcaaagtgtcttacaaagtggctgagccatttgcctttccaaaagcaatgaatgagacttcctattgctcttcatcctttccagaaattggtattttccattttttagattttagccattctaatacatgtgccttcctccttgaagttttaataaacaaaagcagcacctgttatctctttataatttctgcatataccaattataattaagaattttgttttctggttttgtcattctaaatacttttcctgatattatgactgaatttagaaactgcttaaaaatttattagtgatagcaatgattgcccatgatactactgtaataggtagactctttctcttttgcttagtaacaataagttcctggaatgaagttattcagcatttattcactgggaaatgaaatattttaggaatttcagtgtaactttgaggtgatataaccaacagggtcccatttgttgaaggtgttgaaatataagatgtccacaaatggtctttgttaatatcgttatgctctcctaacccccagcttgcctgagttaagattcctttcaacactatcaacagccagtgagtcaaactcacttaactaaagctcctttactcaatacattctcataacaaaattctcaaatttcttagaaactcttctatttttgttttctcaaagatagtattactgccatttaaaatctgcaaaactccttagttggataaaacaaaacagaacaaaacaaaaacacttagctctgacttggagcagaagaaatggaagcacagctaggtcaggctgcttgcatggggtcacaccattagcctctggggagggcagtgtttgaactatgaggctgtgatggtagagcctgctacattacttattgacccctcaactgcttctgttaccaaacagtaattgttattattgctttttctctgagttagaaggaagattattcttcccttactatgtgagaaacatgattgtgggcctgtaatcacttcatatgtcaaactcatagcttattttgttgccatctcatggagcagatttatagtgacttgtcacatttgctttttgaaatactgtttttttttgtctttatttctttgaatcttttagctcaagtgagcataccaccttcctttctcccccaacccttttcttttgtgttagaagacttttgttaagtaaatgaattatttcccattcatgaggctgatgtttttgtccattgtgttatctctctgctttcattgttctttgatgcataactctgactcaactacaaattttaatagcattctgtttaattcttctgacagttagtgaaaatttaagtaagattagagttaaattcaaacatcctgggttctatgctagatgagttgttgttcttactagtcttgagttcggttcttcagtcaattttaagtacttttgacagcatttctattgtaatttatttaaattaatctgatgagtagagttttatgtgtcacaataaagatgttacttaaattaagacattttatatatggtaaattccccttatgatcccactgttagtcccatttttcaaaagcaaaaatattaatctcttattttctttgagtctgctcagttaaagatttccatatgttaaattttccatcagggtagctatggactcttatgtatcatgggtgatttttataggtgttttggagtgctcttttcccatttctgttactcatagtagtacctaaagtgacatcttttcaaatctaataagtttgagaccaaacttccaattcctggtctgttgtggttttttcctatatttccacaaagtctgatcttaaccttgagaaatggtaagttttctagtatgaagaaagaagttgtagataggatcaggttgggtagagagattgttgggtggtagggaatggtatgggatgtgaggactaggcttcatttcccaggtagaaaagggcagttagaagaaccagtgtaggtccccacagaagacatgactcattgatggaatggagggagaacctccagtgttggtaacaggcatgaaaataaactggtagagcatatatagaagtcaactaaacaagaaacgcatgtgattttcataagcaaggatactgaagtaattcctgactcctacataatggtcaggattgaacattgtccagagccagataagtaaaagaggaaaaaccaactctgaaaatatcaattttaattttgatatttatacatttatgcttttattcttcctagggaaatatgattgcattattgatttgaatcctaatcccaaaaatgcttatgtctatgctagactctagatcagtggaccttacattccacaagtgattgtacagtaggatcatcgagagacattaagaaataaaagaggcctatagacatgatacccagatattttgattaatcatatctagggcagagaccagaactttgtattttaaaaatacattctctagataattttagtatgcacccatgacttttaacaatttaactccaaggctaatcctgctcttgggcaaggatgcttaagaaactgtagtcaattcttaggatatttgataccaagtcacctctactgttagttggtactttaaaatcctgtgtttctttctgtcttatttctgaaagtgggttgttgccttgtactccactcaattcttttgacttattcctacttctcttcaggactttagttctatttctgaatcccacacaggaactggtgctctgctttcattcattgctttttgtcttccagatacatgcttaatgtctcttgctagatgctctgtatttatcttttgctagatgttctgtatttatccctccctccctcccttcctgcttccctccctccttgcttccttccctccctccctccctccctcctttcctcccttcattccttccttccttcctgcctcccttttgccttttctgtatctctttgccaaatctccttcatgctgataactgctggcttagattactggcttagactgccatcatttgcatcacccaattagaatatcatatttttttctgattttctcctgtttatgtataagtgggcatacctagttctagataaatccctccctttattcatcccatgtcattaattccacaatgacatgcaatagggttttgttcaaactaatgtcagaaatagtgggtcatgcattgttttcataaaatgcctggttactgctagatttttttacttgagagctttagataacactttcctgtccactattactattgttaggatcagaaatcctattaattccgagaggacagtgttaccctagggagaaaataaagtgggcaatagaatttgttgctgcaataggaaagggaagtttatacttgtctgtgagctttcataaagcagagtcattttaggatctttgcgaagaagatatcaagggatttcagccagagaacaagcagaacagtgacaaatgatcctgactcttgtgagttactccactgagcgattagtgcccaggaaaacgttgactgaaaatacccaattgccataatttttctgcttttcattctctgtcttctggttctgtgtacttccccacaccattttatgagacttcattcacctcttcattcacttctagtacctcagactgtttttcattaacctcttttttttggtttgtttctataacctttctattttcattattcttattctcaatcttacattttaataaaaagcaacaattcaaatctgccaaacgtgtttacttctcttaatttgtcagtacatttttgctttagtgctatttttaagcttaatattccagttgccaaatttagtagtcaagcaactctaacttactgcaaatttatacaatttctttaattcagagctctaaatgatcactagggtttcagctggactagtatattgttatattaactgcaggaaaagattgattaatccacagacgtctgtatataatattgtggaggaaatatttgccctattaaaggaatagtttttaagtactttgttccatcaatacaaatatttattgaatattttgtatttttgggtactgttctaggtactggtgatcatcagggagaaaacagcaagtgggcagccaggcagtaaaaaactacagacaagtaacaaatacgaaaacttcagagtgatgcatgctgtgaagaaaaataagacaatggggccgggcgcggtggctcattcctgtaatcccagcactttgggaggccaaggtgggtggatcacctgaggtcaggagttcgagtccagcctggccaacatggtgataaccccatctctactaaaaatataaaaactagccaggcctggtatgggcacctgtaatcccagctactcaggaggctgaggcaggagaattgcttgaacccaggaggcagaggttgtagtgagccgacatggtgccactgcactccagccttggcaacagagtgagactctgtctcaaaaaaacaaaaaagaaaagagaagaaaaataagccagtggaatgtaaaagagtgtgaagggcttaaataatatgttaacgataatattcttaaatccatttaagcaactcataggatttctatatgactgtagtatttgtgctgtttcactgatatttctggatttagagctccagaaatgaacttttttttttttttaaccttcactttaatatggaggaggttgaggttaatgaaagttctggtttctccactgatgtctgagtagcatttgctactctggatttatttaagatgaatgaaaggagacagtgaggctgtagcattgtattttgggctagacaaagtcccgagtggtgttcatcatcccaccagtgtgttttgaatacctccatgtgccaggcctgtgctggccatgaagatttgagagtgagtaaggctgatgtcgtctctgctgtcctggctctgtcagcatagaagctaatgggaaggccacatggcaggaggtataaaacttttctactcagtggacagaatgcaaagctgcttgagtgtgaccactagaagagagccatcccaagagaagtggaagtaaaatccacaaatcaaatgcatacttaagctttctcttgctgttgttttctttttctccatatacacacacatacacatatatgcctatatacataagtacatacatacacatacatgtatacatatgtatgtatacacatgtataaattatatatgctttactatttgtaaggatttttcatgtatactattttgtaccttgctaaagtctataattaggtattattatttccattttacagatgaaggaattagacccagagtgtaagtactttactccaaatcgcttagccaacaaatgcttgcagctatatttgaatatagttttttaaactacaggaaaggagtaccgctctttttaccatgttgcatttttctctgtttccaaaaataagtggtaattgtgacacatcttccattaaaagaaccacctctgtttcctaaaaaaaaaacaacaccctgtgtttatgtattagtatatactgctacatggtactgtatgttattttggccaactccctgaattaaaaaatatatatttttctttttttgagatggagtcttgctctgtcgcccaggctacagtgcagtggtgcaatctcggctcactgcaagctctgcctcccgggttcatgccattctcctacctcagcctcccgagtagctgggactacaggtgcccgccaccacgcccagctaattttttcgtatttttagtagagatggggtttcaccgcgttagccaggatggtctcgatctcctgacctcatgatccgcccgccttggcctcccaaagtgctgggattacaggcatgaggcacctcacctggccaaaaatattttataaataccttttgccaatgattattctgtgtctgtgctgccagagtgagcactgacaatatttattctgggtatgaaagtatttttctgactccaaatgagagatagaaaaacagatctagagagcaagggttttgagctgataaaaataggaggaacccagcttatacttctattaatgcacacttcatgatgtgcttcctaattgtttacatgtctttctctttgacttgaatgtaggtacctagtggtcaggtacctacatttaactctttggggcctatttaactctttgtaaccacagcaggaaggccagaggccctggaggggtagctatccaaggattattgtttgaaagacaaataaagactgaggagtattcttgaagaaaggaaactaaagacacaagaaaaacaaatgcaaagcatgatcctgtactggatctcggactaggaaataatacaactataaggtatatcattgggacaatgagcaaaatttgaatatagattgtgggttagaagatagtattgtgtcaaagtgtacatttttatacaaggaagtattagggatgaaggggcataatgtctgctacctactctcaaatgatgtgtgggtgtgtgtgtgtgtatacgtgtgtatgtgtgtgtgtagcaaaagagaagggggaatgagagagaataagaaagcaaatggcacaaattgttcacaaatggtgaaacgagatgaatatgagaatttttatactattcttgcaacttttctctaagtttaaacttatatcaaaataaacatttccaaaaatgattgaataaagttaaaatatattataagtccaaaggaactttgtttttattgggttgtatccccaattaaaaacaaacggacatcaccacaaaactaactaaaataacaaacataagtgagtttaagagtttgcagcgtatttttatgctgctataaattcctagtatcacctatgaatgcatcaaattctatataattagtgtccagattggagtctatctgtggagtttattttccttaagttttgttttctgtctcccttataacgtgatttggtgatatggagattaaggatgaaattggaatagtgtctgaacgtagtcccactctgtttatctcctattgcagggcaattgataccagaataggtgattggttcctgtatgttccagaacatttcatttctttcttctacacagaaaaatattgctcaagaataaaatcacattttcaaagaataaaagtaaaaataaaactgctgactacttctattgcttaaggtaccgattttcatggtactatattgagtgacatctatacacggacatgtagctttcttcttgtcatccctttactattatgataattttggacttcccaaatactttccttgaattcagaagcctcatcaatcattgacatattctcctctgtagactctgatttttttattgcttccctgacattttaaatagccagtatgcatcatttttcatggcctgtcatcagtcattagataatattgcaatgtgctatcaaagtatttctatatttagtagcagtacattctgtatctccatatagcattgtgtagaattagttacacaggatcttcacttaaagcaggacatcacactaagttggtgtttagtgtttactgaactaataggcgtgtaaagtcaactgtttagaagataatatagctgtacatggtcaaaattattaccactgcctatatttttaaattaataacaggtcagagcataagcacatgatggatattcatttccctttttgttggaatagacaaaagatcagtttcaaaaatggtgttcatttcagattatacatatatgtgtatatatattttatatatatatataaatatatataattccttaaaactttaattgttgcataaaaatactgaggcttatgtaaattattctcacatttcaaatttatttgaaattaaaaattttaagcaaacatatgcaggacataatcaggtattctgtctatgtgatttaactccccccacctactcccacaattcctgcacacactcatatacagactttcatttctagtttttttttttttttgagatggagtcttgctctgttgcccaggctggagtgctgtggcatgatctcagctcactgcaacctctgcctcccgggtttaagcgattctcctgcctcagcctcccaagtaggtgggactacaggcacatgctaccacaaaaatatttgtattttttttttttttaagtggagatggggtttcaccatgttagccaggatggtctcgatctcctgacctcatgatccacctgccttggcctcccaaagtgctgggattacaggcgtgagccaccacacccagccccatatacacattttcatgctgtcatggacctcatagtcctgatcctttgggaacaaaattttcaactaaataatagaatgaatctagtcctgttaataggaggcaaaaattcaagtaacagtggtattcactgaccattgttcctgctctcaccttagtataaatgttgggaaaataggagggatttgtgggatggagtaaatcttggtatctccacataggaactttattggacttaactttattcttatttgtctaagtctttgtttggatagttctgagtagtgaaacagggatgttagtagtcagctctacagacagcagaattgaagtctatagtccagttgtttaaaatgaagattgcctacattgggagatttctacttagaacaaggttaccatagtcacaaggctgaaaaatttctcaaatatctatttgacttctagggcaccaagccaactgattcactgttagtgggatagaaaaaaaacaaactatgtagacctttgacattcttctgcaagctagaaaggaaatagcaataatatactggcaaggctaggaatgtgctgagaagagaaaagtcagcttgcttctttaattgtgactcttttttgaagcacacttaagaagcattttgaaaggaatgtggcatctttcatcatgtgtgaattcaagatcttatagctttgtaatatctttttcctgccaagtactagattcggttgaccttttggataatgcatttttgtttgctttcaaatattgagaaagatctttcatataaccttctgttttccttaggaattaaatagtgttgagggaatcttaaaagtttatgggaaaaaataaaagatccacattcagacatctttgttttatatctcttttagctcagacagccctaagtctacctattaagctatttataagaataaactaagtctctggtgctgttttcttcctgcttctgcttgtgtttttaacattcctatgtcacatatttttcttgccttcgttctctaagaagtggagtgcctttgtttgtttatgactctgcagtgggggctgctctcctttgggcatttcaggagggtgagtggcaggacacaagttggaatgagcaaggtgtgctcacaatgcattgaagagactagtctaatctgagatgtgattcttgttggtgcattataaaaaatgagcacagggaatggttcttatgctgtgtctgcaggatatgccagtgcatctcactagataaattttgttccacttagcatccttccttcctcactgttccccaaatttaaaggtttggattttcactaatatcgtctaatctctggcactcctttccatgaaattgtggtatgtgtcctggtgagataattagaaaattggtctgttgttatctagttgacttggtgcttgtgttggctgttactttgttcttccttaactcttctttttagtcccttctgtgctagcttctgtagaaaagaggatttaacatactcacgtgcactaccgctgttaccaccatcatttttgctttggaatggtgatgatttaagaacttaaaaccaaaggcttaccagtatccagtccgtattttctacattatctacatttccccattaatgagccctcttgaatttaaattaaaatgtaaaggaacctgaatatgcatttattcattcaaatatctattcaacaaatatttattgctctctagatgctggcattgtgtaggtactgatttactcagccaagtacagtagagtgctgcacaaattaatagcagactactctgttctccttttattttgggcttctcaggcatcctgtgctgagtcttggatcaaaaacacaacaatacagaaaataatctgttctaattccttagtgttcctggtaatatatcttacacttggacttatggcttatagtactatataaattcttaagaacaatagactgaaatccttcatatctttatcttagtaattgcccatacctgagatttaaaaaaaaaattcaaaacaagaaaaaacatgaaataacagcttagtgctgtttattgaatgctcctataaaaagacaaaatattggcaacaaccaacagtccaactataaggaaagagtcagttaaaatatgatagctctgcttagaagaattttaagcagccacttaaatgagaactatgtggaaagattatgctacagcatgggaaaatgtttgcgatgttgctgtagctctagttccccaggaaacagactccaacatggagatttgcactcagacaggctcctgggcagtgtgctcaggatcagtgatcccaccaggcaaacttcattaggtttcaaggcctgagaatgatcctttgtggttctcagctctgccttttgggtcattctcatgaaaggtagtaagtacatgtttgcagctgaggagttttaccagactgtttccctgtgagaatgtaaagaaagtagatggggcagagggaaaaattgaattgctcttgcagaagccatcacaacagaggtctcagctgatctcttcagaattgcccctgactggggcaagaaggaggtatctttttgttatgactccccactttccaaatgaactatctttgaaagcagcttcccttgcggaggcaggtggatcttgagccggcagctctcttcagctgaaggcaatgcctagagtcagactcagttgagagctgacagctacaaacactcccagtatctgttagagatgacagattatacaaaaaagaaaactttatacataaagtgtttgggcatatcatgaacattatgaatccgagtacataaaatatgtgtgagtatgcacaaaaactggaggggacactgaaaaaatgaatatggctctgttacaaaagaaaagagaagccatgagagcataatcctttcaccaaataaacaatgaaaccaaacagatgatagtttcctctaaaataatgaaagaattcatgtatatattttcccctcctcactcaattttaaaagatgaccattaaaaaaattctttcaggtctcagcctttcccttgtgttttatttgtggaatatgttagagtgggataatgacataatgacaaacatagctcagtgttctgtgagatctactttgagaccgtaacgaatatgaatagttgctccgcttggcatgcttttaatctttcctagggttgcctcacccacgatgctaaagaagcagtgcttatgagttcagtaagtacatgcaccactgatactcattttcacggctctacatttcttcctttttcagcttaacattttatatattcatgatcaaaatggaattgggcatgaaaaatgtgaacggcacaaggcaaataaatacaatactagaaaaacagtttgaggtgtatatgctagtgaagaagaataaacctgaacatctattttcccaggttagagcacatatacacaaaagactgtaatcctggcataaaagtttctcatgttagctccccttatctgaaatagacttcctatttctcaactgctttcttatttccttccaaagcataactcgtagtatccttccaaatcatacatactgtgtgtgtgtttcctagtgtacccttttttttttttatattaaacagttctttaaagctgcctttaatgcacttggaattacttctttgaaaaatacaagatgagaaaagacaggagaacatgagaactattttcagatactttaaaggacttctgtgagaagaggagatttgttcaaatcaccacctagtatatgagggtatattagaactagtggactaaaattataggaatagattttgccccacatgcaagaaggaaggaattttgtaattactggagatattcagttttggaagagcaagcttcctgagctgctcatcagggtgctgtttaagtagaggaaagatgactgtctatgagatctgctgtgttttgagagagattggactggttatcagtcaagttctcatgtacttgatggcttcatgaatcaatgttatactaaatggtgtattcacaaattctgctttaaacaaatatatacgtaatcataagatttcatcttccagaagtatagaagtattagcattgcttgtgaatgctgtaaaaatgctgtgatgctactgtaatagctacagcatggaaacacaataacatactaatttctgtcactcttaacatctaatgctgtttgtctaatgaaatacattttagacctttggctaagtatttattacctaattcaataggaaaattgaaaaaaattttagatttccatcaatttcatttctttaccacaacaccttttttttctgaaaaaaaaaaaaaaaaaaaaaaaaaaaaaaaaaagtttgtccctttgctcagactggactgcagcatagctcccaacacttggttggagcagttgaggagggtgaatcacaatttagtgatttaaaaaaaaaagtgaccattttttttggaggcggggccaagatggccgactggaagctgcgtgttcagaggctcccactggaaaaaaaatctaagcatgtgaatccttcatcagcaaccaaggtattcaggttctctcgccaaaattgacaagaaggctggcctgaccacagagagaaggaagagcagtgtagtgagaaggcccacctgagagccacacggggaaggggaagccccttccccaagccaaaggaggcggtggtgagtgagtgcgctagggaaactgctttttccacagaaccctgccacccatggattggaagatcccactcgtgaacccacgccaccagggcctagcgtcccagccttggaacatgcagattcttacagcctctcagctggagtctgcttaagcctatggaactcaggaagtgggggttgctggtggggaggggggaagaagaggcaaccagcaccagctgtggctgcctgctgtctaagccatttgagctcctggggggaggggcaagagtcagcactgggacttgcaactgcctaacacactaagctccctgggcagggtgggcacacccatttctatagctccaggctgtactttcccctgctagagctagagccagggaggctggacgacttgctcccaagacttgtccccacagcccaacacaccctctgtggcagtctgcggctagagtgcctcttcaggcctaatcccaacccatcattcctcagtgggcggggcttccctgcaggatctccaataactccagctagaggctcggggacagaattcagatctccctgggcctgagtccctagggagagggatggccacagtctctggggaccagcagacttgctgtctcctcttggtagttctgagaaatccaggcagctcagatgagtgggttttcccctagtgaaacataccctctccaccaaaggacaaagtgcttcattaaatgggtcctgctccctgtgccacccgattgggtgagaccctccaacaggggttgtcagacaccctatacaggagtcatcctactggcatcaggttggtgcctgtcgaggtcagaggtcccagaagaaggagcaggcacccatctttactgctctccagactccttgaatgacatctccaggaactggagcgaatcacatgaatacgacctgaagtgaacccctagcaaactgcagcagtcctacagaagagggaccaattattgaaagaaaaacaagcagaaagtgacaacagcatcaacaacaacaacaacaacaaaaaggcctccacaaaaaaccctatccaaggatcagcaggctcaaagactgaaagtagacaaattgaggaaggtaagaaagaatcaatgaaaaaatgctgtaaacccaaaaggccagagtgcttcatctccaaatgattacaatgtcaagggcacagaactggagggaggatcagatggacggattgacagaagtaggcttcagaagatggataataaaaaactatgatgagctaaaggagcttgttctaacccaatgcaacgaagctaagaaacttgataaaaggaattgctaactagaatacccagtttagagagaaacataaatgacctgatggagctgaaaaacacagcatgagaacttcacgaagcatacacaagtatcaacagccaaattgaccaagcagaagaaaggctatcagagtttgaaaactaccttactgaaataagacatgcagacaagaatagagaaaaaagaatgatcaaagtcttcaagaagtatgggacttgataaaaggacagaatctgcgattgattggagtaccagaaggagatggagagaatggaaacaagctggaaaacacacttcagaatattatccaggagaacttccccaacctagcaagacaggccaacatgaaaattcaggaaatacagagaacatcattaagatactctgtaagaagatcaaccccaagacacataattatcagtttctccaaggtcaaaaaaaggaaaaactgttaaaggtagccagagagaaaggccaggtcacctacaaagggaagtccatcagactaacagtggacctctcagcagaaactctacaagccagaaaagattgggggccaatatttaatatcttaaataattttcaacccagaatttcacatctagccaaactgagcttcataagcaaaggagaaatgaaatcatttccagacaagcaaatgctgagggatttcattaccaccagtcctgccctgcaagagctcctaaaagaagcactaaatatggaaaggaaaaaccagtaccaggtactgcaaaaacacagcaaaatataaagaccaatgacaccatgaagaaactgcatcaactattatgcaaaataaccaaatagcatcatgttgacagaatcaaattcacacataacaatactaatgtaaatgggctaaatgccccacttaaaagacagactgggccgggcatggtggctaacacctgtaatcccaacactttgggaggctgagatgggtggatcacctgaggttgggagttcaagaccagcctgaccaacaaggagaaaccccatctctactaaaaatacaaaattagttgggcatggtggcacatgcctgtaatcccagctacttgagaggctgaggtaggagaattgcttgaacctgggaggttgcggtgagccgagatcatgccattgcactccagcctgggcaacaagagcaaaactctgtctcaaaaaaaagaaaaaaaaaagacacagactggcaaattgaataaggagtcaagacccatctgtgtgctgtattcaggagacccatcttaaatgcaaagacacacacagcctcaaaataaagggatggaggaaaatttaccaagcaaatggaaagaaaaaaacaagaaagcaggggttgcaatcctagtccctgacaaaacagactttaaacaaacaaaaatacaaaaagacaagggtattatacaatggtaaggggaagaattcaacaagaagagctaactattctaaatatatatgtacccaatacagaaacacccagattcataaaactagttcttagagacctgcaaagagacttaaactcccacacaataatagtgggagactttaacaccccactctcagtattagatcaatgagagaaaaaattaaaaaggatatttaggagttgaactcagctctggatcacgtggacctagtagacatttacggaactctctaccctagatcaacagaatatacgtccttctcctgtgccacatggcacttaccctgaaattgaacacatattttgaaataaaatactcctcagcaaatgcaaaagaactgaaatcgtaacagtttcttggaccacagtgcaatcaaattagaactcaggattaagaaactcactcaaaacgacacaatttcatggaaattgaacaacttgttcctgaatgactcccgggtaaataatgaaattaaagcagaaatcaaaaagttttttgaaaccaatgacaaagagacaacataccagaatctctggaacatagctaaaacagtgttaagatggaaatctatagcattaaatgcccacatcagaaagctagaaagatctcaaattgacaccctaacatcacaattaaaagagttagagaggcaagaacaaactaatccaaaaggtagcagaagacaagagataactaagatcagagaagaattgaaggagatagagacatgaaaaacctccaaaaatcaatgaatccaggagctgattttttgaaaaaattaacaaaatagatagaccaatagctagactaataagagagagaagaatcaagtagacacaataaaaaatgataaatgggatatcaccactgaccccacagaaatacaaactaccatcagagaatactataaacacctttacgcaaataaactagaaaatctagaagaaatggataaattcctggacacatacaccctaccaagactaaaccaggaagaagttgaatccctgaatagaccaataacaagctctaaaattgaggcagtaattaatagcctaccaaccaaaaaaaaaagcaaggaccagatggattcacagctgaattctaccagaaatataaagaggagctagtaccattctttctaaaactattctaaacaattgaaaaggagggagtcttccctaactcattttatgaagccagcatcatcctgataccaaaattaggaagagacacacaaaaaagaaaacttcaggccaatatccctgatgaacatcgatgcaaaaatcttcaataaaatactggcaaactgaatgagcagcacatcaaaaaacttatccaccatgagcaagtgggcttcatccttgggatgcaaggctggttcaacatatgcaaatgcataaacataatccgtcagataaacagaaccaaagacaaaaagcacatgattatctcaacagattcagaaaaggcctttgataaaattgaacatcgcttcatgttaactctcaataaactaggtattgatggaacatatctcaaaataagagctatttatgacaaacccacagccaatatcatatggaatgggcaaaagctagaagcattcctttaaaaactggtacaagacaaggatgccctctctcaccactcctattcaacatagtattagaagttctggccagggcaatcaggcaagagaaagaaataaagggtattcaaacaagaagagaggaagtcaagttgtctctgtttgcagatgacatgattttatatttagaaaaccctggctgggtgcggtgactcatacctgtaatcccagcactttgggaggctgagataggcagatcacctgaggtcaggagttcgagaccagactggccaacatggtgaaaccctgactctactaaaaatacaaaaattagccaggtgtggtagtgcacacctgtagtcccagatattgggaggctgaggcaggaaaatcacttgaacccaggaggtggaggtttcagtgagctgagagtgtaccagcctgggcaatagatcaagactctgtttaaaaagaaaaaaaaaaccctcatcatctcagcccacaaacttcttgaactgataagcaacttcagcaaagtctcaggatgcaaaattagtgtgcaaaaatcacagtcactcctttacaccaataataggcaagcagagagccaaatcatgaatgaactcccattcacaattgctacaaagagaataaaatacctaggaatacaactttcaagggatgtgaagacctcttcaaggagaactacaaaccactgctcaaggaaataagagaagacataaacaaatggaaaaaacattccatcctcgtggataggaagaatcaatatcgtgaaaatagccatactgcccaaagtaatttacagattcaatgctattcacatcaaactaccattgacattcttcacagaattagaaaaaattattttaaatttcatatggaatcaaagaagaccctgtatagtcaagacaatcctaagcaaaaagaacaaagctggagacctcatgctacctgacttcaaagtatactacgaggctacagtaaccaaaatagcatggtactggtaccaaaaccgacatatagaccaatggagcagtacagagacctcagaaataacaccacatatctgcaaccatctgatctttgacaaacctgacaaaaaacaagcaatggagaaaggatctcctatttagtaaatggtactgggaaaactggctagccatatgcagaaaagtaaaactagacccctttcttacaccttatacaaaaattaactcaagatggattgaagacttaaatgtaaaaacccaaaccataaaaactctggaagaaaacctaggcaataccattcaggacattggcatgggcaaagacttcatgacaaaaacaccaaaagcaattgcgacaaaatccaaaattgacaagtggggtctaattaaactaaagagcttctgcacagcaaaataaactatcatcagagtgaacaggcaacctacagaatgggagaaaagttttgaaattttctgacaaagggctaatatccagaatttaccgggaacttaaccatatttccaaaaacaaaaccaaacaaccccatcataaagtgggcaaaggatgtgaacacacacttctcaaaagaagatatttacatagccaacaatcatgaaaaaaagctcaacatcactgatcatcagagaaatgcaaatgaaaagcacaatgagataccatctcacgccagtcagaatggtgattattaaaaagtcagggaatagtagatgctggcgaggctgtggagaagtaggaatgcttttgtactgttggtgggaatgtaaattagttcaaccattgtggaagacagtgtggcgattcctcaaggatctagaaccagaaataccatttgacccagcaaccccattactgggtatatacccaaaggagtataaatgattctactataaagacacatgcacatgtatgtttattgcagcactgtttacaataacaaagatatggaaccaacccaaatgtccatcaatgatagactggataaagaaaatgtggtacatatacaccatggaataaaatgcagccataaaaatgagtgagatcatgtcctttgcagggacatggatgaagctggaagccatcgttctcagcaaactaacacaggaacagaaaaccaaacactgcatgttctcactcataagtgggagttgaacattgagaacacatggtcacagagaggggaacaacacacaccatggcctgttggagggtgaggggtgaggtcagggaacttagaggatgggtcaataggtgcagcaaaccaccatggcaagcgcatacctatgtaacaaacctgcacgttctgcacatgtatcccatttttttagaagaaatttaaaaaagtgaccattaaagaggcattggcattgattaacagctctgagtaagccctccgaggatcggtccatgtggaaatcatgctttcctgctgcctcttctgtggccgccaatttgaacagggctagtcatcatcagcaaaagccagaatctatgtacgtcacagtaatcccctcccccaccttcttcaccagcgggtaagagactggtaaaaagtaaaggcgtgagaagtgatgagaatacttatctgcagggagattccaaatcttgggagccactgccctattttcagtgtggcagattgcattccagaataaggggccaggtgtgggcacagagctgaagcaggtgctcctgcagctcctctttgtaattagctcatgtctgctcattctttgactctgcaccttactgctgctgggctgctgctgggctgctgctggctttgtgtcttctctggcaatatgccagggtgctgaagaaggaaggctggggaatgtgatgagccctttgtcacctgccaggttgccagcatctgatagcaggcatagcacagtggcctgagaaggctgcctgattagacatgtgcttccctgaacctgtccccttcttagcactcaacacctgtggctccttgttggcaaaggaacaagaatttgtcaaacaataagcattcacacctattaaattagtcatttggcataacttgcccaagcttgtgataaaaggcctgccagtgaatactgaagggtacaaaatatagcaatggaaaaatcatgtatgcacacatatgaatttctatcactacatatattatgcctggacatatgatcagtcacatccagatgtatttgttttcattaatccattggttttatattcattcttttatagattcaccacagacaaggcacggtaccaaagattagggttactatagtggtcttcatttagtttctctaaaactccatagtttgtctttctggaccttagcatatatgtttcttcagtctggaatggtttccttcctcccctatctatctactcttttttggtggcctagttgacatttcctttttcttcttcaagaggttaagtctggttgagggattggacacattagcagctattgtgtgggaaatattaggctgggggtaatcacaaggtgctttggaagcctaacaagtagagacatctatctcggtctcagagtgtcaaggaaagcattctgaaggaattttggtgtgaagatatgcaaaataagtgaagcagagaactagctaagtggggtaggtaggagaacagaatcctagttaaaaaacaaaataaaacaaaacacagaaccagccatgtacagaagcctgtaaatgagagagagattgttgagcatgttcaggaaactgaaaagtggttcataatggctggtatagaggtgtgaaatgggggactgagagagggaaggatgggctagtaagtaaaagctggactaagccttgctgattttggactttattcagaaggcaacagtcattggagggctttccagagaaacaatatgatgagatgtataattctagactactgatcatggtggcctaaaacaaagtagtggtatttaggatagagagactagcagaatgtcaggggagatgcattatgaacttacacacaacacacacacacaatcgtaattttattaaaataaaaaaatcatattctaaattattttgacagttttagcttagctttatatcatacaaaatcaagcatctttttacatcttttttatatgtttgcttgttttggttaaggcatacataccgtcccctagatcttctaaaatatttattgcttcatcttttgcattgtacgatcttaattgatctggaatttgattttgtttgaggcatgagatgggatttaattttattgttttccagatggctagtgccatttattaagtaaaccattcttttccctttgaattgaaatactgttctgtggtatattaaaacttctcatatacacagatttacttcagcaaaatgacataattttatgcttttttgcaatgtgtttactggttattttattttcatatctcacagtattttctagaacctccaagataatattgaaaacgatgatagcaagcatacttgtcaaatttctgattttagttaaaatgtttttagtattttgctatttagaataagctgcttctggtttttggaaaagatcttttattatatttgaacagtttctttatatcttattttattcaaaatgcttattaagacttgaatctcacacttttcagaatctactgatatgatcatattttgtttacttttatgaatgtaataatttatgctgatatattttccactgctgaactaccgtttcatttctgatataaatcctacttggtcatgatgatttattcttttataaatcgctagattctatctgctactatttttgcaaatattcataagagaaattggtcttagtatactgtatcagcttttgacataaagttatttgggattaataaaaagaattgagtgattttaatttttttctatggccggaaaatattttaaaaactttgcagtcatctagtttttttcctaattgctagccagaactcaggttcttcttgagtcaactttggtcatttatactttgccagatacttacccatttccattccatttacacatttgttcacagcaagttgcatgtttcttttctgatttatctaattcgtcttaatatgtgcctatgtattcttattccaatttagttactttctttcttaatttcagcttttatctattaattcctactccatagtttttttcttaagctcattacagttttcttaatttggaagctctttatttacttatttatttttgttgctgaaaacatttctggcattttccttgagtatagttttgttgtacctcagaattgtgtatgatgcaggctcctttttattgatttctaaaagttataattccaattttgactttccctgtaatccaagagaatgtattgcttaactctcaaatatatatgccaccttttggttatttctgtttattattaaaaatgtgatctgtaaaatctttaaaatattttatggggtttttatgatcaagtatttgagcaatttttgtaattttacatacatataatacatatgtacatatacaaatgttttgagtttgttgcttttgctattttatttttctgactttgcctttttgttagtttttattattaacatttatttaatttctctgattttgctttttagttttgatcttttgatttctcaaaaggacacattaaagtttttcactaaaattttatttttatcaaggttttcttttatcttcattgttctgttgtatataattttaatttctctatgattttgctgatctattcgttacatagcttggtactgagagacatgtattagtgtttcctactataattatagttgtatagatttcttctttcattctttttttttttttgtgagatggagtcttgctttgtcacccaggctggagtgcaatggtgcgatcttggctcactgcaacctctgcctcccaggttcaagcgattctcctgcctcagcctcatgagtagctgggattacaggaacctgccactgcgcccagctaatttttgtattttttagtagagatgggtttcaccatcttggccaggctggtctcgaattcctgacttcattatccacccgcctcggcctcccaaagtgctgggattacaggtgtgagccactgtgcccagcctcttctttcattcttaattttgaaaatatataattttgaaactatataatgctttattgaaatatgatttacataccatgcaatttacctaacaaaagtgtacaattcgatggttgttaatatattcacaaagttttgcaaccatcactacaatcaattttagaacattttcatcactccaaaaagaaaccccatactcattagtaattaattcctaattgtttttgctttatatatttagctacaatgttgcttggtttatgtctcttaggtcttctttgtaaattgtgattttgttttactttgtctctttttattctgtttatcacttctccccttattctaccttgttgatattaatattgcccctccattgctgctttttttcttgcagtttctttgaattctttgcctgttgactcattttcaaccttttattttttaatcaccttttataagtacaattcttgtgagagttttctcatttaatgggatgatttattcatttacatttactttaatccgtgagctatatgattttcttgatttatcatatttcttttacattgtttttgtttctggtcttttgctgttttgatcatgttgacatatacataatatttgaccttgtatttggagagttctactccaatttcccatttcattattgattatcttcctttttctcttagtagaattagacccatgggttttttattattttaaaacaaaatatcaattattttctttctaagattatattattcctatccccccaaatccccttaagaagaaacttttagaataggtttacttttctcctctctaccttctcccctctcctcaccatccaagtcctgtggtttgctgagattgtttagtttcagaatatgaacaaaatttaccttgtggtagtttggtagtttttctatgtatcagtagcttttttgtttgtttgtttgtttgttttttgagatgggtttcgctcttgttgcccaggctggagtgcagtggtgtgatctcagctcactgcaacctccgcctcccaggttcaagcgattctcctgcctcagctttcccaagtagctgggattataggcatgcgccaccatgcccagataattttgtatttttagtagagacagggtttctccatgttggtcaggctggtctcgaactcctgacctcaggtgatctgcccgcctcggcctcccaaagtgctgggattacaggcgtaagccaccgcacccggcctgtatcagtaatttaaaattaatgttcatactacaactgtccaggtaataggtcattatccataatacatgtctaatatgtataaatgtgtggacatttgtatgtatgtacacatttgtatatgatgtatatgtacacatacatcagaaagcatgtgtctatgtgtgtgttgtagggttcattgctcactaatgtgtctacttttccttcttctcttaaccagactcctctacttcttcattctgagtgatttcttgatcgattaatgtgtttttttgttttgttttttttgtttttgttttttttcattttctaaggtgtttcactgagtgatggaatctctgaatctttgccagatactcttctgggtgataaacttttaggtttcagttctctcagtatctcacctgtatttttctctcatcatctagctttcattgttgcagatgaaaagtaaattttttttaattacctgttttctcttgcaacttaaaagatcttctttatctctctctctcttttttttttttcaggaatccaaccagatattcttaggggtgtgtgtgtgtgtctgtgtttcttatcattcctggttgcaatttatgctttttccatctgtagatgtaggattttccatggttcaggggaaattctctctgtaattcatttagttatagtccttcttccattggtttcttttttctcattctacattatagtgtttttagaggttgttcctctaaatatgtttatggaaaatagaaggatcacagaaaaaatactacaagggactatctgctattttataagaaagacacggacatgtgctttgtgatttgaaaggaaggagtaacactgatagttttgtagtgtatgtttatgatactgcacttgttagatgtggttactaggtgaaaaaattcgtttcagagtactcacatgggggttggcttcatcttcattataccacatttctcattgttaaaatttatttctgatgtatgttttaaaacataaattcacagattaaaaaattttattttaaattcaggggtacatgtgcaggtttgttatataggtaaccttgtgtcatgggggtttggtgttcagattatttcgccactcagatattaaacctggtaccgttcagttattttttgtgatcttctttctcctcccaaagatggctccccagtgaatgcttcctgacatttacactcttctacagtaattttcagtacaaggtctcactctgtcactcaggctggagtacagtggtgcagtcacagctcactgcagcctagacttgcttgggctcaggtgattctcccacctcagcctccagagtagctgggactgcgggcctgcaccactatgcctggctctttttttgtatttttagtaaagacagggtttaggcatgttgcccaggctgggaccacctgctttttttttttttttttttttggagacagggtctcactctgttgcccaggctggagtgcagtggtatgatcacgggtcactgctacctcaacatcctgggctccagtgattctcccacctcagcctcccgagtagctgggactacggactacaggcatgtaccaccatgccctgctaatttttgtacttttttctagatatggggtttcaccatgttgggcaggctgggtcttgaacttctggactcaagcaatcagcctgctttggcctcccaaagtgctaggtttacaggcatgacccactgtgcccagcctaacctgtttttttatttaagtctcccttcaaacattgtctctctgaggagaggcagatactgtttttcttctacttccgtgggtactcctgtgtacccctgttgtagcccaaccataatgtaatttactgttttgtaggggcccatgagagaaagtcatgtgtctttttgttttcatatccttagatgtggcacaagtgcaaccttaaaaggttagtaatattcaccaaacaaatacttagatgaatgcttaatttctatgaaacaatgcttattctccaggtgtcaggcattatgccagtgatagatacgcagacataaatagggcaaggtccttgtcctcaagaaatgccatctgaggtggggtgggatagcagatgagagacaacagggccagatcatgaaggaacagatcgtatttcatttacagctaaaggatgccagcatttatgctattcacctttttaaagaggtgaattaacagtagttaaaaattctaacttaacttacccattaataagagcagctttgttataaattttgccacttgaggaaatgtattcttatagacccagatgtcaagctgtcatagaatcttgtgatgtgaggagattagcattgtctatatgtttcaaatgatttactgtaagtagggggtttgcgtcaatcgtaggcggaactttgggagtcagaattgcatcagttgtctgaattgaattactttgtctgtgctttctgaattttgagattaaagtttaaaatcaaagtcttggctattgacttgtatatttgtaaaagttgaagtaatcttttcttagttttaatattttcaaatctaataacttttttcttttctgatcttgtgcagtttaacagttctgggaataaaaatctttattagttaattgaatattatgggtttatatagaattgccattcataatattttaatgtaatattcaaaaaaattcatttttttttagtaatacaaccgtcactttagcatctggtattccttagcatcatcatttgaaaattaacaatattgtaccttaaagtacagaggtcctttataaagcagcaggctttctagttgatagattgctgcgcatagagtagtttttagtttgttgcctatggtgaacttcttattttctggatgattctttgggatcctggcattaggcacagaacataagcttacactgtattgtctttacatttgtgtgcaccataactgtgaggaccttttcaatgttatgaaaaatgcaagttagaagaacttctctttttctcttcaatgcacatggacctgaagtcttttgaaaatacagttcttcaaagtttagaagcaatccatggaatattttcagtgacacacggaatattgtagttcagcatatatggtcagtttataggaatttttatttattctgtatttagtttttaataagaatttcataactggaagatttcatagcaacaaaggactgtcattgaatgtgtatataaatttaacttgtatcttagagttttctagttataacatagtgatggtgatgtaaggatttggcatagaaagaagttttagtgaaggaagtgagaattaatgttcatgcagagtaatcaaaccaggagagtatggtttgataagccaaaagagatgagagttttaggaggaagggatgattaatagtgtcaaattaaaggaaaaacagcaaacaaggttaagtaagataaggacaaaacagtatgtattgatttaagtatttatgaaagcagtttcaacagagcagttggaacaggagactaatggcagtgaatattgtctgtctttgttttctcttctacactagagaactggacagataagtactattattgtctattctggctgacattattgttagtgaatgcaacacatgttgaagagcagtcttgtaacctggcaatgtgacatgagtggtgatatttttatcttaataagtgactttctcaacaagtcttgagcatccaatccatgaaaccaaaatgaatatgaaatgcttattaataaagggactgtttctcacttaggttttctactcattttcctatcacattgattttaagaagttctttgtcaaactgacttcttggctaccagaagttttagactctatagtaagctcttaaagaatattagatgtgctttgactattttaaaaacaatattattcactctgttcatttgcctcacttctggctgggaggaacactcagggaatgataaaggtaggaaagcagctaagctgtagacagcctagattgctctgcactctaatggggcgctagcaaagtgaccttcttttcccagtcctgcctgatttgcaggacttcaaatgagatgatggaaatggggcaagaaaatatgaatatgtaaactacatgtattgatttcaaccaatgtcaaaggagaagcaatagagtttaggtagaagctgtctttaatatgcaggccaaaatcttttgtatgtgttatagtcctctttggcacataaattccctcatttttcctcatatcatcctcaagggggggatcttgtgatcacatgtgatcctgcttcttattacgatagaatacattgtgcacacttatttatttttcattgtaatatccagcactataaggtggaactcttttgccagggcatcagggagtgattatatatggagaaaacttaacaataacctttaattctgtctcatcagattcctcctccatgcttggctgcccttacttttgtgggtgaaagaatgtaaatcattccagagttctgtcattattattttcttgttttttctccttttccctgaggtctagctgacctgcatgtctttccctgagattgctaatgtaagccttttgtttccaccagatagcttgatgcctatccccattcatgtgccatagatttcttttctggtttatattttccacttaatacatgcatttcgataagaagtaagatgataatatggatgtaatatggacataatatgtaggcaacttggatattctgtgaagaatggggaaatcattaagaaaaagaaaaatatattatttatgataactactgcaaggctattgaaaggtgaacagctagattagcaacatttaaaaagctgatgctctgggagttagggagaaggaagggataaacaggatttttagggcagtgaaaatgctctaagtgatatgataagtgtatacatatcattatacatttgtttaagcccacagaatatacaatattaagagtgagccttaatgtaaaccatggaatttggatgataataatgcatcatgtaggttcatggattgtaataaatgtaccactctggtgggagatatgataatggggcaggctgtgcatgtgtcggggcagagagatatgggaaataactgtgccttctgctcaattttgctgtgactctaaaactggtctaaaaatatgtagtctatttaaaaacaaacaaaaaggttcatgttcattaacattttagaggcatcctgaagatgaactgaaatttatattttctgattcaagatgagtgaattaacctatgtggaaatttgtggatctaagagaaataacctttgttactttattcagtagttactcttttgataagcacttaaaaagctataaattcaattatttatattagacttcactaacatttgcttcccatttacctctaggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtaagtgctatggacttgagatggtgatgggaactagaagagtggataattatttcagtaaattacatggtggctgtacttgtaattatttaggcaagagagcttaaagtgccatttagaagattactggtccctggatgtatgtaaaaagatttggcctcattcccagccattttgcatagtgtctgcctcctccattaatttatttcagcatataaaaagaagacatttattaatactagctatagcaattacaaaaatgatagaactcactaaaaacctgataatataaacacatgaatatttccactgaatgtagtcaaactatgagaaatatagcatttcaatattgtggggcgtgactgcaatatctttaaatacatatgctaaaagttaccttcactttgaatatgttcttttctaaatttcataatctgggaacatctggtttacatcctatttttgtcttaatatgcagaataatgtattccccaaaagctgagaattgactatctcgagacttctgtttaaattttagtattaaaatagagattcattgctttagaacatgatctctagttgagagaataaagtgaagactaggaaattttttgtggatttctttgaatcccctttgggaaatctggattataaattataaataattgatgaaaagacaccagaaataaatcttaaaatatttgggtttaaatgaacattttgtccctcaggtaaaatattttaaaaagtcaacattaaaatagataataaaatgtaaagaaaaataaaccatgattttttatgtttagtaatatgctttcagtgattaaacggaaaaacaacattaatttccaggacagaaatttgtatagttccattcagtttccagtagagtgtcttttcaacattttgtactagggtaaataaagttcttttaggctatttagcctgtttccaagcatttgagggaagctattagctattagaaatgacaggttgctctgggctaaaggaaagaagagttgtagaagtaattaaagactcagtgaaaatatacatattctggaataataataaataaatgaggaaatagccctctgaaagcagcgcttaacttgtttttgaggattttatacagcattagtttcatgattgatgatttttataattttgaagttcaatggaaagttttttaaaaaaaatattcgagaaagatggctgggtgtggtggctcacacctgtaatcccaacactttgggaggccgaggtgggcagatcgatcacctgaggtcaggagtttgagaccagcctggccaacatgatgaaaccccatctctaccaaaaacacaaaaaaacgagctgggcatggtggcgggtgcctgtaatcccagctactcaggaggctgagacaggagaatcgcttgaacccaggaggcagaggctgcagtgagctgagatcatgccactgcactccagcctgggtgacaagagtgagactctgtctcaaaaaaaaaattatttgagaatgatagaaagatgcacatttattcaatatgacgaaatcaggtggtttaggaaattaataatgtttttatcatacaagttcagtgatttgaaaatatctaaggatagacctggattccagtttggcacatttggatattttagtctgaatgaattagtattatttgatcatatgatgttttaaatacaaattgtcacatatgtatattatatgtatgtttaataattgctacccattttgaagtcctttagaatggaagaaacttgttaaatgtgtatttttgttcacatttgtagatgctttaaaacgagttattctttctctttaatttagggaatatcaaaactatcagttctgttttacagaagcacaatatttggctaggagaatttgaagcatttttggcctttagaattgaagttggtgtttttggaaatatttctgaactagaatatattattatcaatgttgttgctttatatattttatcgatttgggaaaaattaattcattttaaaatgactgcttcaggttttttccccttatatttcatttggcttctatttctatttaatttgtataccagggtaagaaatagacataatgaaatgatgactcaaatgtcaaggccccctgccaattccaataataaggaactgtgctcattgaggagatgcaattatcatttaaacatgttagtggcagtttaaaaataaagtaataggcaggatttttagttaaaataaggatagaaatctactcatccttatatttatttctgcttactcacctgagtttgccagaatgggacatttgagaggttacagttgccccaaattgatactatggtcagtaaagttgtcacatacagtcttacccagatgaataacatttttaaattagtaagtcatcaaatttcacatttacagtttattaaaacatggaaagaagaaagaaaaataatatgtaaaaattgtgtttttgttgataaatttgactttgtcttcattattttccccataatagctattcttgttaatgtatacctctatgatgtctgaagtctctaattttttagttggcttttataagaaaatgctattttaaaataatttatatttattccttcttctaacattgagggctctcataatttaactgttttgtttgtgcatttaataccaatgaaccactacgtctgccataaaaaaaaaaaatcaagagcaagcatgtcaccgaggggcatctgacgcagttatcagtggcaggattcaacagtcttgaggttagaaaaaaactcttccagatggcttgaccaagctttgattctatcacttggtttcctctacattttctctaagtgatcatccatgcctcacatattcttctctctccctattttctttttcctcattatagtattcgtatgttttcatctttccctaaactcaacttcctgtcatcatcatctttccttatcagatgtcaaacattaagtatgaatgaattggttgtttttaaaaaacccaacagattcagtgtagagaataaagactgaattaatccatgttaatttgtgctgtgtatttctttcattccatgtatatcaaatattgttctgagaatttggaaatgtattgcatagatcttttgaattacaagacattgtggtaaatttgagatgaattttttttgcagcttaatgagcagtttgcagttaatatttagtccatgtaaacataacctactgatatagattacaaagcttcttggtatggaatgaatcttgtttgagtgaatagctttgttagaaatgagagtaatagcacatagcttccttctctgccaggtaaggtcatgatgtgtggtgaaagtatcaacaggctgggagagaggtgtctctgacagccatgatcttagtaaatctttttaatgtctgcacctcagttttatacattggaaattaatgaacctagacaaactaatatttttactcctttacaaatcatacttaacatatatacatatacatgaggtcaattgatcatgattttttttttaattttttttttaatttttttttttggagatggagtcttgctgtgtctcacccaggctggagtgcagtggtgtgatctcaggttaccgcaacctccacctccctagttcaagcgattctcctgtctcagcctcccgagtagctgggactacaggtgtgcactaccacacccagctaattttgtatttttagtagagactgggtttcaccatgtttgaggccagactggtctcgtctcaaactcctgacctcaggtgatccacccaccttggcctatcaaattgctgggatcacaggcgtgagccaccgcacttggccatgaagctttctttcatctctatgtttcagtgaattcagatgcattttaaaagagaggtgcggagaatctgacttacctaccatgaagggatcatcttgttatcaagaattagttaaaataattctctggtagtttaggctgcctacctcagaaagttatttgggaggattaaatgacataatccatgtaaaattcttagcatctttgaccccagggataagcactgcataaatgttcattattacttctactgctattattagttgtgttcctttccacctataacagtctccgtatttattcccctattcacttactgccttatagatgaaagcaccaggtatcagtaggtttgataattttagagaaatattgagctcacctaacatcttcctaaaatatgccttggaccctgctgcttgtctccttaataaagactagaagaccacttgtcacacattctataggagctctgtttggatctgcattttatttacatactatcattgttttaaaatctctggtctctgtcagattgatgaaggtttggaatcgagttttcattacctgtatctactaatgtcttttatgttcatttatcagagcattgtgcagtaacttccaaaataaaatggatgtgttaacttaggcacaacctgaagcagcaacggattttgagaaacaataaataacatgagttcttttgacatttttttttagtagcatcacttgagagaactttaatagcaccttggaaggaacccagcatttgaaatacatcatccctgcgacagagcaatagcattgttattcatcttcacttttgttctcagggttggaactgaggaaaagcataacaaaaacacatttcttttttaattcccagaaatatgctctcatttgtcttattaattagaagctacaatcaaacgctgggaaacaattttcaaagaataaagtaggaaatgtctggttttctgtggccaaatcagttttcagaatactctcttatcttttctagacagttgcccacctttttctgaggcgatgattgaaaagtttttaagtatttattaatcttactataccataatgaaaccgttgaaagacaagtttcatcttgctgtcaagaatacattatttgacttcaaccttaatttaatttgagaaagtgtgagcatttcttctttgttcagataataatattttattagagaatttcaaatattgaactgtagttacctttagtgatgaacaacctgacattagagctttctctatacattagcagagctgagacatgatttcgttcagaattacctggagttcactctgttcttgtaagtatgaatgagacctttatttttaatttgtgtgttgcttacctttctctagaactgctctctgatcattgcccttttttcttttaatgtaatttattattttttaataatttgaacttcatctagattcagtgggtacatgtatgggtttgttacgtgggtatattgcatgatgctgaggtttgggctttgactgatcccctcacccaggtcctaagcatagtgcccaatagtttttcaacccttgtcccccctttcccatccagtagtcttcaatgtctattgttgccatctttatgtccatgagcaccaatgtttagctcccacttttaagtgagaacatgcggtatttggttttccgttcctgtgtttgtttgcttagaatggtggcctcaagctgcatctttttttatggctgcatagctgcatccagctatgtgttctttttaatggttgcacaatattccatgatatatatgtactacattgtctttatccaatccaccactgatgggcacctgggttgattccctgtcttcgctattgtgaatagtgctgcaataatcatatgagtgcagtgtcttttgagtagaatgatttattttcttttggatatataaccagtaatgcaattgctaggtcaaatggtagctctttttaacttctttgagaaatctccaaactgtttttcacaaacgctgaactaatttatagtcccaccaacaacgtataagtgttcccttttctccacagccttgccagcatctgttgcttttgacttattaataatacccattctgcctggtgtgagatggtatctcattgtgggtttgatttgcatttttctgatatttagtgatgttgagtatttttttatatgtttggtggctgtttttatgttttattttgagaaatgtctgttcatgtattttgcctatttttaatggtgttattttttgtttgcttaacttccttatagattttggttattagacctttgttagatgcatagtttatgaatattttctcccattttttaggttgtttactctgttcatttactttgcttttcagaagctctttagtttaattaggtcccacttgtcaatttttgttttgttttgttgcttttgggacttagtaacaaattctttcccaaggccagtgtccagaatggtgtttcctaggttttcttctaggattcttactgttcgaggtcttacatttaaatatttaatccatcttgagttcatttttgtatatggtaaaaggcaggggtcccatttcattcacctgcatacagctagccagctatcccagcaccatttattgaatagggagtcctttccctattgcttatttttgtcaactttgctgaagatcagatggctgtgtgtagctttatttctgggttttctattctgttccactggtttatgtgtctgtttctgtaataataccaagctattttggttattgtaaccttatagtatagtttgaagtcaggtaatgtgatgcctctggctttgttctttttgcttaggattgctttggttatttgggctctttttttggttccatatgaactttagaatagttttttccagttctgtgaaaaataatgatggtatcttgataggaatagcattgaatctgtagattactttgggcagtatggccattttaatgatactgactcttctaaactatgagcgacaaggctcatgtatgatattttgatgcagatattagtgatgttcatgctggttctgggtttttaaaaattagtataaggttaaaattgctgtatggtattttttttaaatgaaccacacaggaggcttaatggcattgttcctgtatagttactttattgtgtatagtaagaggacactgtacatgattacatgatgaattatgtattcccaatagtcatctataggcttaaagtgcttattttgccatatttaatttttgttaacaagaaatattgtagccctgagcataacaggaggtacctcctattggagatcagatttttatttagttctattaaaggtttgtaggttctcagggataaaaatcaatccctttagttaaaaatcatacagaatcttcctttaactgttccttttgtttttaagttagaatcattttagccagtagctttaagtctcagtgaaaaaaaaatacatgttttcaatgtgttgtctacctcttcattttttgatagtttcctgtttgttcttgtgtacttttttggtaagtatacagtgcaataatttttagtaaatgaatataatagtgcatctacgacaacaatttggttttagaaaactttatcacccccaaaagtttacccatttgcagttaattcctgctcctacctccaactgcagccaaccactggcctactttcatctctatagatttgcttcttctactcatttcttacaaatgtcatcatacaattagttatctttctttttcttttggtttgccatcatgtttttgagcttatctgtagtgtagtatgcatcagcagattgttaatttttcctgatgaacagtattctattgcatagataccacacggtttgtttatccattcaccagttgatggacattgattttccagattttggctattatgaataatgttgcaatgaacattcacatacaagagtttgtgtggatatgttcccatttctcttgaactgatttgcagttgttgcatcatatagtaagtacatgtttaatttttaaagaagttgctgaactgtttttcaaagagcttatgccatttcccatttgactggcagcgtaagaaggttcagcttttacactcacacctggtattgtcggtctttttcatcatagccttcctaatgagtgcaaagtggtgtcttaggttttaagttatacttccctgatgactaaagatggtaaacatcttttcttatactttttagtcattggtgtaatttctttagttaaatatgtaggcaaatattttgtccatacttaattgttgtttgctttcctattaataaattgtattaaaaatatacattctagatatgatattgtctttaaaaggtacttcctatgcagttgtcttttataatcttcaatttactgtcctttaaaaatatttatggagaaacttctgttcagaaagtttcattcatagaaatgtaagtctgggctttatcggtcaacactgtttacatatttcagtatctccttcagttgcacttgactttatcctttctattgatatcttaggttgaaataacagttttcctctggatatattctgtgtggccatatgctggtctcgaactcttgacctcgtgatccgcctgccttggcttgccaaagtgctgggatttacaggcatgggtcgctgtgtccagccccgaagtactttcaaaacaggaaaagatatcaaaggcatggcaacataacacactaggtttcttttcttattattttgttacagttttacttttcaaggattttgagatttggtataattgagttccagaacttagacatcaacttagtattttttcctatagcaacttttgaatcatgacttaagctacagcatctttctttttgcaattgggttttatggtaatttctaattattataattctgatagaaacaattagctttacatatgctttgatagggcatcatccttgagcaagcacagaaaaaaagcagtattgagagacagtattgtgtatgattaagaatacagtctctgtagaatggcttgaagccgggaggcagaggttgcaatgagccaggatcgcaccactgcactccagcctggttgacagagcgagactctgtctcaaaaaaaagaatgcagtctctgtagcaggacttcccaacttcagactgttatttactagctgggtaaccttgagcaagttaactttttgaagcttgttttcattgccaacctcatagtcagtgggcctctcttgtttgttcccatttctttttaaaataactaccacattctcctgacttccacaaatatgtttactacttgtttcagttttatcactgaagacatatttaaacattcccttagttgtttttctcatttttaatccttagttttgactaagccttactccttttgttaaattttagtatcattattcttagagaaaaatgccaaaatattaatatttaaaaggcatatctgtctatccattagtatttatctgtatctatgtatcttaacatttctggcactgttttaagtgtcttccatgaaaatgttataagaaaggagtgaaagctgctttcaaatatttaaatagttatcatataaaaattagataaagtttttgtttcagaaggcaaaaccagtgtcaaagaatagatgttataagaaagtagatttggttaagaattaagaggaactttccaacaactggagacattaaaaatggagggagttgcctagtgaaataaaggtctatataatacttgagagttcataaagaaaatgaatgacagtcactcagggatattttactgaagattcataaagggaacccaaactttaaaggtaaataatatgatcacgttatttttgtaatgctagtttcaggaatagggagagtatccatattataaacattttgtgctattgtgaaaaaaaactttgattctgttttcttttcatagcagatatggtttaaccttaaaaagtaatgaattggtggagtagagagatttagaaaagctttgactatttagcaattcttcttctttcaaagcttagtacatagtggcttttaaaattcaactcaataaagtatgtttaaaatgctgcctgtatttggattccaagtttagtagacaatttctgctcctcaaaatgcaatgaaaacttgatttctatgatctatgatgaataataaaagctgcctttaaaacattttatacttgtaagagtgctttataagaaagccacttatttacatttttcagcctccatgaaattgaacctttaagaaatgctaaaatagtaaacaagtaattaggctatgagttattaacaagttttatttcagtttatttagttgttagacaaagctagtttacacatttctattatactggtggctaaagattatgatcacttattagagagatcagtttctattgtacttataacatgattcagaacccttcattctgtttaacagcatttccttattctgtgaagaaatgagtacagtttaccacattttatttttctgaaaataatcaaaatccaagtacagtcatacactacacattgatggtttagtcagattgactgcatatatgacagtggtcccataggattgtaaagccgtattttatcataccttttcaatgtttagacacaaaaataccattgtgttccagttcttacagtattcaggatagtcacatactgtatagatttgcagcctaggagcaataagctctaccatttagcctatgtgcattgtaggctatgcctctaggtttgtgtaagtataccctgttgttcatataatggtgaaattgcccaacagtgtgcttctgagatgtatttctcttgttgttaagtgattcatgactgtatttatgtttgaatcatacaataatcttggttcgttttccgtttttcctaatgaagacatggtggttttttttttttccttggagatacaggggggtcaaaaatctgagcatattgtaggtgacaagcagtggaagttgattccaaaactcttgctttttgaaggagaggtcaagaattatatttcttgtcagcacagactcatctgtgaagttgttgttggctgatgttaaaaatgcttgtaataacatgtgtaggttcttcaaaggattgagatttcaagcttacatgtctcaaaattttgagtgaagcagtgactcttttttggccattgaacaccagcttcagaaatccttccatccactgtagaagaggtgtgagggaatctctttctctctgtgaacatatatggagaactcatactatgatttatggcagcttgcattttcatatttttctaatttagatgttactatgaataaggtaggtgtagatctaacaatagaattgccataaacaggagttagaaattcttaacatcctacagtaaaagaattttgtgctactctgatacattttttaggtaggttataaattcttatcttactatcttaatatgactaattatgacagctatttttcagtagtttaattaccattctaccctgttctgtggttataaagacttattccaggccgggcgtggtggctcacgcctgtaatcccagcactttgggaggctgaggcaggtggatcaccaggtcaggagatcaagaccatcctggctaacatggtgaaaccccgtgtctactaaaaatatatttaaaaaaaaaattagccgggcgtggtggtgggcgcctgtagtcccggctactcaggacgttgaggcaggagaatggcgtgaacccggaaggtggagcttgcagtgagccgagatggcaccactgcactccagcctgggtgacagagcgagactctgactcaaaaaaaaaagacttattccatacaagagtttattattctgtgaaataatatatattattttatgtacaatgtttacattctatgtcaactcaaaaagaaaattttgtgaagtttgtgttcttatccccccagtttatagaaataaatagtacctaataaattatttatagttctcttgcttgtttctctataatcttgattttttttttgagacggagtctcgctctgttgcccaggctggagtgcagtagcgcgatctctgctcactgcaagctccgccccccgggttcgtgccattctcctgcctcaacctcccgagtagctgggactacaggcgcccgccaccacgcctggccaactttttgtatttttagtagagacagggtttcaccgtgttcaccaggatggtctcgatctcctaactgtgtgatccacccaccttggcctcccaaagtgctgggattacaggtgtgagccactgcacccggcctctaatcttgattttatgggattatgtatttcaaagattttacattttaccctgttaattttttttttgtttttaagtagatacgatttttaaacttgaatcttcaccactgaattacagaagagaatgcacaattgtccattcccttctgttatttagtggtgaagattcaagtttaaaaatagagaaaatagagaaaaaagattattgtgctgttcctgatggggatcattggacactataaaactgtgtttgattttccttaaataacatgattttggaaactttatatatggtttgatcactttagttttccccagacatttctttcgagtgaaccattgttttacagtgtgacctccggggcactgccgatactcggtttatggggctgcttctcaccactatcatataacaatttaaattaattaatttaaaaaatgtgttcggagccttctttaagtctaaatatagagtgtatgtctatctgctatgtttcccttaactactaatttgataattctaaggggaagagatgattcagtgggtctggtatgaactgttctctataatctgagcaaggctctgacctcatctttcctgaaggtggaaaaatggtctcataaatttctttttttttttttttttgagacagagatagagtctcactctgtcacccaggctggagtgcagtggtttgatcctggcttacttcagcctatacctctcaggttcaagcaattctcgtgcctcagcctcccgggtagctgggactacaggtgtgcacccctaggcccagctaaattttgtattattattgttattagtagtagtagtgaatacagggttttgccatgctggccaggctggtctagaactcctggcctcaagtgattcgcccaccttggcctctcaaattgctatgattatagacgtgaaccactgcgcccagcctagtctgataaatttctagatgtttttgttattatgtgtataaaaatggactgaagtattatttcctatctttacacttgttaattcttgactcattatacttacactctatttacttttacagatcatactatcataggtgagagggcttcctgggttaattttcaattatatttcctttaccccttaccctaatcagagattgctatcaccagaacgaatggtttatttcaaaattctacatttattttatttaagacatttcattccccaattttgtctatctcctttgtcattgtttgcatttaatgtttggattgatttttcttggaatggcataggtgaattgactaagacactatttttagcatattgtaagtttcagttgtatttttcaaaagcacactttatgactgggaagaagcttttgagtgttgatagcgtggagtctcaagattgcttatcagaccaaccgttaacttatttataaactattatgtattataatgtagacaatatatttctttatttttagtataaaatgtcaaaaatcattgtatttgtcttgccaaaaattagggtaaaaatgatcatctaagtatttattccacttatgtttctactagaattaatcaaaacacttaaaaatctatttttatttaacttgaattggaggcccagaatctatgacatcatttaccctttcataactgaggataatttaaaacagatttcatacctcttggtataaaactcacaggcagtaagagacagaagaatgtgctctaaaattctaccagtgcaaatataaaacaatgttttattacagcagttattctgaataattgatacagtttatcaaagtttaaaagtaatatgatttttctttaaagttagtggctttcagtttctggttgaaatctctctctctctttctcctctctctctgtctttctttctctctgtctctctctctctcttttgaaaactttttcaggattttaatggactttgataagtatggaatgcaaattaacctgataagcataatagtttcttcctaccctttcaaagattatgattattaaggtgatgatgatgatacatggttttgttttgttttgtttttttgagacaggatcttgctctgtcacccaggctggagtgcagtggagtaatcttggctcactgcagcctcgacctccccagcctcaggtgatttctcccacctcaggctcctcagtagctgcaactacaggtacgcaccaccatgcccagctaatttttgtattttttgtagagatggggtttcaccatgttggccaggctggtcttgaacctctgggctcaagcgatccaccctcctcgacctcccaaagtgctgggattacagacatgagccaccaagctgggcgatgatgtgtatttgttgagtgcttagtagcaggccctcttgtaaacattttatatgtattatcttatttgactcccgttgcaaatatgtgaggtagagacatactaaggcctacttcttggatgaggaaactgaaatacaaagagattaagaaaacttttctaaggttatatagctagtacatgccaaggacaatattggacccaaatggtcaggctctagatagagcctgtgccacaatgcgtggcctgaaataaacttcactagtgtattcttctgaaagaatatcacacaacatttattgcaaaaaagtattatgataggctctgtataaagttcttatttttatggagtctaggatcaattttgggaatgagatataaatatatgtagagatcatgattaatgcagaaggtataaagaagttgtccattgaactataatcagtgtgagcttgtaatgttcttcctttgagataagctgaattaaaaaatgttacatttaagtaattattttgcttgtcctatggacacaagtgtagattatagtaattgccagtagattatactactgacaatttgtaatttttaaaaatgttatgacaaaacatatgtgtactgcttctggaaaattgaaataagtttccttcctaccacctattctaaaatcaaataagaaaattcctaatatcatcttgattgctttatgtaacattcgtcaaagatttaagaatatatattttattcttataattttggtttatctcaatagatggatggcaagacttatctttgtcattttagttttattttacaaatggtcttgggaaaacctgtcagtttttaccccacgaaaatttcctctgatatatggtagttctttcaggttccagattagtttaatactttaaaacttctcaacctttgtctcataaggcttttattttattttataacctgttctgtctcctcatccagaataaatttatagtgtagtctattattctactccctattttcttcaatatagttttcatatattgttaccatcccccttttatatgtcaatatttgctaaagtaaaaattaaaaaaaatctttctcctaatgtacctttttgtcatatgttttaaaaaaaattgctgcaatattgcattaaacttgtacataatgtcatattgacaatggcatgtttacggggatgtgtgattgtgggccttgcaaaggagtccttggagttcacctaggccagtcacatgtaggacacatttatgtgttgttttcatctttcatgtttttcagtcagacatgtagagttttgttcattattttatccctgacatttagccattgtctttgcatacagcaagtgtttaggaaatgtttgctaagcgagcgatctaaggattttgtaatttattctgttttgttgttaaggccaaactaggagaatacatgtgatagcattttaaagggcactgcttatgtaaggtattatattcgatacaattattcatccattaattagtgattacatttaaatgttcactgttaacataaaataatctgattacttaaacaatatttctccaatatacttgtcattataatctgcctggcataaattgcaaagaaaaccctaatgaaatcatttcctagtgggtccccagttttggctattagtccaatttcagtcattgcccataacatagcaattcaatgttattatatttccttttcattttctagtatgtttctacaacaggtagtccgaattttgacctcgagtccctagtcaccttcctttatcttctttcgttgccactgtcgcctgtgtatattcagtcagggttcagttcaagaccatttttgaacgtttattccattgcaagcacattgggagtatacatgtgaaatgacagatttccagtcctaaaggaatctcttatcattaactactcatatatatttaaattaaccactcatatatttattaaattgtgagtacatatatatatatatatatatatatatatatatatatatatatatatatatatatgtagttaacaaagcactgaattaccattatttgagagtaattataataaggacaatttgaataaaagaaacccatgaagtatagattttttaaaaacatatatatatatatatgttcgtgtgtgtgtgtactcacaatttaataagagaggcatataaacaaatatatgtatttatatacaaatatatagttgaatatatacatatatatttgtttctgtgtctgtcttttattaaattgtgagtttcttaaggacatgaattatatcctatccatctgtgtttctttagcacccagtacagtgcctggcataaggtagacattcaattgttgaattaagaaacaaagactttatcctatgtttggagggcacatataaaaatatttcatttataatcctcaattcaaagtcttctttcaccttaacattttaaagtaaaagggcaggtatttgtcatccacactttatagttgaagaaacagagagacaaatgttgtctgatttcccatatgctgtggtgctagcaccctcgtctgctgatatctcacttagaatcaatttcatgaggaaagcaacctaggcaaaaagctaattgtacaagtgttaaaagttcatcactttttcaaattgtatagaataaatgctttttgggggttgagctgatgtgcactttatgttaacattttacttagacaaagaaatgagtgactgtcttagtaaattcagtaattttattaattcccaagagcctactttgtactagtcactgtgttgtgccagatgttagagatatgaagatgaatacaacacatgttgttaatgggctttcactcaagtggaaggcaaaagcaaacacattgtggtaacccctaaaatggaaggggtttgtttgtttttttgcttgtttgcttgctttaccaagtgtttacaatgagcaaggccttggaataagcattttatagacacagttttatttactctttccaacagccctagggggtaaaattactatcgccattttacagacaagaaaattgaagtttgactattgtgttgtggggccatcgatgagtggacaattggttctttgtgaaggaattggagaaggaaactgggactaggagaatggtatggtcataatgggtcaaggaagagttctaaaagatttatttaaagcacatttttagtaaaagagtagcagtttttttttaaactagaattgttttagtcctttaatcatttttgaagccttttttggaccacattttgtcttaagatcacatgtctggcatggatccctgggaatatgcagaaaggacatcttagaatgctctagttggttagaagtgtggaaacagctgagggatttttctagtcaggtccagtaagagaagtgatgctgcaagttctggtcttggagcatttcaggatatgggaattgaattcagtgactatggaaataataatgagaaatccataaacaagttttaaaaataggtgacttccatgccctgtttttggcttttcccagggtatcatataattatattacattgcacatggattgagtaaggcagagtatgtaacagttgaccttatacaccctaatattttcactggctttagttcatgttgcaaatattgagttgattataaaatataaaaagaaaaatcaaaatgaggttcatcataggattctgaatgagacaatttcagagaaagcagagactccattgctttttattactagaatgtcattgctttccagtagctactgcattaccattatttgagagtaattattataaggacagttagaataaaagaaacccgtgaagtatagatttttaaaaaggaaatatgattttgttactgcgatcgactttattcagtactgtgaaagaaaccaacaacttaattttctgctgtttacttgagcttctaacaaaatggtaataagaagcagcttacaggggttgctttagtgtctatttaagtgtcatttgtaattataagatctgaatgataaacaaatggaaatgtttaaacaaatggaaatgtttaatccattaaacatggttcagtttcttttaatagattaaaatttccctcaaatcataatcatgtttacactttcaatgcttaataaatttacactccacccatgttaatgtattataaattttgagttggtggaatgtgatttaatacttaatgacaaaagccattagaagtttttctttttatcttttactaagtaatattttatacagacaaaagagtataatcgatatgtaatataaatgtaagttatgaagcataaataacgtaataacctgtgaatccactgcctaatgtaacagttaaaatattcccaattttatactggggaactccctgcatccactttcttcactttcttcccagttctgcactgctccatccactgaaataaccattctcggtttggtgttattgccctggtgtgtgcgtgtgtgtgtggttttttttaatggcgttcccctaatgtatatatctgtaaatacatttgtttacttttacttgtttctaagctttataacaaatgtaattatatgtcagagatttttgaggttaggtattagctagtttatctattgcccaatgagtcaacctgtaattttttgaactgtggtttagcgcatctcaatttttaaagtgctttaacatgttttcttggacatcttcacagttgtccttgtgagtaaagcagtggaggtaacatctaactcacttacttttggtagataaactccatgaagagtaagctcagattttaagaaatgaaatgtggcttctctgtagtgtgaactcatgttattctcttctcttcacactgttctagccactctattttccttttatttcctcagatatgtaaaccttttttctacttcagggattttgcatatactgttcttgattcctaaaatactcttctacctctttttagcatcactaacttaatttttgtccttcagatctcaactgatatttgatttccttccttgaccacttcacctggggagtccacatgcctttattgtctattgttagttttccacattgcactatgccaatttttttccagcttgattgaggtataattgatgaataaaattatataaatttaaggtgtatgatgtgatgatttgatatatggatatattatgaaatgattatcacaattaaattagttaacacatctatcacctcaccaagatacctttttttgttattatggtaacatctaaaatctactcttttagcaaatgtcagtgtacaatacagtattgttaactatagtcatcatgctgtatattagattcttagaacttattcatcttaaaactgaaaaagtttgtagcctttgaccaacgtatgccaatttgtgattatatattcttatgtttcttcatgtttttgaacatgagcattggacaaaaaacatgagcaaacataacaatatataatcacgcttgttttttgtccggtgatttgactgaaagatccatgcaggcagagacaatgcctcctttatccaccaatatgtacctagtgtcttctaaaatgttttgcatataggaattcaataaatagataataaatgaatgtaattatagtctggtattaaagatgaaatacacagacaataattatttggctatatacctgggcagtatcgaatttaggttaaatatcagatttttaaagatgttgcccactttgaagttgtatatcccagaagatgataaatcaagattttattggctttctaatattgattatttgaaatgctaggtacattgtacacttgagtgggtaactaccttgtaattcattgactggaaagaaagataaaaagctgttaaccttttttacttgtcatgagatgaagtgtgcacaataaatcttttctgtctttagttgtttgcctgggtaagtgatctaatagattcacaggtcttgtcaccaataaattttgaaaatttcctttctttttttgtgaatttgaaattaatgtgacatgtgtaatgtctctgtgtgtgtaatgtctatgtgtgatgtgtgtgcacgtgtggaagagagaatttgtgtgtgtttatgtatgtctgatgtccatggcgaggaagaatatgcaaacaaatttgagttctgttgtctccttacaagtaaatatgtagaattatgcattgtttaagagtaggattttttaaaaaatggtgtgttgggtaaaatatttgctttcaaagagcagaattaaagggaaggcaaattggacagttgccaagtgctgcattcaatgtggggctctgcagtgtcactgcaaatgtaataaatagagaaaattgcatttaccacaattttttttcaaggagagaacacaggtggttgcaagtaaatctgtggtgtgctccatcataacagatagtccttacagtgccccccaaggagaactagtgaactgcaggcatgttttgcagagctgggcatgcaaacaggggcgttatacccttcgttctccttctctgttctacccagagcagtagttcctactaaatgcttaaagaatgtttaaattattttatgagaatttaaatttgaagaggaatcacattattgtctgcccatggtacccacttctccttgttgggctttgctaatttcttttttttttttttatactttaagttttagggtacctgtgcacaacgtgtaggttagttacatatgtatacatgtgccttgttggtgcgctacacccattaactcatcatttaacattaggtatatctcccagtgccatccctcccccctccccccaccccacaacaggccccggtgtgtgatgctccccttcctgtgtccatgtgttctcattgttcaattcccacctatgagtgagaacatgcggtgtttggttttttgtccttgtgatagtttactgagaatgatggtttccagcttcatccacgtccctacaaaggacatgaactcatccttttttatggctgcatagtattccatggtgtatatgtgccacattttcttaatccagtctatcattgttgggcatttgggttggttccaagtctttgctattgtgaatagtgtcacaataaacatacatgtgcatatgtctttatagcagcatgatttataatcctttgggtatatacccagtaatgggatggctttgctaatttctaagagcattgcctgatctatctggctgctgtttacctccaaccccttgtcttgtcactctgtaccataagcagtctcatccagctgccccaatcttgcatcttttcctaatatgctaagctccttctggttgccacagggcctttgaatatgctgcttgtttcgtctgaaatgctctttccctaactttttaaatggcttcatagtgctcagattttagcttaaatatcaactcctcagaggggcatttctcttgctctatgtgaaatagaagtagcccagtctcagtgctctgtttattttctttataacactactatctgtaatgatttgtttctttattgtcttgtgtcctcactaagatgttagtgacatgaaggcatgggcctaattgcttattttgtttttcatcttgtattcccagttagctcctagaacaacattttaattacataatagattctcattaaatgttttaaaaattaatttaggaatgattggtattcaattctgcaatttctagtttgtacattctaattttttatatcatgataatgttttatttctgcaagtgtttataaattttatgtaagttgtctttcatatgaaagagcagactcagcccaggttttcctgtgatgatgtcagtaatcaagatatatctggactgaaccaacgagtcagtttacttagcagtagataaaaacatgacagaaccctgctacgctaattggctacttattcttctttgatgtaaattttggtatactacctttatctaaaaaaatacatatatatctatgttcatgtgtacttcaaaactgcatttcactctagttaaaatatggctcacctggtttaagcacaatctttaagcaggaacatgaaggatatcttgaaatctcttccatatttataactgctgatatttgagagtctgtactacgatccaggcccagggctacctgctttgatttcttacttatatttaatactctcaacaaccaaatgagataggtatgattttatcaatgtggattagagagagtcagtaatttataacatttgttttacatatatagactgatagactgataatctgcaacccatgaaaattttggatttttgctaaataaatctttgatttttccctgaacaactaatagacaggattgatataacagctgttgtcatttatgattctcaaagtagtcttactatttaaccaaaaagtactttatgcttatgactaaattgtcaactaaatcttttgtctttttatgtttaatcaaaggaatactttgtaggactagtgtttagaaagctgtctttataatcagagtcacaaattagtgtgctgatgttagtgcattttgatcatgtcctttatgtatcttatccccttactttcccttgttccccttcatggattttttttttcttttctttacagtgagagtggcagtaaccatgacagataaaaatgttgtgtatatagaagctcctctatttcaggttaggtcccagaaggctgtttttcagttgttcttaaatccaaagtggcttaaggggtttcagcttgtaatgctcaaatgcctttccaacaagcagttatgagatttaaaatgcacaaatagtgtgaaatcttaaaatcagacatagttctttttcacttggtttacgtggctcatttatattaaaattgggttgaacgaagaagcaccctttttctatgatctctgtaagtaacttagaaatgcttcagtgactactgaatttacagcgagataatcaccatgtttccttcatgttcttgaataaactttttaccttgcccaggattaaaattaggcaatgttctagccacattttacaaaatgtttttttatctcctgctgatagactgtcagttgcacaatgtggcacttttacatgtgttgtcgttttttagtggttgccctagatttttcaacccatatttccaactaatctaaattcactttcaaatgacactgtattgcctcgtcggtagtacagataccttgtaacagagtatgcccaatccctccctccctgtcccctataaggttgctgccattcttgtcacttatccatatgctttgatccacaggctatattcaggcaatacattgttactattattacttttaataaagttgtctatcaagtcagttaagaacaaggaaaatacaatattttattttaccttcattctttctccaactctctttctttcttcaaaaagatccaagtttctgatctgtataatttttcttcttcctgaagaacttttttaaacatttcctgcagggcaggtctgctagcagtgagtttcctgcttttgtttgtctgaaaaagtctttatttcttctttacttttgcaggattgctgtacatacaattctaggttggcgtttttttaaatttcaacataaaatgtttcagcccactctgttcttgcttgcattgtctgatccaagaaaagttgttgattttctgtttgttcatctttttttcttgttggaagatggagtgacaacttacaaggtcttcacatgttagagctgaaactagaagtccctttgtgacttactctttgtctttcaaaatactttatactgttgcaaaattccaaatacccatgaaacatttttactcttctcatattttcaatttttaaaatattatctttatttattttctcttgtaattatttctcttctcagattttcaatttttaatatatttatttaattttccttgtaattatttccttgtgattattatttttatttttatttaattttctttgtaattatttctctttttaatgttgtatttgttgtatttgtacttactggacgtagcatggctagtgacattcttaaaatacctcaaaatcaaacatagaaacaccaagccaagtgaagcctgtttacaacatgttaaggtaactaaacatctgcctacttggctgttatcaccatttgttgatggcatcagagtaattcagtagctgaattttgtttgtctgcataaaaaacttataaagtagggtcactttcacattaattatgtacattaggagtggcactataaatggatatttggtgggagtaaatgaaggatagtgtgacccattaagttcaagggcatgtcactcagtgaaaatctgtatagatactgatatcttcatgtatgttaagaccccctagtatatgctcccatagtattcagtgtaatatacttactacacagttgcttgttttacttgcctgtctcccctacaaatagattttgctttctgtctcactggccctctctctcttttctccttccctccctgcctccctccctctctctctctctttctttttctttctttctttctttttttttttttttttgctttttcattacctgattgaaatcaatgacccaacaaacattagcactctttcagtctttagccaggttatgcttgatggttgccgattaacatttagtactttttctatgttgtggctaaggaacactttggccttcaagcataaggtattttcccctataggaaatctctttggcatttaattaagaataatttagtgggatagtcttgagtattttaactttaatgttgagatgaagcaagtcatgcttataaatttacatagcacattaggtctacatctgtctagcctcatttaggtactggatttgtattttgaagagctgtactttgatgtctatgtgtgctatagtttgaatatggtttgtttgacccttccaaatcctatgttgaaatttaatccccagtgtggcagtgctgggagatggggcttagtgggaggtgtttgggtcctggcgttggatccttcatgactgaccagcttggtgctttcctcatggtgatgagtgagttctcactgtattagttcccataataactggttgttaaagagaggcaggcatcttccccctctctgtcacttctattctcatcatgtgatcactgcacatggcagttctcctttccactaatggcagaagtagcctgaggctctcaccagatgctgatgctggtgccatgctttgtgtacagcttgcacaatcatgagccaaataaatctcttttctttataaattgtctagcttcaggcattcctttatagcagtgcaagcgaactaagacaatgtgtttgtgtgtttcatagattagtacaaattgtgttaaaatatttgattgcttttatatatatatatatatatcttttgaaaaaaattccacaacataagcaaaacatcaacttacatttgtaactgtgtatagaatgctggtactgtgtctaaaaccaacatgttttcctaggtttggaaaatatcaccacagtgtgtttgctgaaggcaaatagtttgtgtttgtttgatacaaaatatttaatttttatgagagaatcagtggtagaaatcagtataggttttttggaagcaggcagatcaaactcctacttggctaacaatagttttcactgatgagctgattgttcttatgctgtgtagacagaactttagtcaaatagagaaacagaaggtttcattaaagggcacagttaacaattttctttttatacagcactgttcttttttctttataggttgatattttattttcattattatagcatccaagtgctgttagggcatagagaaatcatttcatctatttcattgacaggattgtgccaagcttattctcaagccttcataatgattgaatatagagaactgcacagttaaacctcaccccactgcagttttctcaaatttaaaaggaaaatttagtcgtgagtgtctgtagatggaagatactacagaatagagatttatactaacccctgaacctcgtagcactttatttggttctggggagaacatatttttttaaacaagagaatgcttatataggacagaggaaaaggtttgggttcagatggaattttggccttttctccatagatttgtttgaaaaatgctggaaagatccatgaaatagtaaatggctcaacaagtattttgaaatattttttaagtggcaggcagaattctaagttgtaatgtgtattgtatttgagacaatttaatcttatatttttgaggatggatttgcattgagaactggttaaaaaaaaagatgggagttgatatgaaatttaggtatgaattagtaagaaccagtgagttaatatgagctatagaatatagagaaagagttcaggtgattttcaatataaaacttatattgatttttattttcttttagcagctagtttgttggaggaatgtggcaatggagtacagatttcctgcagttttggatttctactcagactaattattagcaataaacatattagttcttccaaatattctatatggattcaaaaattagagcaaacaattggatgcaagtgattaattggaataccagaaatattagagtatttggttgttttgccatcaaaaatataatctaaatatgtaccataactttgaattttattttagaaacttctaaattctcaagataaatacaaatttgatatatttatgtatagttttcaatagtttgctttaaaaaggactttaaaaagcatgtatttccaaagcattgttcatgtttgtgcacacacaaaaataaggttcttccttcttgatagtagaacaaaaatattaggtgctgtgcatacaacttagtatcattttgtgaaactctcaggccttatatctcttgggattttaaaattgtaatttacatgcaaaatcaacctttgggcatttaaaggataattgtcgaatttaaggattacctaaatcctgtgctttaacttctgctgcttctgtttattgtttatttctttgctaattgttatcttctcagaggaagaagcggggaagaaggagagccttcaatacaaattagttaattttattactgatcgtattttgctaaagagtgtaaacaaaatgattaaagtgggtttaacatgaggtgtggctttcacatagtttttgttttccgtgttcctggatcatcaagaattttctcttactttgggctcagttttctagtagtcttcagtagaagtggctattgtgggaactttaaacatttttaatgcatttttatatatagtgaggttagctctaggtaaaaacattaaattgtacagcttgtattcagtatgttacccatttttcctaagagtttgtttttcttcttcaggttcctcttctcccctttattccttcccttccttcctccctctctttcttcctttaatacatacttactgaacttcaactatgtgctagaatgtatgtcttcatcttaacagtggagccctggaggaaatgttagttttcatggacaactaagggcacaatcagataactgcccatacattcagcggactggttttggtgcaagtgttaagtctccttctctcagagtcattatgttagctagggtaggttacattcctgtaacaaatataatcaacatgtactagcacaagcaaagttgaagtctttctcaggaaatagttcccagccaatgtttcaaattgggatgatgggggtctgtaagggaccaaggctgatgtatgacttcgtgggtctaagtcatttcggccaatgtaagaagatacaaagagtggagacctgagaacagtatgcataatttccattcacattttatagtcacatatccagactaactgcaagggaaactgagaaaaggaatataggcctgtgcctagaaagaagcggggaatgaattctgatacatgtacattgtcgtggagccatagtcatggatgagccagaactaactagtagttttcacaaagatattctggttttaatttaaaaaccttaaaaataagttctatgccttttttcctgtttacaaaaaaatgttcctagagctgcgtagtatacttattatatatataaacaatttagaagaatgctaaatctgcccctaatcacatagccaaggggatgttataatattgttgtatttttggccctttacatgcattttgaaatataatagggatcatactacatatagttttggattttttatttaaaactaatattttgagctttttccatgccacagatgtacgtgaaaacattatttactatggccctacagatttttgtcataaggatatactgtaacttaattataaatttattgatggaattcatattttcattctttagtgtaagtatgtttttagcgaataacttttatacataaatgcatacctgcatttctgattattagcttagttgacttggtgactcaaaggatgtgaatatatctacgtttcttaatatacactgttcatttgattttcaaagaatttatgccaatttaccttccaaagaccaggaatgaatgtgcccacaaagttgtgggcaattaccagatgacccagaaatttcattcttaggtattagcccagagaaataagaacttatgatcatacaaaaacctatactggaatttgcatgacagctttattcatattggctaaaaaccaaaagcaacccagatttccttaactgggtaaatggttaaacagcctgtgttacatccagatggaatactactcagccataaagaggatggagctattgatgcatgcaaaacttggattcatctgtagagaattgtgctgagtgaataacgacagccctgaaagattagatactgtatgactcaatttatataacattttttaaattaaaaaaagaacaggttagtggttgccatgggttaaggttaaggggaggagcaagcagggaggtgtgtgattataaaggggcaacaccaggactctttggtaagggaacttttctgtctcttgattatggtggtggatatgcaaacctacacatatgaaaaagttgcagagaatgaaaagcgtacacacacacacacacacacacacacacacacacagatgagtaccaccaggaaaatcagatagatgatagattttatcaatgtcaatattgtttccaatgttgtagtacagtttttaaaggtgtaaccattggagaaatgagtaaagggcatccaagatctctgttatttcttgcaactaactgcatgtgaatttataattatctcaaaataaaaagtttgattaaaatgtagtgcacaaaatttattatatagcttattatcttttatataataaggttctgttgtttgatgatgtaaacttttctgtaattgtaattaggaaattatccctttcattcattccgcactattcctggttggtatttaaatgttctgagaccttttcttgtttccatgcccaaattttcttcttttactttttagtaattattgtgtacaacagcaattccaaaaatatttcttcaccttcttctagcctttttgtggaacatatgatcccaaatatttcattgacctattttgtagggtagctcagaccccagcctattttttacatttttatttttgttttctttaaatgtaattgccaaaggatttctggaccagccctggttgatttagtgcctaaagaactggtcgtacctatttatatcctcttggtcaataagttatgctgttaaagtgttcttttattttattacaaaaagaatctgattttattcacttttttatttaagagttgctctaaataggataattgagtaatgatattcctcacatcttcagtttaaaaccctttatcatcctctctctctgcaaagtcctttttttctttattcatatgttatttatcacttgtttttttgtcaccggctctcactccaatactcccactcaattttctgctttatgtataggtatatccttgtaaaatttgtaacattttgcatgcatttcacatttacataaatattattgtgcctatatatctttttaagtaatttagttatataaagatctctattctacataaatttcatatgtttgttgagttcttcagaatattcaactagaattttgattaagactacgttatatttatagattaatttgagaaaaattgagtttttcactatgtttagtgcatgcctagtaaagaaaggtctaatgataagcagtaaaattgataatatctacgtttcctttctcttttaagattttaatgagggaccccaatgccatttgcctaatatctctttgatggtgcttttagtatccagactttaattatttttactacatttggtgtacatgaactaatatttagatgtgtgttatactactaacactgaagtttctgttataatcctaataaagttctttcattattgtatttggattgtgtaattttcatttgcagaaatctgccagaaagatttgaaactctatttatatcttcttgagattgtgtggataaacttacatgcataaagataagaattgctgtgtctccatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcacaaggacaaaaaaccaaacaccgcatgttctcactcataggtgggaattgagcaatgagaacacatggacacaggaaggggaacatcacactctggggactgttgtggggtggcgggaggcgggagggatagcattaggagatatacctaatgctaaacgacgagttaatgggtgcagcacaccagcatggcacatgtatacatatgtaactaacctgcacattgtgcacatgtaccctaaaacttaaagtataataataataaaattaaaaaaaagaattgctgtgtctcagccatagctagaagaatcccagacaaatgaattgtcaccctaaaaaaagacatcagagaaaaatatctcctaatacaatgaatgtatttgggagtaagcaaaaaaaggattcaggcacaactatggcaagccataggtgcacctgaagaggggagtggaaggggaagcttttatttggcaaaaagaagttaatataagctgcttggaaacaacagttctttggttcaggaggctcagaaatggagttggtgtcagttcatcagtggagctgctgttactaggcaagtggtctttttattttaaatttaagttctggggtacatgtgcagaatgtgcagttttgttacttagatatacacgtgccatggtggtttgctgcacccatcaacctgtcatctatattaagtatttctcctaatgctatccctcccctagtccccaaccctctgacaggccccaatgtgtgaatttcccctccctgtgtccatgtgttctcattgttcaactcccacctatgagtgaggacatgtggtgtttggttttctgttcttgtgttagtttgctgagaatgctggtttccagcttcatccatgtccctgcaaaggacatgaactcatcctttttatggctgcatagtattccatggtgtatctgtgccacattttcttaatccagtctatcattgatgggcatttgggtcggttccaagtctttgctattgtgaatagtgccgcaataaacatatgtgtgcatgtgtctttatagtagaatgatttataatcctttgagtgtatacccagtaaccggatttctgggtcaaatggtatttctggttctagatccttgaggaatgggtgaacacccacaatggttgaactaatttacactcccaccaacagtgtaaaagtgttcctatttctccacagcctcaccagcatttgttgttgcctgactttttaatgatcaccattctaactggtgtgagatggtatctcattgtggttttgatttgcattgctctaatgaccagtgatgatgagatttttttcatatgtttgttggctgcataactgtcttcttttgagaagtgtctgttcatatcgttcgcccagtttttgacggggttgcttttttcttgtaaatttgttgaagttctttgaagattgtggatattagccctttgtcagatggatagattgcaaaaattttctcccattctgtaggtttcctgtttactctgatgacagtttcttttgctgcacagaatctctttagtttaattagatcccatttgtcacttctagcttttgttgccattgcttttggtgtcttagtcaggaagtccttgcccatgcctatgtcctgaatggtattgcctaggctttcttctagggtttttgtagttttaggtcttacgtttaagtgtttaatccatcttgagttaatttttgtataaggtgtaagcaagtgttcttttaaaagcatcttatacgtgttgctgcagttctaaagaataactagtgataaaccttgtcacagaaatctgtacatacatgcaaaacataggtcatgaaaagcatgagctgcattaaggacatgaaggaatttctcatggggttattttaggaagtttttgagatagttcttatctcagacatgtgagcatgagctgccctcctttgtgctttcctggctctaatttgtttagaccggccatgagtgattccatcctggtatctgcaacttcacagggtcttggcttatttgggcttcttttctgtcagtgataagtgcttgatcccaattctctaagtgatatggactgagttgtgttgcccccaaaagttatgtgttgaaggcgtacccttcatgtaactgtattggagataaggactttaaagaagtgattaaggttaaatgaggtcataatgttggagccctggtctgatagaactggtgccctcactagaacctgacaatgctaccatctgatcttgtaactttcaacttccagatatgtgagaaaataagtttctgttgtttaagccacccaatctatgatattattgcagctttatctgactaagacactgtctgacattagagtgattgtcatattaattaatgctctgggagatagaattatgagtcagctttctattagaaatgattttataacagtctatttttgttctagggtgtttaggcattaaataaagtaaatgatccattggttgtatctttccatgtttgccgactcttaatgaactacatgaaatggcaactaccttttctagccacctcagtgccttacattcatggttaggcattatgcatcatttcctgtcttttctgacactcaggatatgaaattattttgccatgtaattcaattaggtcactgaaacactttgtgagttagacttctgtaatgcaaaatcgtgttgcttatatatcttcattttttttcagagcaggagtcatttcaagagtcagaactacctagaaagtaagataattacacttaattattttttaccaattggcatcatactttttttcctcaaggagtcatgtcatagcaatctgatgtttctcctctctgtttttttttgagctctcactctcagattgaatatattaaagttgtagtagattttggacctaaataaaatatgtattttctcataagtgtgggaagaatttttgtcttttatttagcttcatttaacatctacctcagtgcctgaaacattttaggagactagatggatagatatttgttgtacattaaaaaaagctttaaaaagcccatcgtatcaaaattaattcatgtaaaaatttgaaacactctgaaattgattgttaagtgctcctcaaagagtaattttggcaaacatctccaaagaagttcatgaaaacttctgagttactgagacatagatgtttactaacacagtaatcagtggttacacattctaaacatttaatcaatgtaatggaatattgagataacattataggaattacacaattccattgtcattgtatgtaaggaaaacagtgaaaacttcttatgataaacactttcagtatgttacttatctccattttggatgagatacaggccaagtcctatatatattttgctgctttgtggataattagccgcagctttgttcagaaaaggtggaggtaagtgaggaataggtatcagacatctatatattgttttataaatttttttgtaaaacattattatcagtagctctggctttgtggctgctgtcaaataaatttggttacttataaataactttaggttagactatgatagctatgagaaatttgatggctttctgtttagtgaagcagagtataattctggttattccaatgtcctttatttagccacaggttgtgatttaatgaaaggtttaggagctggattggaaaaatacttcttaccttctaagaaaatgttccacatcagctatgttatctttatattattagctgggaattatgagctgctatgttgctactattcttacaagaaggcttgcaagcagttgtagacaattttattttttgtgaccattctgtggcttgatggtaaattacaagagaggtaataacacttcacagaaatgtctttatcactttctatcatcttccctgcccttggcagtctcctttgctatttagatgacaatatatactcagagtttgtattttaaaaagcatgactctctgttcggatagtatctagcaatttgaaaccagatagcaaaatcattttaaaaaaccccagctttcgtttgaatggttagctacagattcaaccagggcctgaggactatgatgccttaaagtggaccctgaccaaagacttcaaggtaaattctatgggtttattagttgtcttggttttatgttttggtggaatataatccacaagacatgtaaagctgaaatgtaatataaagaaattccatatcattgtttctctagagatagttcagtaaaggtcaaagtaaattgaatcaagatagtgaggcaatacagttgaactgagaaaattggatgtggccagacagcattaaagaagagtagaatgaaattgactggctgtgaaggcttcagaaattggtgatgagttttttttttatcatttcagaagatgtaataattattagataatatttatttagcattctgctgttgggactttggtggcatctttaaaaaaagattttacatatttattttatccttagaagtttacattctaaagaataaaatcagtgtttgagcacagtaagtcattggacatatttgaagttcagttagagttcttatatttgaaaagttttgcaagacatagattcataatcaagaggcatgtactgtcgtcccttggtatctgtgggagattggttccagggcctcccatgggtgccaaaatccacggatgctcaagttcttgctgtaaaatagtgtagtatttgcatataacctatgcacatcctcctgtatactttaagtcatttctagattatttataatatctaatataatctaaatgctacggaaatagttgtattgttagggaacaatgacaaggaaatagtctgtacatgttcagtacagaaacaggtttttaaaaaatattttcagactatggttggttgaagctctggatgtggaacccatggatgttgatggccgattataaatactttcactattatgatagaaaaccagcagcatgtgttgatatagaagctgcaggagatccagaagatctagctaagataattaatgaagacagctacactcaacaaaatattttcattgtggatgaaacatccttctattggaagaagatgccatctaggtaggactttcatagctagagaggagaagtcaaaacttcaaaagatggtttctcttgttaggagctaatgcagctggtgactttaagttgaaaccaattttcgtttaccattttgaaaatccttgggttcttaaaaagaatgctaaatctattctacctctactataaatagaacaacaaagccttgatgacagcacatctgcttacagcatggtttactgaatattttaagccaagctttaagacttaccgctcagtaaaagagattcctttcaaaataatagtgctctttgacaaagtaaatggtcacccgagagctctgatggaggtgtacaaggagataaatgttgtttgcatgcctgctaacataacatcatttatatagcccatggatcaaggagttatttcaactttcaagtcttatgatttaagaaatacactttggaaggctacagctgccatagatagtgattcctctggtgggtatgggcaaagtaaattgaaaaccttctggaataaagccgcaataaatatacatgttattgcggcactattcacaatagcaaagacttgggaccaaccaaaatgtccgtcagtgatagactggattaagaaaatgtggcacatatacaccatggaatactgtgcggccataaaaaaggatgagttcatgtccgttgtagggacatggatgaagctggaaaccatcattcacagcaaactatcccaagaacaaaaaatcaaacactgcgtgttctcactcatacgtgggaattgaacaatgagaacacttggacacaggaaggggaacatcacacaccgaggcctgttgtggggtggggggagggaaagatttaggagatatacctaatgtaaatgacgagttaatgggtgcagcacaccaacatggcatatgtatacatatgtaacaaacctgcatgttgtgcacatgtacactagaacttaaagtataatttcaaaaataaataagaaaaccttctggaaaagtttcatcattgtagatgccattaagaacattgacgattcatgggaggtggtcaaaatgtcaatattaacagaaatttggaaggcattgatttcagttctcagagataactttgagggcttcaggattttagtggaggaagttactgcagatgctggtgaaaatagcaggaagactagagttagaagtggggcctgaagatgtgactacatagatgcactctcacagtagaacttgaacatatgaggagttgattcttatggatgaacaaagaaagtggtttcttgagatggaatccacccctggtaaagatgtgtgaacgttgttgaaatgacaacaaaggatttaggatattacataatagggcagcagcagggtttgagaggattgactccaattgtgaaagaagttcctctgtgggtaaaatgctatcaaatatcattgcatgttagagagaaatctttcataaagtaagggtcaatcaatatggcaaactttattgtttcaagaaattgtcagaactacctcaaccttcagcaacaaccctctgatcagttagcagccaacaacagaggcaaaacctacaccagcagaaggattacaagttgctgaaggctcagataatcattagcatttttagcaataaagcattttaaagtcaaagtatgtttgtcgcttttttagacataatggtattgcacacttaatagactacagtatagtgtaaacataatttgtatatgcactaggaaaccaaaaaaattcatgtgactccctttattttagtattcaggaacctaacttacaatatctctgagctatgcctgtacagaaaaactggatatatagaagatagtttcagaaattattcagaaaaggaagcttatcattagaaacacacgagtcttattcagatttactgcagatattacatgcctattcaagtataaatatgtttacttcgttaaattggcccacgcaattatgtcttttagattaataattatgtttgttttgtggctgggagaggtggctcatgcctggaatcccagtacattggaaggccaagtttgagaccagcgtgggcaaagtggcaaaaccccgtctctacaaaaaatacaaaaattagctgggtgtgggggcttgcagctgtagtctcagctacccaggaggctgaggtaggaggctctctggagcccaggaggtggaggttgcggggagcagatatagtgccgctgtactccagcctgggtgatagagaagaccctgtctcaaaataataataacaataataaaattatgtttgttttgtgaaaacatttttgcagttatcaggcatcttacattgattggctacatatattatagattgttttttttttttttttttgagacggagtctcgctctgtcgcctaggctggagtgcagtggcctgatcttagctcactgcaagctctgcctcccgggttcacgccattctcctgcctcagcctcccgattagctgggactgcaggcgcctgctaccatgcctggctaatttttttgtatttttaagtggaggcaggatttcaccatgttagccaggatggtctcgatctcctgacttcgtgatctgccctcctcggcctcccaaagtgctgggattacaggcgtgagccaccgtgcccggccatagattcttaatgtagggcatatgtgtgtgtttcagaggctctatgaaagccctgcattattaatatgcaaaatttggcataggattctttttctgggatgaaggttcatcagattatcaaaagaatttcttggaaatacttagtctcaattattttgtaattaaagaacaactataaatattttaattctgtggggaggaaaatatgatttttaatgtaagttagactaaacaacaggttgcttgaattttctctctgtagttgttgttctgatattatgtagacaaaggctaagtcctttaattatgtctaaattaatttacaatacatgaaattcacccacacttgttttatttatctctccatggaaacagcatgctttgagctgctactaaatatttcatatgcaggctatttatacttttatatttaaggatatattctttagactctattatttcatttaaactgtttctggaaatgcagtaaagtttaatattctttttaaaatgcattttaaatgagtcagcttttcattgtatggattgatttccttgccatcattcactatcgtgttttttgtttggttgtttcctaatgttatttcttaatatcttcctcttgcaaaaatttctcactttgggggcctcattacaaagtattttctatgtacatgttccaccagattttaaaaattttaatttttaaaggtataatttacatacagtcaagaacccaaatcttaaatatgtggcttaataacattttaatagttttcatgttttcgagtagttttaggttcacagcaaaattgagtggaaggtacagagatgtcccatataccttctgtctcttcaacaggcatagccttctattatcaacattctctaccagagtgatacatttgttacaattcattaacctacactgatacatcattatagtccaaaattcatagtttaaattagagttcacttttagtgttgtgtaatctatgggtttggataaatgtataatgacatgtccaccattatagtatcatatggaatattttcactgccataataatcctctgtgctctgtctattcctccttccctaccccttaaccccagatagcagctattgacctttttactgtctccatatttttgttttttccagaatgttatatagttggactcacacagtatgtaaccttttcaaattgagttctttcatttaattatgcacatttaatttttctgcttatcttttcatggcttgatagcttgatagcccatttctttttagcactgaataaaatttcattgcctgcatgttcagagtgtatttactcacctatagaaggacatcttggttgctttgagttttggcaattatgaataaacctgctataaacatccattgtgcaggtttttgtgtgcatacatgttttcaacctatttgggtaaataccaagaagcacaattgctgtatcatatggtaagagtatgtttagctttgtaagaaactgccaaactgtcttccaaaatggctgtactgcttttcatttccaatagcaatgaatgaaagttcccactgctgcctacccttgtcagcatttgatgttgtcagtgttctggattttggccattctcataggtgtgtagtggtatctcattgttttaatctgcatttttccctgatgccatatgatgtggaacatatattcctatagttatttgacatctgtgtatcttctttggtgaggtattttttaagatatttgttctgttttttaattgggttgtttccctaatattgagttttaagggttatttgtctattttggataataaccagatatgtattttgcaaatattttctcccagtctgtggcttgtcttttcattctctttatattgttttctgtggagcatagatttttaattttaatgaagtcaagttcatcaatttttttaaatacatcatgcctttgtcatcttatctgaaaagtcattgccaaactcaagttgttctatattatcttgtatgttatcttccaggaattttatagttttgcatttaacatttggtctgtgatccattttgcattttttgtgaaagatatgaggtctgtatctagattcaatttttttttttgtaattcgatgtccagttgttctagcaccatttgttgaaaaaaggtatctttttttcattgcattgcttttgctcctttgtcaaagatcagttttactatatatatatatttgtagttctatttctggggtctttattctgttctattgatcaatttgtctattcttttgcaaataccactctattttgatttctgtggttctataataagtcttgaggttgggtaatgtcagtcctccaactttatttttctccttcaatatcgtgttgtatatttcaagtattttgcctacttcatgtaaacgtaagaatcagtttgttgatattcccaaaatagtttgctgggattttaacagagatttcattgaatctatagagcaagtggggaagaactaatattgtgataatattgtatctttctatttatgaacatagactctctctccacttatgtagtttttctttaatttctttcatcagagttttgttattttcttcataatgatcttgtacatattttttaggtctataagtattttattttggggtatgctaatgtaaatgtattgtatttttaattttaaattttacttgttcagtgctgttatacagaaaagtaatgggattttgtatattaaccctatacactgaaattttgctataatcattttattagtctcaggaatttttttgttggttcttttgaattttctacatagatattcatgtgatctctgaacagagacagttttatttcatcctttccaatcactacacctttttgtcctagttcatttgttctgtgataacacagtcttgataatttatgaagaacagaaatttatttctcacactttggaggctgggaaattcaagatcaagacagtggcaggattggtgtctggcgagggatgctctctgctttcagtatggtgcttccaatattcctctttgagaggagaagaatgctgcatcctcatgtggcagaagggatggaatagcaagagagcacttttttcacccttgagcccttttataaggatgctaatcccattcatgagagtggattgtgagataatcacttccaaaggccacacttcttaatactgttgcattggagattatgtttcaacatgtattttggagaggaccacattattcaaaccatagtaattttatttccctttattattttattagctaggacttcagtacaatatttaaaaggagtagtgagatggtacattcttgccttgctcctcatcttagtgggaaagctggttttttaccattaagaataatgttagctgtagagattttgtagatattctttattaagttgatgaagttccccttcattactagtttactgagagatttaattgacgttggattttgtcagatgctttttatgcatctgttgatatgatcatgtgatgtttttcttctttagcctattgatgtgatggattacattaatttatttttaaatattaaactagacttgcatgcttgagaaaaatactacttggttgtggtgtatacttacatttatacattcttggatttgatttgtgaatatatacgtatatgtgtgtatatatatctgtatatatgtatactatatatatatattttttttttttttgagacagagtcttgctctgtcgcccaggctggagtggcacgatcttggctcactgaaaccttcgccttccaggttcaagcgattctcctgcctcctgagtagctgggattataggcccaagccaccatacccggcttgatttgtgaatctattttgttaataatttttgcatttatgttataagatatatcagtctgtcgttttcttttcttgtaatgtctttgtctggttttgttattagggtgatactggcctcagaatgagttaggaagttgtattagtccattctcatgctgctaagaaagacatacctgggactgggtaacttataaagaaaaagaggtttaatgaactcacagttccacatggctggggaggcctcacaatcatggcagaaggtgaagcaggaacaaaggtatgtcttacatggcagctggcaagagagcatgtgcggaggaactgccctttataaagccatcagatcttgtaagacttactatcatgagaacggcatggaaaaaacctgcccccatgattcatttacctcccatcaggtcccttccttgacacatggggattatgggagctataattcaagataagatttggtggggacacagccaaaccatatcacaagtattctcatcacttctatattatgggaaagatttagaaaaatggcatggtataatttatttcttaaatgtttggtagaattcactagtgaactcatctggcctgggtcatttctgttttggaaagttattgattattgattaaatttatttaatagatatagagctttacagattatcttttgtgtgagattcagcagattgtgtctttaaggaattgatccattttatctaggttatcaaatttgtgggcatagagtatttctttgttattcttgtaatgtccagagaatgcatagtgatgtctccttgtttattttggtcttattaatttgtatcccttctctttttttcttagttagcctggctagaggcttattagttttattaaccttttcaaagaaccacgttttgttttcattgacttttctctgtttatttcctgttttcaatttcataggtttctattctgactttatttcttttctcaggccgactttggatttaattttttcttctttttgtagctttctaaagtgaaagcttaggtaattgatcttagatcttttctccttatatatgcattcagtggtgttactctctttgcactctttcactgaatcacaaattttcctaagttgtgtacttatttttatttagtcaaaaatatttttatatttttattcagatttcttttttgacataggttattcaagtgtttggggattttttagctacctttctgttactgactcataatttaaccccatttcaagacattgtaagacttctagtcttttgaatttgttaaagtgtgttttatggcccagattgtggtttagcttggtgaacattccatgtgaacttgagaataatgtgtattctgcttttgttggattaagtagcctttagatatgcattatatccagttgattgatgttgttgaattcaactgtattcttactgatgttctgcgtgttagatctgcccaattctggtacagtggtgttgaagtctccagctgtaatagtggattcctctatttctccctaaacttttatcagtttttgtctcatgtgttttgacactctgttgttcggcacatacacattaaggattgttatgtctttctggaaaattgacccctttatcattatgtaatgaccctcttcatccctgataactttacttactctgtttcttgacctgttgggtatttctcttcctccatgcggaaggctagagttgattggagttgggtatttcctttcacctgggtcagttaggctctgataaaatcctagtaggataggcagtgattacatatattctcctgagggcagacatttttgagaagtacaaaatgatctggtgtatttctaaatgggtcttttcccccttcccttgtgggaatcataagggaattttcctctagtattcactgtgagaagctagtagagctccatgaagtaataatcacaaaagtgtgcagtctccgggatgactgggtgcccctggagtttttagtctctcagacttgtcgacaccgagcctccagtaatttgtaaactgctgttcaggtttctctactgtggcactggttcccaaggacgtttttgcttgtgggctgctgctccagtaagtcattattctctgtatctgcctgtctttctctccagttttaggggcagtggtttgcccagtgacatcatttctcttatagatttaagaagagttgctaatttttcagtttattctgctttttacttattgttaggatgaagtggtgacttccaagtttcttacatgtgggaccagaaactggaggccaccaccatatattttaaaattatatagttatgttgtaccctataattttatatttcagtataggtggtatatatatatttggcctatgtgtgacagaaataagaaacaaacagaatttattggattatttatttccccaatcctttaagtttttttttaaagactaaattattttctctttccttccatgaaattttgtacattttgatttcagcaagatgcctttaaccaacatgtttttgattcagtggttacaaatagatatgtgctacttgcctttaaagtcaagttaaagtcctttctggcttagccaaaaattatgtcatatatatgacgctagttccctgggactgaggagatgtttaggatgatcttgtaagatatttttctcgttttgatttgcacacttgaaatatcaaaaagaacagatacctttaaagctccccttaaatattgttcctgacattttttgggaagaagattttcctatgtgaacatctttccttgcaggaaacttttttttgttgttgttattgctaatgttgccttataaagaaatacatccgccccacttttctagtctctaaacacatttaatggactggtgaactaaatacaattatttaataatcacttctaggaataattacttttcagtgttggaaaggactttaagaattctcttgtatgtaaataatggctttaaccaagtttgctgaatacaagtttcttgcaaaccccaaacattttctacacattggataattttcatgccaagacccccatcacacaatatatttttacaatgacttttaaagcattctttactacaaggaggaaataaagaaatttttgaacatcatttactaaaatcaggaaaaacgatacacaactattttttggaacattctttgttgaaggaggaagggcaataaataaacttggaaactcctgtgggtgcgacgctagggctagctaacttgatataagttgtaagaacaaaggtaggaagattgacacatttcaggactgggacactggcaagtttttgggaaagtaaacatatcaattaaaaaagaaaagtaacagttctgctataatttctggtcttagttgaaagtccagaaagcaagaaattattacaaaagttcaattataatctggctaggatgatgaccgcaaatatattacaggcccagaatatgagagaaagatctgaaaatgagagatagcattggtcaaagggaaatggccctaaatttatagttattatttactgtgtcaccatagacagctgtatatgctatgaacaaaccatttggaaaatggaataagcaacaataaataaataattttttaataaataattttaaaatgccatttacaatagcatcaactactgtctgggaaatacttaggatgccaatacctaaaataatagatgttcaagtcctctataccccaaattgcaaaattttgcagagaaattaaaggagacttaagtatatattgaaatatactatgttcatggatttaaaaactgtcattgagatgctatttctctacccactgatacataactccagtgcatcccaataaaaattcagctgcatttttgtagtcgctgctgtctttagaatttaaatgagaatacaaaatgcttaggttagctaagacatttcttcaagaagagaacaatgttagagaacaagcaagacccaagatttactataaactggcagtaaataacacagtatggtattggcataataactgatagattagtggaacagaatagaaagttcggaaataggttcaaatatatattgatttttgacaaaggcaccaaagcaattcaataaagaatagaagacctttacattaaatagtgttgcagtaactgagtatttatatggaaaaacaaacttgaacctatctcatataaataaacaaaaattaattcaagatggatcatagacataaatacagcttctagagcaaatcacaaaatatcttcaggatcttgaaaaaagcaagacatttttaacagaatatagtaggcacaaacaataacagaaaacaattagaaattaaatttcatcaaaattaaatattttcttcatcaaaaggcagaaagtgaaaaggcaatccacagacagggagcaaatatttgcaataaatattcctgacaatagacttgtatctagagtacataaagaattactataaatcaataaaaagacaattcagtttaaataaaagcaaaggcttgatcagctattttttaataaatggacaaaaaagtatagaaaaagatgcttacattatcattatcaaaaaatgtaaattaaaaccacagtgacataccactaccaatggctcacattggaaagactgacaatactaaatatcagcaaggataaggagcaaattgaactctcttactttgctggtggaaatgtaactggtataaccattttgcacaactatttggcaatcactagtaatgttaatcatacttctaccctatgacctaacaatttcattaatgggaatatactgaagggaaataggtaaaatgctcataaaaagatttgcacacaaatatttctaacagctttatgaataacttcccaaaccaggaaaccacccaattgctctttaatagggtataacattataatgttctctatttatattttgtcatcattgcaatgtggtggaacttcagtagtttctctaggcttaaacttaaagagtcatcttgaatagaagtctaatgttttttaaatgatattttctgcagtgtttatgcagtacagtgagctgtgaagattgcagttatatccgaggtggttgtgtgtaatcaactagatgaaattttgtgtaaaaattgattggatagcataatctcctagtggttctattctgtggccagcaggaaaaattttggtaagtgtggcaggttaaggtcatgaaccgtcacatacaggaagaagtcagaatcgtgaatttcccaaatagtgagtacagaaggcatgtagcaatggccatttactgagccttcttgactagaacttaagtttcaggtggaagaagtaaagtcagtcaaagagccagaaccagcatcctgaagagtatcagcagaacatcaaggaagggttgtgctactgttttcctcttgatattattataggtagtgagattgtgaagcataagaaaggagaagttacttaaattagctagaacaggttgctggttatgcaattacaagtgcacttaagactagagaaacgtttactgaagagttgggttttgatgaagtacccttatagcatatagataataaattcacagattttgaacttaaagcaaggaaaaacatacagtagcagatttaacgggcaatgaagataagataacaatttattactacttaactggaatacttaaaatcagaagaaagggcagcatgggccaggtgaagtgacaaattaggtgaggatcttcaaatacactatacagagatgcatcattttagtaatgtgaaggtctgagaggttaagagatttattaattatataaggtggactcttagtacagaagtttttgcaaacttgcaattttggtaattgcttttctattataaataaaaatcagcattaaagaaccctctgaaatacattaagttgcgtaatgccaaaaattaatatgctttatcacactgaaggaccttggttgtaatataggcttcagtttctttagacacctttttggcaggtatgtaaagccatatgcacaatatgtagttgactgatactgtgaaatgactggaattttattggacagtgggaggtgaagcagccaagacatataatagttttgcagacatctcaagagatttcaaaatgaagaaaaaacccaaaagttttagcacttgtgtaaaataaaatcattttttatctttgctctgaaatttcttcaggtttcaaaggtcctgtaataaatgtgttagcactggatttttccttgctgtggaagtgagctgtgagacaattgaaatagattttggaatgcttgagacgtgaggggttggatttaagcagatctgagataggaagtcaggattctctatggtctcttcagaagtttatgagactctgttatgtggtcatttattttctgtcatttgacttttgtctgatttgtcttgaagcttctatctccacaacttttctgggcacttttttaaacacacaggaacttaccttggagaacattttttaaaaatataccaaaaatactgtgtctaaacttctgagaatgtataatgtgattgtcttctgaaaagtaggagttaaagtacgtttttatccttgggaatattgttaaatgactaatagaaagtggaaacctggaggcatggcaacgaaaagtcatttaaaggaaccagtttttatttatgaaatgcttactatgttaagagatacagtgcattgtaatttttttaatctaatggacaatttttaaggttttttttttctaaatagagaataccggattaacctataaccttctaagttgtacctttgaagaggcttttcttgctatgtcttgaatagccattttgtattatctatagctctccctggtcttcctgtcctcaagaagtgttaaaataatttgttgttctaaggtagagaatgggccaaagtaggaggatacatcaagatgtctaattggaaaggaaatcagattgcttttccagtgatcaaaggaagtatagcagtggagcaatgaacttttaaaaatgattcttatgggacaaggaaaccattgttgtaattttgttattcagcaaccagaaatgatgaattagatgtttactaaatcattgcacttattgtggtacaaacgcctgttggctataaaggatagctcttaaaagaaaccagaaagcaagggaaacaaaaacaatcgtgtcactttcccagcagcatgtgatgatgaatttctcattcaaaccctgtgaaataaatagcttgctcattcaaaatcatttttttttctttcttttttgagatggcatcttgctttgtcgcccaggctggagtgcagtggagtgatctcggctcactgcaagctccgcctcctgggttcacgccattctcttgcctcagcctcctgagtagctgggactacaggcacccgccaccacgcccggctaatttttttttttttgtatttttagtagagagggggtttcacggtgttagccaggatggtctcgatctcctgacctcatgatccacccgccttggcctgccaaagtgctgggattacaggcgtgagccaccgtgcccggcctcaaaatcatttttggttctcagcatccttaaaatacttttttagacaagttacccagagaatcatctgtgccctgtgtaggcacaggtgattgttcattcccccaacccccactcttcagagagagactttgtcaggcaagttttgaagtgatttatccaggatcactgtggtaataaccttcaaagactggtaaagaactaggtaggactctagccctactggccaaagatgaagttgacattataaattgcaaccgttgacaatctctgatgtaataatgggaatataaggctggaattaattctgattcaagagacctaattccctggcttttaatcagtgtataccactgaatatctctacctaccttagtttttatgccggtcatttaacctaagcatcttcatctctgtcaaaggctcctatttcttctcccagtagcagctgccgttgtaaacaaataattaagttgaaccagttgtaatgattgttgggtagccatgatacaacataagggtggcaggaataagggactcaatagtgtgactcagagtcattgaagtgattggcatgaggtctcagcagggctttggtggctggcaaaaagcatggagttggactggatgcctaagtgcagttttggtggagaacgaacagtgcaagaagttactttatggataaaaaagatgactttcagattttgagatttaatatatctttgtccctggataacattatctaaatttagaggccatgtaagtggagaaaggaagataaatgaagtcaagaaactctgacaacagggtgaatagggcagattgccccaaactaattaactcatcagtcagttactgaacaccatatacatggtgtaaaggatcaaataaattgaaaaacatactatttatgtgctgcaggattgggtggtggcaggttttgaaaaactgatgactaatatactcgatgattataatagaaatagtgcctgctgcttggtaggtacttagatttttatcaaaagaataaatttatgcatgaaatcgtaagaaggggcaacaagcagatgcatgtggaagagtgtcatggaaagacactcagaggagataagatttgagttgaacttgaaaggatagttagccatcagcaaggtagatataggggctggagtgaggaatttgaagcaaaagagatatgcctctctgtacaaaggcagagatgcagggtgaggctggagtacaggatgcatgcagaggaggaataaaagtgcgcccttagcaacccagaattattatttggactttgtcctgaaggaaatagaaagccattggaggactctaagatggactgtgataagatcaaatttagaaatatgatttctggtgactatctttttgacagtttagagattttgaagagggtaatactgtgggccttttggagtattccacgttgaaagtgtctgtcctactagacagttgaatagtcatggtcttttattttgtttttgttttatttcaaattaaacatgaacaaatttatatttcatatagtataaatatttgtatatatttatgtttataaacagttgtacagatcattgtagataacataagcacacactttgtatatgtgtatacaaatacatatacaaatatcatatacatatgtggtatccagataggatgaggtttgtgcatgagtcactgaagacccaaaataacagaagtttgtatttctttcatgagaaagaaatatgtaggcagtctagagttgttatttgtgtttcagatatctagacaccttttatcattttgttctgcttcttatagcctgtaacttttccccattgcccaggatgtctgcttgagtttcagcattatgtatgcattccaattaacaggaaggaggaaaggatggaagactttaaggacacttttactataaagacacattcaacatgacattttaaattatattccattggtcagaatttagccctagagccttgcttagctataagaggggctataaaatattatcctttctggatggcagtgtacccacttaatagtggtggctctcttgtgatcaagaaggggaagaaggaatacagcatgagaatgaactgtgtatgccagatacacgtagttatcctccttttccccagtaattcaatgcagaaaatctctctctctttttctctttctttgtctctctctgtatgtgtagggggatatatgtgtgtgagcatatttttagaagttcttccaatagggggaatgtacaatcaacgcacattttgtgggcaataataacattttataagcacaagtgttttttgaaatgcttgtgtttatgtaattggcttaatgtatactacatgtgatgattgtaataagttgcatttgtatagagctttaaaaacatttacaaaagtacattcacacttgttatctcatataatctatataacacttttaaggtaaataggatggtgtactatccctattttatatgtggggaaatggaattatgtggttcgatattgaaactaggactggtattcactgacccctactttagggttagtaatggaaggcaataatagtatggattttcgagaacagaggataattagaaaataatttgtattttaatttgaatgaatgtatgctagtggacatgaattcttgtcatttgtttgataaattagcattcgagaattttttcccacccacctgagcagtggtatcttggccatggtcagagcgtcccatgctgttttctcctcctaataggacagatcaattgtgtggtgctgctcagttaatgtaagattgatggataaatttactcatcaatcatgtatttccctgcaattgtaacatgcaaaagttgtctacaagttaattgttttctgacacattcattgtacaaaataatcagagaatcccactatctttttctgcaatattgctttgtaaaaacagagccctggtaaatgttatcaccataaaggcaaaatgaagcactttcaacacctgactgaaatcatggtgttttgagctggtgacgtacattgctcaaaaggacatagtttataatttctactccagggggcattcagattagtacaaagtacttttagcctcttatcgttgggagtaaattttctgaaggtacatttatcttaagaatagcaaagaaaaaagagagctattgagtggctgactaggccgggaattgagctacctcttttgaaaagactgaatttttacttagaaacccaagcaatattgttcaaattttaaactctcatttgggccagaatgaaactttgaccactaatgaagggttaaaacaaggtactctgatatgaagtgtctttttttgtttttaaatgggttaaaaattataaaaactagaagtatagcttcttgctaacattcattacctccagggacatttttcagtccatcaaacttctccattcagtaataccattattgaagactctctacttcttgaaataccttctttctttggtttctgtaactttactctttccttttctctttctaaccccttttcctgtgttttcttagtttactttgcaggcttgtgttcatccacccagccttccacgtggcttgttcccagcccttcctttcctctgtacacctctcaaacttcctagcattcttcccatgctctctctcactctcagagacattgtacgtgctattttcgctgtctgaagtatccttcccttgaatatttaccggttaacttctattcttctaatgtctaatgtaacatacaaacgttgtctacaagttaattggtttttgacatattcactgtgcaagataatcagagaattccactgtctttgttctgcaatattactttgtaaaaacagagccctggtaaatgttatcaccataaaggcaaaatgaagcactttctttctttcttcctttcttttttttgttatactccaagttctagggtacatgtgcagaacgtgcaggtctgttacatacgtatacatgtgccatgttggtgtgctgcacctgttaactcgtcatttatattaggtgtatctcctaatggtatccctcccccttccccatgacaggccctggtgtgtgatgttcccaccctgtgtccaagtgttctcattgttcagttcccacctatgagtgagaacatgtggtgtttcgttttctgtccttgcgatagtttgctgagaatgatggtttccaacttcatccatgtccctacaaaggacatgaactcatccttttttatggctgcgtagtattccatggtgtatgtgtgccacactttcaacacctgactcaaatcatgatgttttgggctggtgacgtacattgctcaagaggacataatttatattttctaccccagtgggcattcaaattaatacaaagtacttttagcctcttatctttgagagtaaattttctgaaggtatatttgtgttaagaatagcatatacaagcctaaattttattattagatttaaattagacctaaatgtaattatcatttgttcagagaagccttacctgaattctgatttataaaaattgcctggtatatctctcatagcatcctctagctcttcttcctacacattacatagtaagctccatggggacggaaaccattttgcttttctaacaacttaatccccagtgtccagtacaatgttcatcacacactaagtgcatgatatttttgaatgaatgaatgaatgaatgaatacattatcatagatacaaataacacattatgaaaatactgttgtgtaaggtatacacacatagataaaggcatccaggagtttccttatttattggctgaactgagcatcaaagcatagatgaaaaatgagagatcaatgtcaaatcatcaggttttcaggttgggatgtaggctttgttcttagtgttgtgggacttaaaagatgcaattgcgggcagaggaaagaatgaatttaagtggttcagtagtgttattttaattcccttcaataataattcactttctctagataccttcaatgtgtaatatcaaaggcaaatataatttttatttctctaaacacaggctcgtatgtagaagatgacatagagatattggaacacctgctacttaactaaatgaccctcaaaattcaattttcatgtgtttttctgatgagaatctgaatgatgggatgaggaattggggaacttctaacatgggttggttttatagtttcagaatgagaactgataaaatcttaatatcacgtctctaattattatgtaagttgactatattcttatatttcactaccaaatatactactcctttcccactggggacaaattttcttcttttggggacacattttgatggcaataagtgcatatttttgacatgtgtaactttctgtgaaataatgctggggaaattacagataactgttaaatgagggtcaacagtcatgccaagccctatatccagatagcttctcttatggattagatttataaagtcctgggagagtgctttgtgtctgtattcactagacattttaaatcttctaatacatgttttatcttactatagccattagaaaacggttcatgattgttcaaactttttttcctctttcttctctctttcaccctccaccccagttttgagctacttgttataaatcttgactccattaaattcttacaagaacattttggaagctgctgctattggggaaaaggtgcacagttagcaatcacctgaataattagattcatgtaaaattccattttgcataatgtaagtcctagcctactcctactgtgtctttcctttagaatctccacatctctacaaattatgtaataacctttagtaaatgctttggccacttagataatggtgatgcatctataaacctcccatctccagatgttatgtactgaaatgtagtgtaaaaaaactgagtcaatatttatttttcttcagcaaaatatataaaatgtgaagaaatgagaaaagagaaggaaggaaggaaggaaggagaagaaaagaaaagaaagagaatgagagcgctttttgaaaatttccagtggagaaaaaattactcatcatgctagaagccttgtaattgatagcccattgatagtctgggaatattctgaaggatttttgattgatactttttaaaaatattacgataatatttgtatcattgcctagtcatttatgtatgaattctataataatatccctttattagtacgcaacatttcagaaatcctataaaactaagtgtgtgttcatgcagagaacatttaaatcagtaaaatccatacatcaaattaatctggacaagtctttctaattggttgcaattggcatttactgtagagctttctttacattctcattttatttactgttgaaagtactgtggattacctctggggagaagaggaagaatgtagcataggtgacattttggtaacattttactgctttaggtggacagtcggtaaattggtattcattttcttattctttttcacttgtaataaatttaaaataagaatacaccataaggcagactttcatatgtaataaatttttaatgaggatactacaccataaggcagacttaatagtgactagttttgtgaatttgcaagcaagttgtatactcattctggatcttgaagaacttttggtaaaaaataaaaaacaaaaatagtaaatataataattcatgaagtcagagctttactgagttatggccatcttttgaggctactttagttctatgaccaatttagattatttgtaattcattcatcctttgaacatttggagtgtggctaatgtttatatgcaattaaccctatatgtaacattgcttcatatttatataaagttattataggacggacttccaacatttaaaagggatgtgccaattggaagtgaaagtattagttgttcactgtctgaacacaatccaaaccactggacaattaggttaattcagagaaaatagaatcataggatgctagagctggaaggaacctcagagataatttaatttacccctttcaattataaataggaaattattacagtccacagaagctttagtcctgcagttagttaatggaagagctagcactaaaactcaaatttcagagcttcctctctgcttcctttctactgtattggtatttcccaaattgtcatttccaaaattgttcatgtgagtgaaaccaaaacaaacaatcacaacaaacaacaataataaaaccaggattttgtggcacagtaactttttgaaatattgcatcttgtatatcccttgtggattcacaatgcactttaatatggtaaaggctctgagaaaccctacagtaaagaaatctatgtaaccatttaatccactcttccccaaattttttgacaactgaacctcttctatgctaaacaaccagtacgttttaagaaagaaagtttggataatactatgaaattagattgtttattgttagcatgcaacttgattatatatgccatgccaaacccctgttgatttcaatagggatagcactgtgttggataaagaagaggataaaggagaaacttggatccagtgaatgagacgtggggtttattcaggggacttacatacagtgtggtccagcggcagtgggctggacaggagaaccactacagtttgtaaaaaaacatgcagtcttcacttagcaccctccccttggcaaccttcacgtggcaaccatcatttaaccccaaacaaaaggccttaatctccctgtatgggcttgcattccacaggatgggtcaggggtttagaggttccttatagataaggaatgaatcttcaagttggctgttcctggatttcttagctcagaactctgaacacacattcttcttaggccatggtgtcattctgagggcatgcttaagttattgttgtcaggtgcatctgccatacagggtcattctcagggtatgcttaagttattgctgtcaagcgcactggccatacaggagcattctcagggtatgctgaagttaatgctgtcaggtgcattgaccatacagggtcattctaagggtatggttaagtcgtcattgctgtcaggtgcatctgccatacaatataacgatcaatttttaaaattagattaactgatgacagcatatagctctaccttaatggacgtagacagttgctcaatagagaggtcagtatcccataagtgctttcaaatcttttcatttcatggctcagtgaagggactctggagagagaacaaggttctagctaatgaaaactgattggagggcatactgatgaaaatggtacttagtaattaataatggaaatacaggtattaggcaatggcaatggaaacagaggaaagagagaagagagtcagagccatttcagagggatgggttgttttaggcccatctctttctcactggaacaaacctcaaaccaagtaaaaataccagaaagtgatacaagaaagacgattagtgtgaggtaagtacaaaggaaggaaaaacatcaaacatggacatattaaagataaatggggcaatatgccatgtcctggaggttatttttgaatcacccaacaaacttaactcttccatatctaaactcctaaagcttttctttcttgactctaattttacttaccctgttctggattttcctttagttttttgagtacatgttttatcactcccaagatattattctagaggacaaggacagtagcttgttttactaagttccacaggtactgggcaattactttgtatgaatcacgccatcgatgaatgtttgctgaataaacacacataggacaaaagcatgcataagtgtgtaactacagtagagtatgtgaagcattagctctgatgatcccttctctcaaaaggtttagagtgtacttcagacaattaacgcactaaaaaagactgttctggtgtgaaacccttgatataggacatatccattacaaggaataggtcatagaagcctttgtagagaaaatagtgttgaacattaacagtatttattgaaagcaatgttggtagttatattagtcctgttgtaacgaaattatcacaaacttaatgtcttaaaacatcacaaattatcttattgttctgtaggtcagaagtctgaaatgagttttacaaagccagaattaaggaattggcagagctgcattacttctggaagctccagggaaaaatccatttgcttcccctttccaacttcttcttttttttttttttttttaacttttaagttgaaaggtacacgtgcaggtttgctatataggtaaactcatatcatgggggatttgttgtacagattattttcttgaccatgtattaggcctagtacccattagttatttttccagatcctctccctcttcccaccttctaccctccagtaggccccagtgtttggtgttcccatctatgtttccatgtgttttgatcttttggctcccacttaaaagtgagaacatgcagtatttgattttctgttcctgcattagtttgttaagtataatgacctccaggtccatctgtgttcctgcaaaggacaagatctcattcttttttatggttatatggtattctatggtatatatgtaccatattttctttatccagtctaccattgatgggcatttaggttggttctatttgctactatgaatagtgaggaaatgaacatagatgttccttgtgtccttatgacagaacaatttgtattcctttgggtatacatacaatgatgagatggctaggtcgaatggttatttatgtttttaggtctttgaggaatcgccacattgttttccacaatggttgaactgatttacactcccactcacagtgtataagtgcttttattcttcataaccgtgccagcacctgttattttttgactttttaataatagccattcttatttgtgtgagatgatatttcattgtggttttgatttgcatttctttaatgatcagtaattttgagttttttttcatatattgttagctgcttgtataccttttttgaaaagtgtctgtttatgtcctttgtccactttttaatgggtttgtttgggtttttctttcttgtaagtttgtttaagtttgttatagatgctgcatgttagacctttgtcagattcgtactttgcaaaaattttctctcattctgtagtttgtctgtttactctgttgatagtttcttttgatgtgaagaagctcttcagtgtaattatatcccatttgtcaatttttgcttttgttgaaattgcttttgacatcttcaacatgaaacctttgtccattcctgtgtccagaatggtattacctcaattatcttccagggtttttatggttttgggttttacatttaagcctttaatctatcttgagttaatttttgtatgtggtgtaaggaagggtccagtttcagtcttctgtgtatgggtagccagttatcccagtaccagctgttgaactacttgtctttgtcaccttggttgaaggtcagatagtcataggtgtatggccttatttctgggctctctattttgttccgttggtctacgtgtctgtttttgtaccagcaccatgctgttttggttactgtagccctatagtatagtttgaagtcaggtagcattatgcctgctgccttggtatttttgcttagtcctggccagagaaatcaggcaagagagagaaataaagggcatccaaataggaagaggggaagtgaaactatccctgtttgcagatgacttgatcctatacctagaaaaccctgtagtcgcagccccaaagctccttatgatgataagcaggttcacaaagtctcaggatacaaaatcaacattcaaaaatcactagcatttctgtacaacagtagtcaagctgaaagccaaatcaggaaccctttttcaacttctaaaggctgcttgtgtcctttgcttacggccctttactgcatcttcaaagtgcatcactataacctttgcttcgttcttataaggaccctgtgatttttactgggcccagcagaataatgtagaataattgctccatctcaagatctttgacttaattacatctgcaaagtctcttttgtcatgtcagataacagattcacagattctgggaattaaagactgggatatcttttggggaccattattctttctaccacagtggaaaaccagcatcagcaaagttacggaagttgaaataagcatggagtgtatagccgaataataaaaagatcaaaatgaaatgtaaagtatgtattaagaagtgtggcaaacaggattgctaagcaggctggtataagttacaaagccctttaaaactcaggacaggagatttagatttaatgcagttaatactagcgaacattccaagtttttaaagaagtggctactgttatgaaaatggtatttataggaggttggtcatgtatgatttgtaggagagcctggtggagagaaagtttgatggcagggagaatcgtaaatgtacagtcagatgtggtaccttgcatagttatttacgtatgttggatacaatgcatttctataaattgtttgactcaaaaattatatttttgaattaaagtagcaattattaatttttttacaattcacttattttatattgtatctgtttttggaccatagtgatggttgtcaattcataccttgtcagtcagtggtttttctttgcttcctcattgtctttccctctgtcttaacacctatttgctaatggctattctgaagggattcttctttttctcattcagagaaatcttatgtgttcttgtgaaagtaactttatgttaggaatggtaaattactttttttagatattgttatacattttcttctttaattattaaatttgtgatattagtgaattcttccaagggggaagatactgacatcagactgaatatttactttaagtacatcttaactggagcttttattgctttcacctggaaagggtcaacacttagttgaataaaaaggattcacctttttacttgtaatggaatatcaactgcaatgtggtttttgatggtccaaagaccatggtgtcctcattatatttaacgtcagagtaaagtgccacatttcctctggcaccagaatggaaaggactgcatgcataatagataaaaaaagcatagatataaaaaaagatataaaatatactatttttctgctggtgataggcaccttctccatcctttccctattgcaatacatgaattttgcccttctccaactctaattgatggtcatttagtatcagagtaatgaattctatagttggcctgtaacctgtggctggaacttttgctaggtcttgggagatgagacacccactctctactgaggtggataagctggtaaatcttaagtttgggactgctgagagtcaccattagagagagttttcttaacaatgaagtcagtgcagaggaaagcaaagcccataaaaaagagtctcagtgttggtgagatgatttgagccctggatccaaccatgatttaaactcaaatatttctgtttcttttggtttataagccagtatattttcttcattatttaagctgattttagttgttcatctatcagtttctgtcaagactccactcttgcacagtacacatacaaccagaactcttacttgggctccaaagtctcttcaaggtccctctgtggcatgtttgtcatggtgttgagttttccccttcagctgcctgactttgtatcttggcagaaggagtgagctagatttccttgctacctcctggtaatttgctgagtcatacaactctcttcaaatatgatactgttatagtagcattaatacagggattctaaaggaaaaatatttaattgccataatggggacaaaaacctggttgataaatcttttcatatttttcctatttatggaattagaggaatgaacacaagactgtcttcaatttatctattactataatggattatttctttatttcactagcaataaatgttgggggattcctggggtatttataaggagtaagagatagttttgctaaaagaatctttaaagattttattgaatgtgagatatccagtaaatgataggaatcagtcttgattctcatccataatttctgcttagggagaaactttaaccaagtttttttttaaaagattaaatattacaatatttttttccagtttttttttcttttagtggctctcctttcttatcaccccatataacctaagaggcagagagagtagttctgttgctaactcttgcagaagttgtgcccatttcttttttctggtttgctgagatttttatgccaataataaggtcggcattcttctttggaaaagaaagttgtctaaattctacgtataagtggcactatagaaatatttggaaaataacaatggcatactaaaattacttggaaacaacaaatgaacagagcagtcactatgcagtgtctgcaattcagaacaactctgctttgagactgtgacataagataggcagaaggagggaagattcaaaaattttcttcttggataaataattagatcaccttttaattattatcagactactgtatgattgctgattttgttcctcaatacttatatgtgctatttctttattaatcaattcctggactactcggtttctgtattcgatcctattctacaaaggccacagcctattggattttaaagagcccttaagtaaggttatctaacataacatccagctgtgtgggagagtgcactatataatatgtattcagcaaatattttttgattacatattaattagaagacattgtgctagacatcaaagataaataagatcaaaataccctcctgctgaaactctcaatgtaatgagatagaagaatggagtgaacaggctactaaaatattctataataaaggataacattgatttatatatcagaggttccagaaagctctaacatttgaattagtctttgaacatgaagcttagaaaacaaagagcacgctaggcagaggagacaatatgcaaaaacatggagacatggagagttcatagacaatttggataattattaacagattgacatgagatgaaactagtctattggtgaagaacgtattaagaaaagcttttgtagcaattgcaacaaaagccaaaattgacaaatgggatctaattaaactaaagagcttctgcacaacaaaagaaactatcatcagagtgaacgggcaacctacggaatgggagaaaatttttgcaatctacccatctgacaaaggtctaatatccagaatttacaaggaattaaacaaatttacaagaaaaaaatggacaaccccatgaaaaagtgggcaaaggatatgaacatacacttctcaaaaaaagacatgtacgtggccaagaaacatatgaaaaaagttcaacatcactgatcgtccgagaaatgcaaatcaaaaccacactgagataccatctcataccagtcaaaatggtgattgttaaaaactgaagaaacatttgatgctggtgaggctgtggagaaataggaatgcttttacactgtcattgagaatgtaaattggttcattcattgtggaagacagtatggtgattcctcaaggatctagaaccagaagtaccatttgacccagcaatcccactactgggtatatacccaaaggaatataaatcattctactataaagacacatgcacatgtatgtttattgcagcactatttataatagcaaaatcatggaaccatcccaaatgcccatcaatgatagaccggataaagaaaatgtggtacatatataccacggaatactatgcagccataaaaaggaatgagatcatgtcctttgcagggacatggatgaagctgcaagctatcattctcagcaaactaacacaggatcagaaaaccaaacactgcatttctcaaacataagtgggagttgaactgtgagaccacattgacacagggaggggaacaaaacacaccagggcctcttcgggggtgggaggcgaggggagggaacttcagaggacgggtcaatgggtgcagcaagccaccatggcacatgtatacctatgtaacaaatctgcacgttctgcacatgtgtagctgaatttaaagtaaaattttaaaaaagaaaaaaaagaacagcttttgtgttggtatgtgtgtgtgtgcacatgcaccattctgaagaattgggacttaaattggtcatccagacagcatgcttatatccagagttcacaaagcagcaattacacttttgagtactgctaattgccggctttttgcctatatattttgctgagatctttttctgatttgtattcactggtcctattctcaactccttaaattaaaattagtataaatctcttttatatgactatccctcagatatttaaaagtgtctgttccttatcttctagtcttcagaattaaagttccagtcattcaaactatttatcatgctcttcatagaacattccagcctcagaatgtagatagtctaataataagcaacttgactggtatgtagcaatgttgtgacctttctctggattctgcaagtaggaatatgagtgtcacttatgataatattagtatttttattgctataattgtcagctacattatatttgtatatattgactttaaaacccatagattagttttccaagactcactcctgtgttgattctgcccaatcctgtaatcgtgcagatgattcctatgttacaaggttttacatttattcttgttcaatttaattatagttaattttggtctagcataattgcctgtagagatacttaaatcttcattctctttctctgtgttatcaaccgcttatgttttttaatcctgtgtaacttagataaatatactttcattctaacttttgataaaaatgtagaatttcaaaggatacatgacaacatctacagcagagcactatagaacacacgtcaaggctggtaatatgcagaatttgcaatataaaatacttcagggatttgactaattagtttaattcacctaaaccagctaatattttcctgtctatactcctaattcataatgagtctgttaaatatcttctaaatcaaagtacattacatctttgacattacccagatcaaatagtataataaccttaaagcaaatagaaatcgtgttaatgtgacataccttttcttttaatgcacatttgttgagtcccagaaatatgtccatttcattttccatgtgaatgtgactttatttggaaataagcttttggcagttataatcaaatgaccttaaggtgaggtcattattttaatacaatataactggtatccttgtaagaagagaagaaacacaaagacagatacacagggagaattccttgtgaccatggtggcagagatgggagtcacatgtctgaaagcatagggacagcaaggattgctgacaatactggaagttaagagagctgtatggaacagattcttcctaaagcctttagaaagagcatcaccctgtcaacaccttgatttttggacatctagcatccaaaactgtgagagaataaatgtttgttattttaagactgccagtttgtagaaaattaaaaaccttgacataacgctaatgtcgacatttcatttttaccccttttttgaaattagatcaaaatatactcatcttaattcttctggcagtaatttggttttctgtgtttctctgaagattactgaaggttgattaatcatcacattattaggatattttaatgttcctctaagtttatacaaattccaggtagtcagatgctcacttactccactgtgtactcatttaaaattgtttattagttgctaattatgcacttggaactaagctagacactggaaatatggacatggtccttggacttgagaagcttatcataataagccaatgaaaatatcactgtaatttagagcaacaagtgtaatgaaataggatacctgtagtcctaggagaaagcaagaatagggggaagaaacctgggaagttttccatagcactgaatttaaggttgagtgcaatatgatgtatggctttaggcgaaaccacatacatcaattaattaaaacaaaagaatgaaagaaccttgcatagcatggagatgggagagaagaagaagctttctggaaatctaggtaagtagatttgtttgcagtacagtcagtggcagggaagagagaaggctggaaaagttatccagagctgtttattgagagatcttggatttctttctgaaggtcatacgcagccattataataattcccacccctacaaactttagatgtgtagcaagctctttcaaaggaagggaaacaaacaagtaacaacaacaacaaaaacatacaaaataacttcttgttgatcccctgtatttacttaaattatttttatattaatgttaattggttatgttcaaacctaacaggaatttggaattcttgtacatataattcacatacaactataaaataaaatatatttataaactaaataccaaagaactcccacaaaactaatcaaattcaatttaacagtgttaaattatatgaatgtaaatgtttgctgaaactaagttgcacctgctatggtgtagtttttttatagatatattttttttattatactttaagttctagggtacatgtgcacaatgtatgggtttgttacgtatgtatacatgtgccatgttggtgtgcaacacccattaactcgtcatttacattagttatatctcctaatgctatccctcccccctccccccccctcacaagaggccctggtgtgtgatgttccccttcctgtgtccaagagttctcatttttcatttcccacctatgagtgagaacatgcggtgtttggtatttgtccttgcgatagtttcctgagaatgatggtttccagcttcatccacgtccctacaaaggacatgaactcatccttttttatggctgcatagtattccatggtgtatatgtaccacattttcttaatccactctatcattgttggacatttgggttggttccaagtctttgctgttgtgagtagtgctgcaataaacatacatgtgcatgtgtctttatagcagcatgatttatattcctttgggtatatacccagtaatgggatggctgggtcaaatggtatttctagctctagatccctgaggaatcgccacactgtcttccacaatggttgaactagtttacagtcccaccaacagtgtaaaatgttcctatttctccacatcctctccagcacctgttgctcctgactttttaatgattgccattctaactggcataagatgttatctcactgtggttatgatttgcatttctctgatggccagtgatgatgagcattttttcatgtgtctgttggctgcataaatgtcttcttttgagaagcgtctgttcatatcctttgccccttgttgatggggttgtttgtttttttcttgtaaatttgtttgagtactttgtagattctggatattcgccctttgtcagatgagcagattgcaaaaatgttctcccattctgtaggttgcctgttcactctgatggtagtttcttttgctgtgcagaagctctttagtttaattagatcccatttgtcaattttggcatttgttgccattgcttttggtgttttagacatgaagtccttgcccgtgcctatgtcctgaatggtattgcctaggttttcttctagggtttttatggttttaggtctaacatttaagtcttgaatccatcttgaattaattttcatataaggtgtaaagaagggatccagtttcagctttctacatatggctagccagttttcccagcaccgtttgttaaatagagaatccttttccccatttcttgtttttgtcaggtttgtcaaagatcagatagttgtagatgtgtggtattatttctgaggactctgttctgttccattggtctatatctctgttttggtaccagtaccatgctgttttggttactgtagccttgtagtatggtttgaagtcagatagcgtgatgcctccagctttgttcttttggcttaggattgacttggcaatgtgggctcttttttggttccatatgaactttaaagtagttttttccaattctgtgaagcaagtccttggtagcttgatgggcatggcattgaatctataaattaccttgggcagtagggccattttcatgatattgattcttcctatccatgagcatggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttattggtgtgtaagcatgcttgtgatttttgcacattgattttgtatcctgagactttgctgaagttgcttatcagcttaaggagatttggggctgagacgatggggttttccagatatacaatcaagtcatctgcaaacagggacaatttgacttcctctttgcctaactgcattgcttattaggttgaatatgtgagacacacttttccttaattgtaaattatcattcaatgttatgactacttatcatttcacctactcaatcttgccttttctaggtaccggcatagctttatagctaccaaattttagattatgttccctaacctgggtttatgtagttttattcagtattttatcttgaacattatgaaaccgaagactacatactactaactcactttaggaatagagctttcagaatttacttttagtttgttctgcatatctgtcaccagaccagagggttttttgggggttggggtgtgtatttaaggtgggagaggcaattctcatataaattcaataataaatttggaacaaatgtcattccatatgcagattagtttataaataatcatgtgcttactagcactgagctaccatgccatggccactaaaaacctcttaattctgttccattcctcttttttcttttgtgtcctaaatattgatattctagtctttgatataaaatcaacgattcagtgatctgcaccaaaaattcatttggcctgttttattttgaaatttttaacttattcagaggagtctattaagcttgaattttgttcttaaagtgctataatggtccttagcattcatgctgtgtcgttgaacttggatttaatttatttcatcttatattaaatatgttataagatgctgattagatattttggatcttggatgaggatgtactaaaacttagccagtctaagtaaattttaattctagaggattctctacagactgaaaacttaagatggcttttcaactagtctcaactagaaaataattctgttctagcgtgtgctctgttttctcttcctaactggagagtctctattgctcatagtttgtattggtgtctgatacgtatgtctatctcctagacactgtggtgttttcagaatggtagaaaataagattgagattgtgacagcaggctgataaatatctttatgtctcttttatttccctgtgtagtgtttaacacataatatactttggacagtgttttaaaaataaattgtacatttttgtagaaaaccaactatctttataataaacatagatgattacctctctttgagaaccaccagatattttagcttcctaaaggagtgagtccagtagcactttatttttaattaactgacttattaattaattaatttgggggaaacttggtattatttgttgaaatgcatagatagtattctaaagaaagtttggttaatatttatacttaggggaaagcagtacctagggcttgtggaaatttggtgggcagctatgacctgtgctatcttttaaaatagatttttttttgtattagaaaaggttttactagtatcaactaatggcaacataattcattactgtaggttgttgctataaggtaagatcctcattgtctgcatttcagaaaagattctctctgtgttattccatggagcagcagatagcaattctaagacactgaggtacacaccacagatactgtgcattttaattgactaatttgcctcttcaccttttgaattacaaagatgaggagctattgaatgaatgctcaggctttagcaaactaagggagaaatgtcattattaccacagaccaaataaaaggtacaaaaatgctaactgaacatagaaggaccaacttgcagaatgaccttgggaactggcgattttcagtggctcatccgcattctcttccttgcatctgcctgagcacagaatagttcattctctctccaaatctctttcaatttactaaaatttgtctttagttgaatagcagcagcgacgtccacactgtctcaagtcatgcattgaagtcattaaatgacaaatatgcttccttaggaaatgttttgtgactcattagtctaacaggagaagcaccatttctctacttccctctctgtctcctaacctcccccttttcttcctcctgtcctcccttccttctttcattttttttttaattcaagaacttgaaattaaattagagataatccaatttaactatttcatttgaggaaacgaaggcccaaacaggttcattactgccagagccagaagtagctcctagatgttcctgatctagttctttttgcaccacatacactgcttctttataatatgcatactaaaataaaagcataagtgaatattataagccttaacacatatgtgttcagcatttactgtgtgcaaggtgctatgatagatgctgtggagtaaaccaaagagaaagacaatgtttattttctcaagaagtttacattctaacaaaggaaataatttccatatgcatttttatataattatatataaattatataataattgccatatgagttttgtttttaaatcctgggtagaaagaattcaagtctgggattatgtttctttttattattattattattatactttaagttctgggatgcatatgcacaatatgcaggtttattacataggtatacaggtgccatggtgttttgctgtacccaacaacctgtcatctacattaggtgtttctcctaatggtatccctcccctatcaccctcacccgctgacaggcaaggtgtgtgatgctcccctccctgtgtccatgtgttcttattgttcaactcccacttatgagtgagaacatgcggtgtttggttttctgttcctgtgttagtttcctgagagcgatggtttccagcttcatccatgtccctgcaaaggacatgaactcatccttttttatggcagcatagtattccatggtgtatatgtgccacatttcaaaagctagcagaagacaaaaaataactaagatcagagcagaactgaaggagatagagacacaaaaaacccttcaaaaaatcaatgaatccaggatctggttttttgaaaagattaacagactgctagtcagactaataaagaagaaaagagagaagaatcggacacaataaaaaatgataaaagagatatcactactgatcccagagaaatacaaactaccatcagagaatactataaacacctctacgcaaataaactagaaaatccagaagaagtgaataaattcctggacacatacaccctcctaagactaaaccaagaagaagtcaaatccctaaatagaccaataacaagttccgaaattgaggcagtaattagtagttgaccagacagattcacgggcaaattctaccagaggtacaaagtggagctgataccattccttctgaaattcattccaaacggtagaaaaagaaggactccttcctaattcattttatgaggccagcatcatcctgataccaaaacctggcagagacacaacaaaaaaagaaagcttcaggccaatatccctgatgaacattgatgtgaaaatcctcaataaaatactggcaaaccgaatccagcagcacattaaaaagctttatccaccatgatcaagtcggcttcatccttgggatgcaaggctggttcaacatatgtgactcaataaaggtaatccatcacataaacagaaccattgacaaaaaccacatgattatctcaatagatgcagaaaaggccttcaatgaaatacaacaccgcttcatgctaaaaactctcaactaggtattgatggaatgtatgttaaaataataagagctatttatgacaaacccatcgcccatatcatgcagaatgggcaaaagctggaagcattccctttgaaaactggcacaagacaaggatgccctctctcaccactcctattcaacatagtattggaagttctggccagggcagtcaggcaagagaaagaaagaaagggtattcaaataggaagagaggaagtcaaattgtctctgtttgcagatgacatgattgtatatttagaaaaccccatttttatgtaattatatataaattatataataattgccatacgagtttttaaaaaaagtcctgggtagagagaattcaagtctggcattatctttcttcttcttcttattattattatactttaagttctgggatacatatgcacaatatgcaggtttgttacataggtatacacgtgccatggtgttttgctgtacccaacaacccatcatctacattaggtgtttctcctaatggtatccatcccctatcgctcccaacccccgacaggcagggtgtgtgatgccctgtctcaaagatgcccaaaatctccttcagctgataaacaacttcagcaaagtctcaggatacaaaatcaatgtgcaaaaatcacaagcattcctatataccagtaatagacagccaaatcatgagtgaactcccattcacaattgctacaaagagaataaaatacccaggaatacaacttacaaggcttgtgaatgaccatttcaaggagaactacaaaccactgcttaaggaaataagagaggacacaaacaatagaaaaacattccatgctcgtggataggaagaatcaatatcatgaaaatggccatactgcccaaagtaattatagactcaatgctatccccatcaagttaccattgactttcttcacagaattagaaaaaactactctaaatttcatatggaaccaagaaagagcccatatagccaagacaatcctaagcaaaaagaacaaagctggaggcgtgctacctgacatcagactatactacaaggctacagcaaccaaaacagcatggtactggtaccaaaacagatatatagaccaatggaacagaacagaggcctcagaaataacaccacacatctacaaccatctgatctttgacaaacctgacaaaaacaaacaatgggaaaaggattccctatttaataaacagtgttgggtaaactggctagttatatgcagaaaactgaaactggaccccttccttacaccttatataaaaattaactcgaggtggattaaagacttaaatctaagaccgaaaaccaaaaaaccatagaagaaaacctaggcaataccgttcaggaaataggcatgggcaaagacttcatgactaaaacaccaaaagcaatggcaacaaaagccaaaattgacaaatgggttctaattaaactaaagagcttctgcacagcaaaagggattatctttcactctccctttgtgtttagcctcgatacaaatctcttacaagtttatctttgaggactaagcagtgagagggggcagcatagtcagagacagccccagccacctctgtcccaggtcacagatgattcacaaatgccctaaagttggcagatctttcttcctcttagtttacaaagcatagcatttttcaaaagaaatcttctctaggtatctcaatgaaagagagaagtttaaaagcatagaaacaaagagcagtttgcacttcccaggatttttgtcctaatgtatctgaaaatccagccagggatctgttagaacagagtcgtttacagagccacttccatgcctcccttttcttaaattcaatttgcagagaattttctcctcattccagtttctggtcagggaaggaattggaatagagtctcccattaatctagcaaaaacggttcagtatagtattaattgcctaaggaagacagcaattatcactcttctctgggtattcccttagagtgcccacaaaggttttaaatgtttctttgttccttcagtgaggtgctgcttctttcagttttcacaatagaaaaggctggtttttttgtttgttgtttgttttttacagagttaaataaaatccagaagctgttcaggagcaagatgcttctggctgggatgctgagcatggttaaatgatgatgatgatgatgatatcagctaccatttaacctccttgtttgtactagaaacttatctattgatgtgttttttttatatctcattcaattctcataacaattatatgaaagtagtagtattatcttcattttaccaatgagaaacttaggaacttgtttgaggtcagtgagtaatagatactttatttaaatacagatcttctgtgacctcaaagcctatatagtctttccactattaacacagactctggtgaagaaaacagtgttctaaacctattagtggggtgggcagaacaatagatgctatgtgttgcattcttagagcacttaaggtcatctgtgttgacgaaggggactgacgacataattttgcatttttcatttattatgtctttaggtacagatttctctacagtgtttaatgaagaggaaaaccaaaactgcccttaacacttgcttttagaagttttcctcttttcaccattagtttatcagagttttgttattttacagaaaatttggtagaaagaaatggtttgttgaataaaagctaatgttagataatgataagtgttgttaagggaataaaatatagaaaaatgagataaaagtgtttttttaaatgagtaatttccccatatttgattttgagcatttcatttttaatagcatgtttgttcaagaaaaaattgcattaccatattgtaagcttgagtacgtaatatatcaaaggaaatcctaattttaaatgctattcttttatacacatctctgccttcagaattagggatgtatttattatcctaagaacatccctttaacttgctaaccatagctgtaatgactcttagtgatagagccccaacttgtttctgaagcttggtgctttggggaagatgattatttcagaactgaaagttgatgggaacatggctgacaaatgggaagtttataagtaaaaagtcctagcaacaaagagacacctatccacatcaatatgggaaaaaagaatactgatttgttattgagtacacacaacagactacgtgcatgtagacagcacacaaaacctttgaagacagaatgacatttcacacaatttatacagcaaagaataagaaaatgaaataacatttctcttctttcctcagttacatctcaagataggctcctagattagctctaagagtatgtttatatttcaaggggttatgaggtctgcaaccttggagacatctttgcagtgtgaaactagagactgggtttatctagaccctgtggagaccatttatatctaataggttagagcgaggactcaagcacattgtgttttcaaggagactcaggaggataagagaaggaagttgcctccttcctcttcataagcaaataatcttcttctcatcttcctcctcctcctcctccttcttaaaatttatctttataacaggaagagtagagcttttccctttcttatctgtgattcatcccttggactggagtcaagctgaaatgagggttgggatgggtattctttagctatttatgatggcattgcatattcagtggcagcaacagaagatgcactgtcttaatttttgtgagttaattcagccattagaacaataagtgaaaggatagacattggcacctcctttatatggagttgcattatctgacagcttcaagttttgtgaactcagccaagtatgtatagaaagctctgagaagctaaaatatagaccacaaaatctgggtcaccaggcacgtaaaaagaattcattatgctctcacttactctctttatacatagttgaatatgcttggttgtctggtttcccagtccacaacagattagatacaatatggtaaaatacactatggttgggtagagttgcccctaatgacagcaaatgtgatagtggaaaacctgatgtcaatggggctataaaggaaaatgacctataatttgaaagacagaaactctaacaaatattaaaatatacattttagtacatatttaatatgtaaaatgtttgataaatactagacacttagttcatgtcatgtgttttccttttttcccctgcaagcattgctgtattacatcacagcaaaaaaaaaaaaatcaatgttcatactattactcttagttttgagaaatgtttatgtctgggtactctggaaaacagcagagcactgtgtgtatacattattagctctttttaacccaatatgttaaaactgaaacatattttggtattttaaaacataaacttaagtaattcataaaatttaaatatgttgagtaataatagtaaaatagcaattaaaagcactttacacatattagttcatgtaatttcatttatttatgctgaattagatgaaactcctcccattagtgctagattacagtacagtcatgcattacttaacaatggggataattgctgagaagcatttttaggtgatttcatcattgtgcaagtatcatagagtatacttacacaaatctagatggtagagcctactgcacacctaggctatgtataacctattgctctgaagctgcaaacctgtacagaatgatactgtactgagtactctaggcaattgtaacatgatgatatttgtgtatctaaacatatctaaacatagaaaaggtacagtaaaaatatggtattatcttatgggaccaccgttgtgtaagtggtcggtcattgactggaacattgttaggtgatgtatgactgcacttttacctggtatttgtattgtcattattttttgtagaatcttatttcacttttaaaaatgcacttttcttgagaacaggaatctgtctgactagtacttaaatttttgatcatgccttttgcataaaagatgcttagtaaacttttatgaagtcaattaattaaatctattgtacaattccgttggcactatacctttcttgtaatttattttttaacagggtagggaaaatagactgatgaggttcagcagaataaatacataaattaagcatggatggccagctcaatttaagtatgagacaatgtctattatcccctgttggtaataaagtactgttttttcagggaagttcaaatgttcatacaaaaataccaagccttaacacaggattggattcaggtttaaagttatcagttcactgacaatcttggttcacagtttggtgcctgttaattgaattgtagatgtaagattatttataattactgcactcttacccttcattttaatctgaattcattaattttacataatgtcagtagtaggtcaaattattgtaacaatgaactacagtccctaaaaattatgacaaaaagaggccagggttaattttaatttacagttttcagattttataacctatgtatcttatatgtgatcaaggcatccagaattattgaatggcccctgctccaatgtttcaattttaaatcagctatttgtaatcaaaacacaattatctgcttatgtgacatatttcttattatgttctcaggttactttctgaaaacctgttatctaaatacagtggcctggaattgtactcatctaagattttagcctgaagaaagctgggagtggactggcaacatagtgatttttctccttgtcttctagatttaggcctagaacaatatttgataccaacaaaggttgtcaaaggaatttgtctctcacatatttgtaatccatttttatctgccttataagtcataatacttctggtcttgggtctatacgtgccaggcatcatagaggcctagaactctggttctgagtttagatggacctgtgtttaaatcctactgcctctacctcttgatgatgtattcctagccaagtttcctaattccccatagtctcagttttctcatctataaaacagagataacagtagtatctatttcacaggcttgtcaagaagattaaatgatataactcactaaatatatgatgagtattgacattatagtgccctaagtcctttaatgtggtatacagccaaagcttttcaactttacaaattgcttctcattcaagatgatctaatcttttccctgacaaataattcatttctttatataactcatagaatttaaatagacattaaaaggtaaacaatctagctacattaatttttactaagatgtgaatcactggtaaccataactctccaagacttatttatgttttaagagatatctatcttttgaaatctgttaaatattgaaaatttaggcatgatgatgaattgaagtgaaagctttagacaatatatgtgaaaggtacatttggggcacattgcctttcaggttggttgtcattgctgagaggcctatcttgggtttagtttgtggaagtttaatctttatatcatatattttttccttttgtacttttccttcttaaagtcctggatttgttccaggatccctgacagataccaaaatctaaagatgctcaagttcctgatataaaatggtatagtatttgcatataacctttgcatataacatatgcatatcctcgtgtatattttaaattatctatagattacttggaatacgtaatacaatgtaaatgctatgtaaatagttgctatactgtatttttaaggaaataatgacaagaaaaaagtctatctatgttcagtacagatgcagtttattttcaagtggtttaaattcacaattggttgaatccatggatgtggagcccacagatacagagagctgactgtacgttctcgaaaaaactgaatcatttggcaaaggcaaggtgacctacaatagagggaggagttagaataaaggtcaggtcagttgaaggttgagaaagcaagatatgagaagcagcaatgactggttttatatgaagctgtgtgtaagtaggggactgcaactgatgggatgtttatgttcccccaaaatccatatgttgaaattctaatccaaatgtgttggtacttggaggtggagcctttgggaggtaattaggtcatgagggtggagccctcaggaatgagattagagcctgtgtaagaaaaagagagctagctagctagctttctgtcatgcgaggatacagtgaaaagtcagcagtctaaaacctgaaagagggtcttcaccaggaactcgacccttctggcaccctgattttggacctccaacctccaaaactatgagaaataaatgctgtttaagccatacagtttgtggtattttgttatagcagccctagctaagacaaggactaaatttattctcaaggttatagaaatgaggaagttaattcacttaatgctaggtttggacatagaagtagatatgtaatagctcatttaggtaattctgtaggtaggatatagtccattttaagggaacataccagttatttggagattagctttgttttctagaagtgaaaagcactatggggactagtataaactgtacggtttaagtgaaaagaatgtccagatgatgtctgcatttcttataaagacaccaagtagggaagttggcagagctctgccttctacttttggtgctatagagtttagaagaaagagtaatggaaagaaaaaggaactgggtacacatcaccacgggtactcatttcagtacaatgcacaccgtggtgctgtaatacttaccccagggacatagattaaggtgccagtcttgcttctcagacacttaatggaaattttgactgtctgcagagataattttttatattatattcaagaaataataaatgtaataggatatagaggaatgaaactttctagttacagaaatatttaacatagtttcactttatcttcaaaattaatccttaaaaacagatagaactgatggtcttatctctgagttgtagataaggaaaataagattgccaaaactcgtatagcttcagattcagaaaaaaaaaggcagatcttttttattctctgtggttctttctgtcatattacttatgtaaaatgacagtgaaacaaaatgcccaggctttggggcatgtgaagacggaataattttcttctagctaacacgttttttctttttttgagatggagtcttgttctgtcgcccaggctgcagtgcagtggcatgatctcagctcactgcaacctctgctttccgggctcaagcaattttcctgcatcaggctcccaagtagctgggattataggcacccaccacaatgcctggctaatttttgtagttttaactctgtctccaaaaaaaaaatacaaaaaaaaatttagccaggtgtggtggcacatgtctgtagtcccagctacttgggaggctgaggtgggaggatcacctgagcccaggaagttgaggctgcagtaagctgaggtcacaccactgctctccagcctgggtgatggaatgagaccctgtcaccaaaaataaataaataaataaataaataaataaataaataaataaataaaatacaagagacccaaacagataaaacacccttgaactatgaaggactaatactttctgatttcaaaatttattttaaaactacagtaattaagatagtggtcttaattggacagtggtactgctataaatatagacatgtaggccagtgtaataaaattgagtgttcaaaaataaacccttacctttatggtcaattaattgttgacaaggatgccaagataattcagcaaggaaagaatagtcttttttcaacaaatgtttttagtacaagtgtctatctccatgtgaaaaaataagtttgggcagctaccttaaaacatatacaaaaattaactcaaaatgggttgtagacctgggagaaagatcaaggtggctgactagaagtatcccgcagtcacctcctccacaaaaaaaaggaccaaaacagcaagaggataaccacacattgaatagagtatctaagagaacactgaaattcagcaaggaagtgacagggaccctctgaggcatagagtgagagggcagccaagcagctggcctggccaggatcggtttggaatgaggaaggtgtcttcattgtggggaaaaggtaggtgagagatccccagccatccactttcccaccacagatgctggtaatactagccacaagagagccactcagcactcacaggcccttagcctagtacagggagctgcctagggtctgtgcaagtgaattgttgcagagagggaactcacactggctcccactcactccccgagaccaaagcagctgcagcatggagccactttgagaacccaactcccaccagactacattattccctgaggcccaacgggccttgcattttcacatccccaaagtcccacttataacccctgtattcacctagaaagctgcaacaccacaatgacagctaaatctggcattgtggcttggtccccaggattctggcctatgcagtgcactacaccctggggaacaggtgatagagcacaccagggtggctgcccccagtactgatactccccagagccttagagctgcctgttctgggctgctgcaactcagaacaacctcccctccactccaacttcacaactgtgtgcaccttcatagggcctgaggacaggacttccataggcagactgtctccagtgcccacatacaccctccggatacctgcatattggcctgccccactcatagctgccaccactaccacatgctcatccatccggggccctgagggcaggcctgccctgatcgccactgttgatgcttgtgcatgccatccaggagcctgagggttcgtccgccttacgtggtactaccccgctttgcctgtatgcactattttgaagcctgaggatcagcccatccttctcaccaccacatgcccccttgtccactagccagaagactgaggacaggcctaccatgttcattgccactgacatatgcctacctgctgccatctgctgtcatggtcactaccactgcacatgtgcacttcccaggcccccagagacaggccactcaacctgctgctgtactcctcatctaggcattccatccaagatcctagggactggtctgcccagcctacaaacactacttctggtgtcttcactcccacgggcccaaggctgtcctgccactgctattgtcactgccagtgctatgcacactgtccaggggcccaaacacatgccaacctggccctcctcagctaccactaatgtccaagcatgctgcctggggcttgaggatcagcctacctgggtcaccccacagccattactggtgccagtgtatactacccaagggcccaaggactggcatgcctagtttaccagcaacatcactcatgcccaaggaccagcccacctggtgaccttgtccccagcaagtccttgtcacagctgccagcaacaactgcagccagtgtcactgaggaactcactgctcacatttattacagccaaagaaatcatacagagactacactactgcactttcccagaataaaagccaaaacaccctactgaacaaacaataaagatctacttacagggaaaaaaatctttcccgactaaagccagtccataaaattggaacaagtgactattaagacagatgcagaggtatcaacataaggacacaagaatgagaaagcaaggaaacatgacacttacaaaggaacatactttttcagtgacagatcctgcagaaagaaaagtctattaaatgtccgaaaaaattcaaaataatgatcttaaggaaacttagtgagatacaagacaacacagataagcaatataaagaaataagaaaaataatttatggcctgaatgagaaatttgacatagatgtaagaaagaaccaaacagaaattgtagaactgaagaattcaatgaatttttaaaaatacaattgatatcttcaacagtagactagatcaagcagaagaaataattaaacttgaagatagagcttccaaaataacccagccccaataaaaacaaaaaaccaaaaaaattttaaaaagccaaaagaaaataaaaggagtgaagaacatccatgtgacacatgggatgctataaagtaaacagatatatttggattttcagaaggagaagagatgggcaaagctatagaaaacctatttaatgaaataataactgaaaatttcccaagtcttttggaagatatagacatccagatacagaaaggtgaaagattcctaaacatatttcatctaaaaagatcttttctggtgcatgttttagtcaaacaggcaacagtaaaagagaattctacaaacagcaagagaaaagaattcagttacatgtaagggaagccatatcagactaacagcagattttccaacagaagtctgacagcccaagagaaaagagaatgatctattccaagtgctgaaaggaaaatactgccagccaaaactcctatatccagcaaagctatctttcaaacatgagggagaaataaatctgtcaaaacaactccagagaatcaaatagaaggaaattcttcctaactcattatatgagaccaacattacccttatgccaaaagcaggcaaggacacaagaaaaaagaaaagtacaggccaatattcctgatggacaaagatgcaaaactcctcaacaaaatctagcaaaccaaacccgatttcacatcaaaatgatcatttaccgtgatcaaataggaatcccagagattcagtgattgttcaacctacacaactcaataaatgtgatatgttacatcaatagaatgaaggacaaaagccaaatgttcattttactagatgcagaaaaagcatttgataaaattcagcatcccttcatgttaaagactcaacaaattaggcacagaaagagcatacatcaatataataagggtcatatatgacaaacccatggctaacatacatactgaatcgggaaaagctgaaagcctttcctctaagaactgagacaaggcaaagatgtctgctttcaccactcttattcaacatagtactggaagtcctagtcagaaatcaggaaagagaaagaaatataaggtatgaaaattggagaacaggaagtcaaattttccctctttgtaaacaacatgatcttgtatataagaaaacctaaagaccccataaaaaagaatctcttagaagtgatacacaagttcagtaaaattgcatttctacgcaccaataatgaactagctgaaaaagaaatcaagaaaactatgccatttacaatagctacaaaaaatacctaggaataaattaaacaaaaggggtgaaagattgctatgatgaagactataaaacactgattaaagaaattgaagaggactcaaacaaatggaatgacatcccttgctcatgattggaagaattaataatgttaaaatggccatactaccccccaaaattttcagattgaatgcaatctctatcaaaaatattaatgacattctttacagaatttgaaaaaatatcctaaaatttgtatgagatccacaaagaccctaattgcgaaagaaatactgagtaaaagatcaaagctgtaggcatcacaccacctggcgtggtgtgattcaaagtatactacaaagcaagagtaatcaaaatagtatgctattgatataaaaacagacacatagatcaatggaacagaatagagaagtaaatccacatatttacagccaactgactttcaataaagtatccaagaacatacattgggtaaagaatacactcttcaataaatagtgaagggaaaactggatatccatatgcaaaagaatgaaagtagactcctctctctcaccatagacagaaaccaactcaagatggagtaaatgcttaaatgtaaaatgaaaatgataaaaccagtagaagaaagcatagggaaacacttcaggacattagtgtttgcaaatattttatgggtaagactttaaaagcacaggtgacaaaaaagaaatataggtaaatgggattatattaaactaagaagcttctgcacagcaaaggaaagaatcaacagttatgagacaacctgtagaacgggagaaaatatttgcaaactatttatccaacaagggactaatacacagactatacaaggaactcagacaaatcaacagcaaaaaacaaaacaaaacaaaaaaaaacccatttaaaaagtgggcaaagaaactaaacagacatttctcaaagggagacatacaaatggccaagaaatatatgaataaagcattcaacatcactaattgttagggaaatgcaaatcaaaaccacaatgagagatgtcactccagttagaatggctattatcaaaaagacaaaaaataacaaatgctggcaaagatgcagagaaaaggaaactcctatacactgttggtaggatgtaaattagtacagccattatggaaaacatcatggaggtttctcagaaaactataaatagaactgccatacagtttagtaatcccactactgagtatttatccaaagccagcgaagtcaggatattaaaaagttgctgacactcacatgtttattacagcacgatttacaatagctaatatatagaatcaacctaaatgtcaatcaatggatgaatggttaaagaaaatgcagtacatatacacaatgaaataaaaaaagaatgcatccgtgtcatttgcaacaacatgaatgagcctggaggacattatattaaacacaactaatcaggcatagaaagatcaataaccacatgttgtcacacatatgtgggtgccaaaaaaacattttgagcttatggaaatggagagtagaattgtgggtgaggttgggaagagtaggggatagagaaagatgggacgaggttagttaacagatacaaaaattacagctagataggtggaatgggttctggtgttctgcagcaccttacagtgaatatggataactataatttattgtgtcttttcaaaaagctagatgagaggattttgaatgttcacaacacaaagtaataataaatgtttgaggtgattgatacacttgttaccctgatttgatcattacccattgtacacacattgaaataccattctacgttccataaatgtatacaattattaaatatcaactagaaaaagggaaaaaatggattatagacctaaatggagaactcaaatgatattaataaatctcttagaaggaaacatgggaatatggttccatttatatgaaacatcagaatgggcaaatctgtgaagactagattagtagtttgcctatgactgacgcagggagggagagagatgaagactgactgctaatggaatacaaagtttcttcgtggggtgatgaaactattctaaaagggtttgtgatgatgattctgtaattctctgaatcgtctgtaaaatccactgaattgtatactttgaatgggttaattctatggtatgtgaattttatctaaataaaaccattaaaaataaagacaaaggggcctcttcacctctattatgttctccttcctgtgactgttttccctaaattctttccaagataatgctcagtttggatggaatattagttctccttttgctgaaattttcaggtaggtttggtggttttccatcagatatttttcaaaagagtgtcttaaatgggggttaccttttcctttggaacattatgaaacatttatacaaacagagctgtagatatatgataaaagatttaaaattcagttatggagctgggagagggctcaaatcacattttgtagctcgtatttttctacattattcctcgaaatacactcaatcaaatatatttaccaaaataactatgtactagctttcaaatccaacagcttaaaccacaaaacactaattgctacctcctttgaaccttgtaatacttctttttctataatttgcttataattaccatatgcaggcttgtataaagttaaatatatatgtttatatattacatatataatatatgtaaaataataatttgcatattatatatatttagcttaatttataaattgtaagtcaatagacgaaagctttttaaagtttcctaaagacctaacacagttcactacatatatgagctaattaataagtgtttctagttgggtagtagataatgccagtctctacaccagagagaaggggttgaacattaatgtgagtggcttttatcagtaatccagaaaattatagaatggcaccttgtatagtctgtgtattagtcccttgttggataaatagtttgcaaagattaaagatactctatacaatcttacagggctcatcagttagtagctcatttttgtacagaaaatggtagctctgtgaaatagaattggcttagaagactttgacttactggaattctaagtaaaattcaaaacgtaacttttcctctcacacatttttacaaagttaaaaacaaatgctgaaaatacttcatttggtacaagtattccacatgtgcaagatacaatacagcaataagatggaattttcaataaatgactaaacattcaaataagcatctttcataggaggtccttggcaggcagcacacttttcccactaaggctgctgttataaaatcatttttggagctattcttttggaatgtctgtccttctctcaaagccagtgtacaaattatatgaataaacagttttggtacttttccatcataattgtttataacaaaaattataatactccagttagtcaaccacttcattctagggttagctcactttggggtgcttccaaaattatatccactgttaaaacaagaagatatgctaccatttacagttcttaaaaatggattttgagctttgtaatatcactataacaaatgtgtatcttggttcactgccaggtacatgttgagtatccaatcaaatgttggtataatgagtgaatgaattaatatgatttttctgttactttaaagggagtacatctttagcaatatctgtatatgtttctgaaaaatcaattatttcatattcactgattgtgtgcttatgcttgctgtttgaactctttattttctgctcatggcttttgacctatttatattgacatacattctgttgatttttatatagctctaattgcaaaaataaaaattgaacaacatgtaaaaagaaactcgttccagcattttcaccagctttccatgccttctctgttatgattggtagagctctgtgatgtcttcagcctattttcaaatttctgcgtaataaacttcattgggcccacagatctgaatccattaagttactttaagtaatcagtgtccagatccttccttatttggtcatggtgttttgcactcttattgcagtggctgcttttctggtcctttgtagaaacagagattttctggagtcatttatagtattcttgctctccccatttaatacattgggttagatttctaatttaaaaaaaagcatttcttatttcttttagtgtttttcaaaacttgctatttattaattttttggtctgtcctttctttagcctcttatcccatgaataaataagtacatatgttgaaaaagaaggaaatacaatggatttatacacctttcaaaaatttctagggctcagcctctacagactcaaattttaattaatagtttacttttttttgtgccactgaaatttactaaggcatatgtaatgaaatatcaccttttcaggaagcttccactaatggggctcagctgaaatgccttctccttcctttgggtccccagggctttgtggctttgtttattttgcctcatcttggagtaatttgtgtatagttcttagttgttttaaacagtaataataataatagcaatgattagtattgattatttcctttgggtcagatacttgatgtgtaagatcctatttatttcttacaactatcttacagcaaaggtattattatcatcttcattttatcatatgtcattttatcacatgtagaatcataaatatatatgtgagtatatatataagcagaaacaatccttataaaaaccacaattttttatatatatatatatatttttttttttgagttttgcaatatcactataacaaatgtgtatcttggtgtactgccaggcagatgttgagtatccaattaaatattggtggaatgagtgaatggatttatataatttttcagttatatgtataactatggtttttataaggattgtttctgctgataatgagaatttgagcaaattattctgtacaaaataaacctgggttacattttccccttcagaaccttttattttcttatatctaatcctcttgttagggacatttgaaattggcctctttttggtcccttgagacttactttatttctgcttggtgcctatagaatttttaatttaatattgaagtttaataaccttttcccctgatacatggtgtgccatttctaccttactattgaattctctatttcacagaaacgttcctgtattatatctttgaataattttctatttcatttgttcagttctctagtttaggaaaataagaggaaaatatgaaatggttagatgctaagtagatataagacattataagaagcaaagatgaaggaaatgtatcagatgtacagttcagaacaagtagtgtcgaagaggtcagagcgtctgggaaacccaatcaaaatgtttcccctgaagatctccgtattgtgtcagccatcatagactccctacaatagtacaaatagaacactgctccttcttaatcgttttttaagttagtatttaaccctcatttagtgtgtctttaccatgtgctaagtcctgtaaagacaaaagatattaatgctttagtctaaaatctagatttttttccaccaactttggattttaaaaagttttaagcttccagaaaagttggaaactagcaagatgttaaaacaaatctagattcactgattactctttaaaattaaattccactgtcttctaaaatttcagcatgtatctccaaagaagatgattcatctacatagtcacagtaccccccaaaattaactttgaaagtatattaccaaagatgtagtttatattcacattttcccaattttctcaacaattttatttatagattgtctctcctaggatccaattgagtattacacattgcatttagttttcatgtttctttaacatcctttattctaaagtgtcctgatgttaacattttttagagttctacaatctgaatttttctgattgtttcctcatgattagattaggttaaatgtttttggcaagagctgtatcacattaagtggtacaaaatagtagtttatcctattctttgtaatgttatcttaaattacttagttaaggtgttggctgtaaatcttttcgttgaaaggaaaactttcctttggtaattaacaagttatctgtagggtgacactttagaccatatgagcataccgttttccaacaacttttcattgaatggatttagaaatcattaatgatccttgccagaatcaattgtattcgtgttggcaaaatggtgattttctaattctactcctaatcttcttaagcacaactatgacctcattaaggtagctgtcccaaattttctgggcctcttttttttttaaaactatctggtagatacagtgagatctcttttacaaaaaagaaataagtacagtgttaaatgtctaatgagcatcaggaacacaaaaaaattgtacctacattgacctgctctttaacttcttccaatatggaagagatagtcagtgagcacctgagtgatctttcaggaaagcaaagacaatccacgtaacatgtttgtctctagcactcatccttggatatgtctcctttccttcatgtaaacagttaagaaacacccaattgtaaatataaaactcattctgaaagaagagggggagcaatactgtaaggacttcaaatttcctactctattattggaaaatggagcattttttttttttaatcggccgcagggatttttgttagtgtttttgttttattttaattaagaagaaaacattaattctatgaaacataagccatttgctttccatatatttggcctggagtagactctggacattgataatttttcaaaacatctccaggtgattctaatgtacagccaggattgagaaatttttgaagaacaggtaactccatcttgaaagatgggtggaattaggacatgtggagattgccggaggtaactttaggtgaaggaaataacataagcaaagattaacctactgatggcaaggatttgccattcttttccacaaatgaagccttttttttctgttatgtttacctgaaaggtaattggaaaaatgatgccttaaagttcactaatttgtgagaatcataggcaaaagctttcctgtgatattagagaagagtaagatattgttcttgataacatcctgcaactcatcatttatagcataataagcccttccactctgattctgttagacaggcccatccatggcaagatattaaacaaaacaggatttattgaaaacatgtctgataatagcaatgatattgaaaaagagcaaaacagtacaatcctggtttttatgtttctgctttgaccacaggcttaaaatgtgtatttcaagcctataaatattgattgtgagacacaagaaacataatataaatattttgaaggaatagtaattaagagcagtgagtcacaggtagctaccagatgaaaataataaacccaactttgtcagggcttcagatcagagtaaggtttcaattttgatatccacggagaagagccaaattgaagatgaatatgagtaaatattgatgatccatactactgaatttgtctggtgataaatgtttcttaggtattgcacatattccgaactcataaatacatatactacataaaaacatggaaaaaacccttcagaaatgttttcctgtattatattttcagaaagtcacaagttttagagaaatcatataagcagaatggcagacagcatgggccatatttccatgtcaaaagtaaattgaaaatctaaattagtacctgaggttaaaaatacttatgtccacagattccagaatacaaaggaaaagtaatgccagccaaatctgaaacataaacaactataagttttctttgtatttgaaaatatggccttggaactctgtataagaagatgcttacttcataaacatacatgtgcaagtgtctttttcatataatgacttctttaagagtgccctccaatgatatgacaagatgctgaccgatgttatacctcatttcctgaaagtttctaagtgctctatgatggatcctatggtggtgagagtcaacaacctttgtcataataaataggagatttttctcacaattttcgaagtaatgtgacattaaaaataaggataggaaggagacaaggaaagaagaatcagtaaagtagtaagaataattagtattgtgtcaggagaactaaattctagttgtgtctctgtcaccaactagctagaaactttgggtaaaccatcttacctattgacttcacttgcaaaatgaacattaggctgtatttcaataatttccaagtgtttgaagaagtagaacctttatcaataaagtatagtatagaaaactttctttcctccacttttaaattattcctgaagttctgaccctttttcctattctttactttcaaatgcttttaatttcaacttctcccacttgctgttacaccctaatatatctaatacgtctctacaggtatatttctgtgcctttcagtagccctctatgttcatctactttttaattttttttatttcaataggattttgggaaacaggtggtagttggtgacatgcatagattttggtgcacccatcacccaagcagtgaacactgtacccagtgtgtagtcttctatttctcaccaacccccatcctttcccctgagtccccaaagtccaatgtatcattttgttttattactttttttcttaaaaatattcagatattgtatcttattactcctttaagctactcatccattctacatgttttccttataaacttttcaaaatggtagcaattgttttcacaagcagagccttatgggaattttacatgtgtggaagaacataataaatttggaatttgctgatgatttcacttttaaaaataaataaatagaacctttttctcccttgaatgaactcttacttggaatcataatatgtaaaacagatgaaggcaaagatgcaggagaagttcttgagtcctaccctttcagccattcccatccttatgagactgacatggcactgccacagacacccaagggccttgctactcaaagtgtggtccaggaatcagctgcatcagctggttagggatacagaatctcagaagcttatttgagaatcacaagctccagtgggacctactaaatcaaaatctacattctaacaggccccttccacccaccacccaccttcattcctccctaccccctttttcctcaccactatgatctggttcacactaaagtttgagaagctccgctctaaatacagatgcaactccatttgaaaagtaactactggactagttaactcatagagatgaatgatgttcattttgtcctttcacacaccacactgactgattctcagctggaagcccagtgtgcaagaagaacaagaaatagtggcactaatgccatttttagtcttatagaaatataggaatatagaatgcagggttttattttatttagtagacagtccagtggtctgtttattctacaacactgactcaaagaaagggactacatagtggcctttatgtatattagcatatcagtcagggccccagcaggaacttaatgccacactcagtgggagacttcttaacaaagttgtgggcaatcttaaggaaaccactaagggatggtgaagccctagggactagcaatggtgggaaccactaacactgtcaatcttgatggagcaagggaagggatggaacctagggaaagctttaacagtgggaagggcccactgtgggatctcttgccttaggtgggagaataagccactgccaaatcacagatcagcagagagcaaaccaagagaatgaataaaccagactttctctcctctcccactctggtcacctgccatcgtttaccattggccaaacccaactggaaactagagtgcaggggaatgatttgatgcagtacagaaaagtcatcttcctggggtacagagcagggtacagaaggtggaaggtggttctgaagaggaaattcagaatatctaacatgataaatagttggatttgtaaataggaaaaaaaaggtagtaaagtaaaattctaatggaaaggtttcatttgtgcttgttttgtttgcatatatgttcatacacttatgtgtgtatgtatattaagcacaagggggaatttctaagacatagtgagatgtagcagaaaatgtgtactttgaagagactttatactttcttctgctgtagaaagttttagataagagaacgttgttaatctgtatttatctagcacatacccttttgtaggcactgctaaggacactcaagtataaaacatggtccctccctcagagaactatgatcttggttgaagggcaaaaacatcaaatatgtttataatatgcacatggaatggaatgctttatttcgttcattcagccaatatttattaagcacctgctatataccaggcaatgtctttaagtcgagtcagaaattcaaaacaaattccctgtggacagggaatttgtaatcttgtttgaaaggtggactttaattatacatttcaagcatgataagtgttttgaaaagagaaatacggagttgtttaggaatttgtatcaaatacacctaacatattggggagccaaaaaagcctcctcgaagcatttaagaagtataagtaggaagttattcaggtcatagaggatagtaaggtgaagggcagctgggggcagtagagatgagggtgtttgcaggggcgtactagtagaagggcagagaagatcatgtgttcaaaaggcccagggagaaaagagatcatggcatatttaacaaagtgaaagtaatctattataactggagcagaaagtaaagggagtgtggtattgtcctttatcctacagcactagaaaggtattaaaatattctaagtaaatgaatcactccatcaaatggaaaaattatgaatataaaatttggacttctattattaccattttgaactaaaactttatgttgatgtgtttatttctaaagtttttctgagaaataagcacaagaatgaatttttctcaaaattttttccgaagtttattttttacttctaatttaagaaaatagctgaattgttcggaattttctgtcatgttttgctgtatattaaagtaataacatcttttaaaaggaaattggcaagtgttctttattagcaattttataaagatagaaccattttaaattgattgttgccaaaagtagaatacaaaaagtatcacagaattatgtgaataattaggaaataaattttacacctctttatgtgtatgtatgtgtgtattcttactgctggaatttcttaatctctgtcagcaatagcacttactttcaaacttcttcatctactgcctcagcttactgatacttctatatcaatatagttattttgcctttctggagaaggtaaatcacaaccaatatgtatttctttgaattctagccaagcaaaaaggacatgcagagtccctcttgagctagaagcgtttatgcagatggtatcatttcatacaaacatgtattgtcaaaacccatcataagatcactgtcagaattactggggatcctgtcaatcatatgtttctccatgttattatttttccaagtatcttctttcaccactacagtagccctgatggatattaacacagaaaaaaggaatagtgccatcaatagtgcttcttttcttccaataacaatatcatcatttttggcacagatgagagataccttatttcttaggtgaatgtatagatggagggacacaactgaaagaatgacttcttaatcagcttacaatgtcatattttcaaactttatggattcagtggctcatgttaaattattttacagtagacatttatatatatatgtatataatactttaagtcttagggtacatgtgcacaacgtgcaggtttgttacatatgtatacatgtgccatgttggtgtgctgcacccattaactcgtcatttacactaggtatatctcctaatgctatccctcccccctccccccaccccacaacaggccccggtgtgtgatgttccccttcctgtgtccaaatgtcctcattgttcaattcccacctgtgagtgagaacatgtggtgtttggttttttgtccttgcaatagtttgctgagaatgatggtttctagctttatccatgtccctacaaaggacatgaactcatccttttttatggctgcatagtattccatggtgtatatgtgccacattttcttaatccagtctatcattgttggacatttgggttggttccaagtctttgctattgtgagtagtgccgcaataaacatacgtgtgcatgtgtctttatagtagcgtgatttatattcctttgggtatatacccagtaatgggatggctgggtcaaatggtatttctagttctagatcccggaggaattgccacactgtcttccacaacggttgaactggtttacggtcccaccaacagtgtaaaagtgttcctatttctccacgtcccctccagcacctgttgttccctgactttttaatgatcgccattctgactggtgtgagatgatatctcagaaataataccacacatctacaactatctgatctttgacaaacctgacaaaaacaagaaatggggaaaggattccctatttaacaaatggtgctgggaaaactggctagccatatgtagaaagctgaaactggatcccttccttacaccttatacaaaaattaattcaagatggattcaagacttaaatgttagacctaaaaccataaaaaccctagaagaaaactaggcaataccattcaggacataggtatgggcaaggacttcatgtctaaaacaccaaaagctatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagtactcaaacaaatttacaagaaaaaaacaaccccatcaaaaagtaggcgaaggatatgaacagacacttctcaaaaaaaagacatttatgcagccaacagacatgaaaaaatgctcatcgtcactggccatcagagaaatgcaaatcaaaaccacaatgagatatgatctcacagcagttagaatgacatttttcaaatcacgaagaaacccagaaaatttgtatatagtaggctctgatcttgccaaatgtgggattattctgatacatagtttatgataaattacaccaattgctcatggtctgcggctgcttataaagatgaaaatttgtttgtccattagttattagttaacagtagatatgaataaatttatgaatatatgtatataaatttgcaaatatttgatccctctgaaattacaactgaattctacttgtttccaaaatgttttcaactttatacattttcatttattcattcatacattgattgactctacaaatattcactgaaacactactgtgtgttaggtcccatgctagacctatttttaaagttgacttttaaacagatcctgctttgaaaaagctttcagtttagaaagggggtaaggcacggagacatactacaagagacaatgtgctaagcaccaaaagaaagtcttgtgcaaagccattctacatctgagacaagtgaggttatttctacttgagagggtagggttgcacacgagggacaattttataatggaggtgacattgggaaagcatctcccagaatggataggacagagacatagcaggattggagaaaagcacatttttccagcctgtgaggaaagtattagcatagagtgtgtgctcagaatagagaagatgcaaagcatggagtaagacaggatcttgaaaaggcttggaatggtgaccagactgcatgttctgcaaatggaaaaataaccaaaaactattattaaacataaatagcaaggggattcttctcaggaagaaactaatagtatggtggggattcatttgtttgcaggaagggaacagttgcaatacagtggtgactataaatttttatgtactaatttttcagtatacagtagaccattgagcaacacagatttgaactgtgtgggttcacttatatagattcttttttcaataaatacattggaaaatgttttggagatttgcgacaatttgaaaaaacttgcagatgaaccttgtggcctaggtatattgaaataatttaaaagttagttatgtggaaagcagtgtggtgattcttcagagagctagaaacagaactaccacttgacccagcaatccgattactgggtatatacccaaaggaatataaatcattctaccataatgatacaggcacacaaatgttcactgcagcactcttcacaacagcaaagacatggaatcaacctaaatgctcagcaatgacagattggataaagaaatgtggtacatatacaccatggaatactatgcagccataaagaactacatcacatcctttgcaagggacatggatggtgctagaggtcattatccttagcagactaatacaagaaaagaaaagcaaatattgcatgttgttacttgtaagtgcaagctaaataatgagaactcatggacacaaagagggaaacaatagacactggggcctccttgagtgtgcaggttgggaggtgggagaggatcagaaaaaaataactattgggtagtttgcttagtacctgggtgacgaaataacctgtacaacaaacccctgttacaaaagtttacctgtataacaaacctacacatgtacccctgaaccaaaaataaaagtttaaaaaaatgtagatactagtctgtttcatcatttactactataaaatatatacaaatatattgcaaaaagttgaaatttataaaaaaacttatgcacaaaaacactgactctacccggcactaccacttgcagttgagagaaatgtaaacaaatgtaaagatgtagtattacatcataactgcataagattatagtacatactgtactattgcaataatttcataaccacctcttgttgctgttgaagtcctattgtatcctcttaaaatggcatgtgatgctaatcagatctgcatgagcagttcatctctccagtaaattgcgtattacagtaaaaagttacctctcttggtttttgtgtattttttacagtgtttagtgcaataatgtaattcttgaataacaccatggggcccacatgaagtcccactggtgatgctgaatgtgcttccttgaggcagagaaaagtcatgacattacaagaaaaagttgaaatactttatacgtactgtatattgcggcctgcagctgcagttgcctgtcatttcagacagacgattcatcttgtaaacagacaatgtaaacttatggtattgataaatatggtacagtactgtatatgtattttctcttttgattttcttaataacattttatttttctctagcttactttattgtaagaacataatacataatataaaatacaaaatatgtgttaatcaactgtttatgatattggtacagcttctggtcagcagtaggctattagtagttaggtttcaggggagtcaaaagttatacatggaatttcaactgcatgggggaccagcgctcccaatccccatgttgttccagggccaactgcacttttttcattcttaataatttactctttttaatctctatatggtttataaaacttttcatttacataattgtttcttaaactcactcaatacaaagaatcatttgggatgcttgtaaaagatagcatactacagttattatagttattccattatcttccacagaaaatttttgcttagatttacctacattcgtcccattctttgtttcctatttttttaatcttaggttattctgggttcatttttctttgtttcagtaatgcacttttagaattttcttttgtgttattcatggagaagtctcttggtttgtgttgatctcattagcattataaaaatatagcttttctgagtgtaccacactaggatgacagttattatttctcaatccattgaaaatattattccattgtgttctggtttctattacttctatatagtgtcagtcttctctctctgcttttatgatctctgtgctatctgtggattcatgactaagcgtctaattctggattttgttttatttatatttcttggtggatgctgtgcttgatatcgtgagttcatatttttcattacttcagggagtttcacaatctggtacttcaaaatttacctttccccattctctttattctccccattctctttattctctccctcaggtactctgattaatttagattttcacattctatatcatatattacttgatctcctcatattttctactctttagctctttgttctacatgttacggtatttttagatcttccagttctagtttatttactttctttagtggcatctaatattttatttaacccatctgctgttttgttttactttcaaccattttttaaaaatttataaaggttctattttcttttccaaatatccctcatcagtttttaattggctctcattgtattttgtgatgtcattctttacttctttaaatgtcctatgtatattttatattccaagtcgtaaaatctagtatttgatgcccttggtgagctaaatctattatgttttttcctacctactctcatttctggtggtaagttttattgtaaatttggtgattgttgattgttaccttatatttgactttattttattctgaggaaaactaggatgcctaatttaaagatatattccatgtaagagaaggttcatgtgtttccacagggattttggagacattacaaacctagaacaaatttagccccttccagggtttcaggtataatccaagaatctcattttcagcttatcttccttgctgctaaggtaaagctaaatctccaaaccacagtgcagagactggcatttaccctcaagctatcctatcttaagtatgcgctttcagctcatagttaagcttttagctcaacgtttatgcttttatttttgcttaggccccttggagattttcctcacctattttaagcccagcagtgttatgaaaattatattttatgcaaaatctactttttttgtttgtttttcatgaggatccttccagcctactgccagaagctgaatgatagatattttttgcctatagcacaatgacagtctggaaattatcaagttgttttgatcaatataggtaagccaaactggaatactttagaataaacaaacaaaaatgaacttggcatctgatttgtccagtttagtagtctctactgattcttgctactttgtgctatttggatgcaacgtaaaatattgtattagtaaaatatttaaaatgagcccagatgatattatgctaagtgaaataaaccaggcacagaaagacaattactgcatgatctcatttatatgtggaaactgcaaaaaggctaatacatagaagcaaatagtagaatagcagttacaaggggttggggtatgggagaaatgggcaggtgttggtcaaagggtgcacatttgcaagtataagatgaataagttctagggacctaatgtacagcatgatggctatagttaatgtactatatatttgaaataggctaagaaagtagatcttaaatattctcgccacaaaaaataaatatgtgaaatatggatatgttaattagcttgattatggtaatcaattcacagtatatacatgtatcaaaacatgatgttgtacacattgaatatataaaatttttaatttatcaattgtaccttaataaggctgaaaaaataatttctcttttacagagtggtgactgggccactcggagactactgcatagctcttctcaaagcttctttttctttattctaatatgctttgtaatggaaaattgaagggaaagtagagaattgactcattaaaaagtctaagacattaaaagatattttgtctatttttccaatagttaataatctttacttacggttgattaagttcatataagttaaccattccattaatatctatagagtgcctacatggcgtgtactgttccacatggtagaaaacatagcaaggaacatgtagatagaaatcgctactcttatggatctagcatcctatcatcatgatagacataaatgagaaaaggtagtaaaataaatagtacggtagatagtaagtgctaaggagaaaaataaaacttggaaaaggaatcaagaatggtgaaagttgttgtaatattagatgggtatatggattcactgcttctgagcattttcttaatgcattctgtggactgttagatcacaggcggaccactcccataatctagtgaacagattatttaggagagtgagtgttatgggttaactgtgtacctcttcctaagatactttgaagtcctaacccccagtatctctgaatgtaaccttatttggagataagtttctttacagataagtttctctattatttctttacagaaataatcaagttacaatgaggccagtagggtgggccctaatccagtatgacctctgtccttacaaaaagggaaatatttggacacagacacaaacacagggagaatgccatgtgtaaattagagttatgctgctgcaagccaaggaactaccagaacctaggagagagaatggagatctgtcaacaccatgatctcagactcatagcctccaatacatatggcagtaaatttctgttgtgtaagccactcaattcgtgatacttccttacagcagccctagcaaactaatatagacagcttaatagtatgtaggacaatagtaggtgctgagctaagggctctaaaattacttctagcccactgtatagctgctttcatttaatttaacaaatatataatgtttatgataaattagggactactgtagaaaatttgtaaatattaaccaatgtgcatccaaataacaattgtgttatataggttcatttattattttaaagatgtcaggaaaacattcaagcaaacattgcatggcagggcagacattcttagaccttatataggggattttcctgagggtgtcatataacacatgcacacttatgcaagtttttaaaaagctcattctctagtgatagtgaaagacgtaggcaaaggacatgctccagacaagaatacctgtatcctagtcctgcacctctgtttcctgagccgtagaccctggacacatcatttctttcagcctccatcttacacctcctaatactaactaggttactataaaattaagtcagatgataattttaaatgttaaaataaacatcaaaaagaaataaagtctctaatacatagtttgccctagagattttcatttttagagggattattccctcaatattttctcaaataatgtattaatttatacactgcttgtgaacactgagatttaagaaaccatttaaattatttagagaatacttgaaaggctttaaaaccatctgactggaatgcaaactacacatacaattactttcaaagagataaaaattgatatgaaattataattcataatgattaatgttgaacgagcataaaaccaactgcatatttgtcctttaagcaaagctttggattcagaattatagattaaaatatgtgttaatcttgggacttgcctttaattaatttatggcatagaacctaaaaatgggaagtatattaattaaaatgagagtgaatatagtcagactgggttgggaaagaatcttgatggattcttttcaccacattcttagtatggaggaggtgcgagtctagatcacatctcaagtgtatgatggagttgggggaaaatgatttcttaccaagacctggtatattagtcaaggtaagtattgctagctgctataacaaacaatcgtgaaatcccagtcccttaaaacaggaaacatttatttcttgctcacatcataggtctgaggcaggttgggtgcctctactgagcagccctgctgcgagagagactgtggaatccagtctcctatcttgtgattttaccatcttagacaagtggcctccatggctactgaggaaagagtagagagagaagtggagaatcacataggctaaactcacattccaatggtcataactcagtcagtatagctgtaacctgacaagaccctgaccaataacgttttgctttctgctatcatcatatgggcctttcttcagtgctctaagtatgcaatttttcttttccttctgggcctttgaactttcctttacccgtcttggggcacttccttgccatatcccaataacccacgtgcttttcaccagcacagcaagcttccaaggaatgtttcttcagttgaactctatcatcttgtcaaggagttttttacacgttgttcatgttcacgggaatgtctagaaagacaaattctgattatctgtgtctgagacattttgctagtgcaaagtcaaccttcatcatgatattatgatttatgtggcactttttatgctttataaaactgtttttaattgataaaactaagcagaaatgtatttatagacagttgtttccagagtttcactgttactgaaaatgctgtactgaataagggtgtatttttaatctgcattccatgcttatagctatataagctttatgaagcttatatagcttcataaaatgtattataaattcttcaacataatttcatagttaatagtttcataattaatagtacctgttggtagtatctttcatatgccagctgaataatcattatcattgtcataatgcttaataacaacaataataattgatagtagttgttgtgtacatgtatatgtgggtactggcctatgcttttgatatgtattatttcatttaaacttcattgtactagtcagggctctctagagggtcggaactaataggataaatgtataaaggagagtttattaagaagtattaactcacacaatcataaggtgaggttccacattaggacatctgcaagctgaggagcaaggaagccagtctgagtcccaaagctgaagaacttggagtctgttgttcgagagcaggaagcatccagcacaggaaaaagatgtagccttggaggctaagccagtttaatatttcaactttcttctgcctgcttttattctggcagcgctggcagctgattagatggtgcccacccggattgagggtaggtctgcctttcccagtccactgactcaaatgttaatctcctttggcaacaccctcacagacacacccaggaacaatactttgcatccttcaatccaatcaagttgacattcagtaataaccatcacaagtccaccccttgtcaacttgaacccatacacatctcctgaaatcatacataatcttcaaataaagacaataagttcataattacacataacataatacaactatcctttgtacaaccagaaatgcaccaatccccaacccaagtgctatcacataaagtaataacacttaaatgctgacatgaaatcaataaatcttatgtcacatgataaaggagaaatgaatgaaatgaagatattttcttagtacaagtgtatacatgcacaaacatgttcttaacaaaataaagaggaaatactcatgacaattacactcctcatttctgcaactggtcatatggtcgtagctggtattgatgactaccttcttctactacccattctgtattccctttgccttcagcaagcacctcagcaggccatggttttttacttggtgtagtgacccaaaccttcagtcctgaaggatctgggctatttgtagtcctgcctggattgtgttcttctagtttcccattgaccttaatcacgtcacagggcatggtaatactaaaagacactctaagggatctcctgtattccacacatattcttccttacctccattttgaagtagtggactgatttcatcttgatagtccaggtcagtcaccccaaccaaacactgtaactcccttcttagcctccctaacttaccttctaaaggtaggaggagctcaaaatatccaggtggcaatcttaacttccagcttaatagaattgttgcattcttcaatactttgcatccttcaatctaatcaagttgacattcaatattaaccatcatattcatcctgatcctgttctgttaaaattatcattatcccagtcttacaaatgaggatgctaagaccctgagagaccatgtgatcagcctgtcgtcactcagccagcaagtagtggaactaggctttaaagtcaggccatttttagtttcaaaagtctcactcttttcatctttccacaccatgtatggaaagaatactgagtgagacaggccccaatcagggctctcttaatttataaactgtgtgatctctggcaactcacccaaccctcccttatcttagcttccgtgattacagtaattgtgattgtgtgttccacaccactgcaggacgataaaatgcaacaaggtatgtggaaactttgaaaattccaacatgctgtacaaatccaagggataatcagaagattattattgagtcacagattgactttgttcgtcgagcagactcttggcaaatattaaggatatgcccagagcactcaaatctccaaattggaaacaaagcaatcatataattcctcttataaaatatagcagtgcgactgaaaatgtaagggcccctttacatctctaatgttttcacgaatgttggaggaaaatcattaataaagttgttaaaacaaatactttctggagtatttgttgaaatagctctgtgattcatctttgattaatgtatttacaggctacttgatggacttgttcatgtgctagctctgggattccactgaactccacattctagtcttcattcttttgaaaacatattctggcacagagccgtctatggtgggctgtgtaggtcaagaggtcagggttcaatccttgccttcttgcgagtttgccttgtgatgtcatgcaagttgtcttcctctccatgccttcttttcatttataccattgagtggatggattggacaagatgatacttgatacaataattccccagtgtagttgatattttgaatcatgtgtaggtgttgttaaaataaaaaaattctgaaataaggccacatacctgcaatcaactgatatttgacaaagttgacaaaaataaacaatagggaaaggacaccctatttaataaagggtactgggaaaattggctagccatacacataagaatacaactgaactcctatctctcatcataatcaaaaatcaactcaagatggatcacagacctaaacataatacttgcaactataaaaatccttaaaaaaaaaatctaggaaaagcttttctgaacatgggcctagtcaaataatttatgatgaagaccccaaaagcaaatgcaacaaaaccaaaaatagacaaatgtgactttatcaaactaaaaagcttctgcacagcaaaagaaaaaaatcaacaaacagacaacagaacgggagaaaatatttgcgaattatgcctccaacaaagaactaatagccagaatgtacaaggtactcaaacaactcaacaagaaaaaaaaataaagagctacattaaaagtgggcaaagggcccgagcacccgtaggtcggattctctggataaggcaccggaagtgaccgcctcgcggctgcttcctctcctggagtccagagtctcgctgttccgccgcgatattcagtaaaccactgggagtccggcagcatgaaggcagcgcgccctcccatgactgcagggaagttcatggtggtcggcggcggcatcgcgggcgtcacttgtgcggagcagttggctactcactttccatcagaagatattctcttggtaacagcttctcctgttatgaaagcagttacaaatttcaagcagatttctaaaatattggaagaatttgatgttgaagaacaatcaagtaccatgttagaaaaacgctttcccaacatcaaggttatagaatctggcgtaaagcaactgaagagtgaagaacactgcattgtaacagaagatggcaatcagcatgtatataagaaactctgtgtgctggagctaaaccaaagttgatatgtgaaggaaatccttatgtattaggaatccgtgatacagacagtgctcaggaatttcagaaacagcttactaaagctaaaagaataatgatcttagggaacggtggtatcgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcatataaaagaaccagatatacaactgaaggaaggaaaaaggaagctagaagcaaatctaaatcagataatgtaggcagtgcgttgggaccagattggcatgaaggcttgaatcttaaaggaacaaaagagttttctcataagattcaccttgaagctatgtgtgaagtaaagaaaatctaccttcaggatgagtttagaattttgaagaaaaagtccttcacttttccaagagaccatacgtcagttacaactaatacagagatgtggcctgtctatgtggaattgaccaatgaaaagatatatggctgcgatttcattgtcagtgctacaggagttacaccgaatatagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacaagaatacatcaaagtcgtcatgcaaaatggacgaatgatgggagctttcttaattggtgaaactgatttagaagaaacatttgaaaacctaatcttaaaccaaatgaatctttcatcatatggagaagatctgctagatccaaatattgatatagaagattattttgactaaaaatggaatttcttcaagaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaatacaacactgaccacttggataaaaatcttaagttatttatttctgtgttttaaacataaatatgtttacttgtgatttagctttggagcaaatttaggtaagttatctatttagccaaatgtactctagtagattagaaccattctttgtgaaatgtcaaaatatggctgtggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtcgaatgcagcccaggacagctttgaatgcagcccaacacaaatttgtaaactttcttaaaacttgagatttttcttgcaatttttttttaagcttatcagctatcgtcagtgttagcatgttttatgtgcggcccaagacaattcttcttccagtgtggctcagggaagccaaaagattggacatccctgatctacatatttaacttaaagtatcactcagtgagcctctgtcagtgtaatattgctttcaaaaagatagttatgtcaaaagaaaaaatatagctaagtatataaaggcataaaaaacttaagacaattatatggacttattctcaaatattttacattttttgtaaactttcttaaaacatgagatttttcttgcaattttttttttaagctcatcagctgtcatcagtgttagcatattttatgtgaggcccaagacaattcttcttccaatgtggctcagggaagccaaaagattggacatccctgatctacatatttaacttaaagtatcactcattgagcctctgtcagtataatattgctttcaaaaagatagttatgtcaaaagaaaaaatatagctaagtatataaaggcataaaaaacttaagacaattatatggacttattctcaaatattttacaattaaagggttttacataaaaatttttcccttgttttatactggaaaattatataatcgtgatctctaattttcaaacattctcaaaagtttagatcttcagagataagctctgaaaatatagatccatacatataaaatatctatgaaattcttttaaaaactattgtctaactacaaaaatagtggcatatacatgcataaaccatctttaattagaaaatttagtaacattcatgtcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaataacaaagcaagcaccttggtaaaaatccagctattcagttttctcatgagattaaatatttcaaaatattctttctgtatcagttggctttttaagtatacaggggtctagttttttatctacaaatttctattcaaatatgagctctattttgaataaaaggggctacattgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattaaaacagagtcctcccattccaagaaactggaaacccctagtttatgttaaaaggccagtctaaattctttcacttatatctttacagaaaactatattttctctcttccatacccagaaatctaatcagaaaactgacttttctcatgttcaactggacctaggggaatatgacagaaaagcatcccataggctttaatatactttttaaaatatataaaactgaaaattaatagccatttaccctgaaagagttctgtgtggactttgtcacttgcacagtaatagcatgtgcctcattgttcagaagattagctttaggtcctattttcaaataagaaatggtagcataagctgtaaaactgtagtcttctctgcagaaaatgccaacaataagaaagcttttgaaggaatcacggaaaacaaatttataaaagcaataactatatgcgcagtaatttttaatacattgacttgaaataataaaatttacaagaatgcaaataaagcctttaaagaaaaaaaaagtgggcaaaggacatgaacaaacatttctcaaaagaagaaatagaagcagccaacaaacacatgatataatgatcagtatccctaatctttggagaaatgcaaattaaaaccacactaagacatcatcatacaccagtcagaatggctattattaaaaagtcgaaaaacaatagatgtttgtgtggatgcagagaaaaggaacacactgttggtgggaatgtaaattagttcagcctctatggaagacggtatggaaatagctcaaaggactaaaaatagaaccactgtttgacccagcaatcccacttctgggtatcattatattaaaaatgacacctgcacttgaatgttcatcacagtacctcacaataggaaagtcatggaaccaacctaagtgtttaccaactgttgattttattttaaaaatgtggtatatgcatgccaagtaatactatatggccatgaaaaagaatgaaatcatatcctttgcagcaacatagatggacctggaggccattatcttaagtgaactaactcagaagcagaaaatcaaatatcacctgttctcacttataagtctgcactaaacagtgggtacacatggacataaagatggaaatagtagacagtgggtactccaaaagcagggaaggcaggagggctctgaggaatgaaaaattacctcttgggtacaatgttcaatatttgagtgatgggtacaccagaagcccaatcctcaacattattcaaaatacccatgtgacaaacatgtacatgttccccctgaatctacatttttttttcagaagaaaataagtgattgtttttatttttaggaaactaaacaaatatcattttcttctctctgatctcatagcacttgacaaacaacagggtgtagcagtccaaaccctggcactagaatctacattttttaaaaaaagtaacaattacaaataatatcttctgtatcctattccctattctccctcttcctagaatacattccaatgccttcaactattattttaatcacaaaattgttgatgacaaattgtgatattcaaatgtctttttttcattaatagaggtattactgtataacctgtgaaagaaatgctttactttgataagggaaaatgatgagtacaggagttaaaaaatattcttcttaaactctagactttttgagaccaaacctcttggaatttgtattacttattcaaattgttcagctggaggctattatcctaagtgaattaacacaagaacagaaaaccaaataccgtatgttctcacttataagtaggagctaaacgttgagtacacatggatgcaaagatgggaacaatagaaactgggtcctgcttgagggaggaggctgagaggagggtgagggtcgaaaaactacctgttgggtactatgctgtctacctgggtaataaaaccatttgtacaccaaaccacagcaacacacaatttacccatgtaacaaacctgcacatgtgctccttggacctaaaataaaagttgagaaaagaaaaataaataaacaataatagtggaaaaattcataattttacttctgtgtcatggtcaattaaaattttaatatttagcaaagcaaagaaaaaaattgttcgtatggtaatgtaaaaagataagtcttgaatttctacatgaatcctaaaatttgcaaaataaataaaactaagtttagcagctctctgtatttctttagccatagactaagcaactgttctattattcctttagaaaattccttttgtactcaaattttcttaattctgcttatgcaacagccaggattctcagtatgtaacagtgggttttgccaacttgggtcccagcctaaattctagttatttgttttaaatatttaatgcaagtcagccagaatgccaaaacactatccttattactaagcaatatattaaacaaacacccctgacttgttcctcacccttaatccacagaattgaaacgaggaatggaagaacaaataaattttaacgtaaaataataataatttaatgataacataaaataatacacaaacacataataataattggatgttagtcttttttaaggctttatcagaatattctgtgttaaattggctgggtcagaatggccaataagattttacacatccaaatggctctctattacactgaggaggtttcgttcattcctgtgtgacactgtgttagtgctttgtgcagaattgtttttgtaatatttccttgaaaaaagtgtagaattttctgtctttgcagaacattgaatggtggtgctatatatttattatagcttcttgaagtgtagttatatacaccagatatgtagaaatagaacccacatctcccatgggatgtgtgaatgacagtgtggtgacaaaagcaccccaggggttcaggctaactgttggttttaaagcaaggaaaacttttagttctgtgcctttaatgtgtatgatttactgattgtgtgtatgtgctgaaaaataaaatcattttcaccctgtgggaaaaaaggcagtttgtttgtgtaaggtattaaagactgcatataaatttaatattctccacatagcataaaatttaatgcttgttaagtaaaattgaataaagactctaaaagcaaaacataaacatttcatatttggaaaatttgcacaacagaatgccaaaatatttgttgatgttcttctttcaactataaagcatagacgtatttcctttaaatattatatgaatcctgctgtgatttaaaaagaaaagtggcatctaatcatggaacattaaattgacttggttatgtagtttatggcttatttatcaaaaaagaattcaaatccatttttagaatgaatttctgagatttaaagaatagaaatgaaactaaatgcaaacacacaagaaaataaaaaagcacagagataaattgtctaaaaggctatatttttggtatttttgtttatttaatgaataaacaatatgaattatacagtatctcatctcaacaaaggcaacatttcaatctattgaataaacagtagcataattagccttgagttaatatcccctcctcacacatacacttttctatggttcacttcagtaaaaaggcaaatcttttctgctttagttcctgcatatttagagtgcttaggctaggccaggtgcagtgggtcatgcctataatcccggcactttgggaggctgaggcgggtggatcatttgtgtcaggacttcaagaccagtctggccaacatgtttaaaccctgtctgtactaaaaatacaaaaattagccaggcatgatggcatgtacctgtagtttcagctactcaggaggctgaggcaggaaaatcatttgaacctgggagggagaggttgcagtgagccggtatcatgccactgcactccagcctgggtgatagagtgagactctgtctctaaataaataatattttttttaaaaagtgcttagcctagtactggctgctcactaatcaaggtagcgtgtgctgaaggttgcatggctgtgacaatttcttaaggaagaccatagtattggtaggttttagatattaagtaaatatttttaaaacaaataaatggttattataaatgcagacattaggatgatatttttttaaaaaataaatagccctatgggggaaagttggttttatttcaaagcaccttatttttttggaataattgtgtgttaagaatcaaaacacacatacacatcgaatgattaaacaaataagcaaggaaaacaaataagcaaggaaaacaaacttcttctacattatttttatttatttatgttttaactgaaagtttgtgttctttgatcaacatctcctcaatccttccatatcccagcctctggtaaccaccattttaatctctatgtctatgagtttgaattttatacttcaaatataggtgaggccatgcagtatttgggtacttgtctttctgtacttatttcactttacataatgttcttcatgttcaaacatggtgtctcaaaagacagtattttttttcttttgtaaggctgaatggtattctctggtgtatccaggcacacctcagagatactgtgggtttggttacaaccactccaataaaacaaatattacaagaaggcaaatcacacaatattttttgctttccagtgtatttacagttcttttcacactatactgtagtccattaagtttgcaatagcattatgtctgaaaaatgtatataccttaataaaaaaaaactttattgctaaaaatgctaatgattatctgagccttcatcaagtcataatcttttttgctggtggagggtcttaccttgatgtaaatggctactgactgatcagggtagtggttgctgaaggttgggtggctctaacaatttcttaaagtaagacagcaatgaagtttgctgcatcgattgactcgtcctatcacaaaacatttccttatagcttgcaatgctgtttgatagcattgtattcacagtagtattgctttcaaaatttgaatatgtcttctcaaactctgtgctgctttatcaactaattttaggtaatattctaaatcttttgttgtcatttcaacagtgttcactgagtcttcagcaggagtaggttgcttctcaagaaaccactttctttgcccatctgtaagaagtaacttctcattcatttaagttttatcatgagattgcagcaattcagccacatcttcaacatctaattctagtgctttttgccatttctactatatctgcagtgataccctcaactgaagtcttgaagctctccaagtcatcaccgagggttgaaataaacttcttccaaactgttaatgctgaagacagcttctttaaacctcatgaaccatcctctgctaccttcaagctttcttctgcagcttcctcacctccctcagccttcatagaattagagatctaaggccgcctttctctggattaggctttggctaaacagaatgtaatggctgatttgatcttccatgcatactactaaaactttctccgtatcagcaataatactgttttagtttcttatcatttgtgtgttcaccggagtagcattttttaaaatttccttcaagaacctttcattttcattcgcaacttggctcactgacttaagaggtgtagttttctgcttatctcagctttcgacatgcctttcttactaagcttaatcatttctagcatttgatataaagtgagagccctgcaacttttcttttcacttgaacacttagaggtcattgtagtgttattcattggtctaatttcaatattgttgttctcatgtgatagggagctctgaggagagggagaagaactgggaacagctcgttggtggggcactcagaacacacacgatgttgactgattaagttcactgtcttatacgggtgtggtttgtggtgccccaaaacaattaccatagtaacatcaaggatcactgatcacaggttaccataacacatataataatgaaagagcttgaaatattatgagaattgccaaaatatgacacagagacatgagatgagcatatgatgttggaaaaatatcaccagtagatttgttcaacagaaggttgtcacaaactttcaatttgtaaaacaatgcaatatctgcaaagggcaataaagtgaagcacaataaaatgaggtatgcttgtatataccacaatccataccacaattatccattcatctgttgatggacacttaggtttattccgtattttggctatagtgtttaatgctgcagtgaacatggggtgcagattactgtcatttgatttcattttttaaatatatactcagtagtgagattgctggatcatatagtaattctatttttactttcttgaagaatgttgatactgtttgtcatcatggctgtactaatttccactcccaccaacagtgtacaggggttctcttttctccacattttgctggtactcattatttttcatcattttaatagccattctaacaggtatcaggtgatatctcattgtagttttaatttgtatttatctgatgattagtgatgttggacatttttttcatatttctcttggctatttgtatgtcttcttttgagaaatgtctgtattcaggccttttgcccatttaatttggttgttttcttcttagtcagttgagttctttatatattttggatactaaaacccttgtaagatatatggtttgcaaatattttcccctattctgtatgtcgtttcttcacactgttgatgtttcctttgctgtgctgaagctttttaatttgatagaatctcattgatctattctcatttttattgtctgtgcttttggggtcatgtccaaaaaattgctgttcagagcaatgtcaaggagcttttcctctatgttttcttttagtagttagtttctagtcttaaataggaactattggaactaaagttataggagctatttttgctggaggtcctagtgcaaatactccaagcttaaaggataaactttgcataatggtaaatcttgggggcaagatgacatctatcaatatgttttaaggaaaattcatattgtgattgtttaatttgggccagatataactgtcatttcatatgcttcatcatatcccagctagaagatgaatgttagaggacaaatgaattatttcgtcattaacttagctgatgtaatctttaggaaggggtggaactgcaccacatttaaatgttccttccccttttattttctggaagacactgacaaaatggtgttaattctttttcaaatagttgttagaattttccagcaaaactatttggcctgaagatttttttttcaaaaaactttaaattatacatttcatgtttttaatggttataaaatgattcagattatcagtttcatcttggttgagttttggtagtttgggtttttttcaagggattggttcatttaaactgtcaaattttttaatgtaaagctgtttgtgatatccccttattattcttgtaatgtctatattatctatagtgataacccctatcttgttccttatgttgatttttgtttacttagctgtcattttcatcagtgttgctagactttactgattttattgatgttttttcaaagaaaccatttttttttgctcattttctttattgttttcctgtttgtaatttcattgattacctctcttatggtttttgtttcctcccttctgcttgctttgggtttattttgctcttatatttttcttttctgaggtagacacttagattattgattcgtgatttgttctcgccttgattataagcactctcttcactgctttggctgcatgctacttattttaatatgctgtatttccattttgatttcattttatgcaatttaatttctgttaacaattcctcttttaaaatgaattgtgtagaaaagtgttgtttcattttcacattgttagggatttttctgttgtctttcagttattgacttctagtattatttcacctagttaacatactctgtacaatttcaacttttgaaatttattctggtgtttttttatggcctaggatttggtcggtatatgttccatgatctccttgggttttttttttttttttttttttaaagaaagagtattctgctgttgttggattgtcaaattattttagatattaattagatcgtatttgtagattttgttgtttttgtagattttgttgttaaggtatcagttttctgtggctactgtaacaaattaccacaaacttggtagcttaaaacaacataaatttattctttcatagtcctgcatgccagaagtcaaagtgtcaaaaggaccatgctatctccagaggctctggggtagaatccatttcttgcttcttctagctttttgtggctgctggcaggtcttgaggtttcttggcttgaggtcacatcactctaatctatgtctctttcttcacgtcaccttctcctttgtgtgtggtgtgtgtgtgcgtgtgtttgtgtgtctgtgtgcatgtgtggtctccctctgccttcctcttgtgaggccactcatgacgatcaaagtatcagaatgtataatattatcatatttgtctcagtcatcgcatatgatttagacaactcatgaggagaagataatctatgtatttacccatacttctagtccttctgttccttttcttccttcctggtgctcaaagatttttttctcttatctttttctttctgtttaaagacctttctttagccattcttttttattattattattatactttaagttttagggtacatatgcaccctaaaatgtatcttggagtgaattcctttgagtttatccttatttagaatccatatagttgaatttgtgggtttatgtctttcaccaaatttaagacattttcatctatagtttattcaaatactatttcaacctcactctcccctatacttttggaactcttaggatatgaatgtggatttcttttttattgtcctaaagatccctaaaactttttttcagcctattttctctgttgttcagattgagtaaattctattaagctgtcctcaattcactgattctatcctctgtcatctccattctaattttgagcccacccagcatgttttctatttttgttgctgtatttttcagttgtataatttacattggttatttttatatttctattgctttactgagattttgtgttttaaaattcatttaaaaagaatttataattgctcgttgaaatattttcttatgccctctttaaaattcttgacagataattccaacatctgattcattttagtgttggcgtcaatcgattgtcttttctcattcaagttgtgattttcttggttcttattatgattcttatgatggttgactttctattatatttttgataatttgggtattgtgtttgttaggagactctagattctatttaaaatttttattttaacagtcaattcctctatttaggtttggcatgtaggtcctggcctacttttgtgggttttagttgcaatgactgtgtaattttcagaggttatgtggtgctattttcatcttggtttatttcatgcctcatggctcccactgtccttggtaatgctgcttgagggtgcagagcaagcttctccaggtcagatatccttatgtctctatatggaggggatttttcagcccatgtggatgaagagtaattcctagctgggcatttgttgtgcaaaattactcttgctggtgactctagccatacaatttcttgagtagtgagttatggtgggtgtgagagggagaatatcaggacattaagaacatggaagcttctcagactgggcactgtctcctgcttttttagctagagctagttctttgaaagcaaatgttgctctgtgagagcagtggcccttctggaagcccctttaattattgaagcacccgggacatatcattctgtttgtgctttcataaattacattgcagggatctgaaagaccagaaaccaaatctagaagtgcccattttttgttactgaactgaattctaaagaatagtcatgcaaatctatatcagcagctacatctatatctgtagcaacaacttctctcttttcaactgcccattgtgaacatctctttaaggttgttttgccatcacattgatttatatttaaaattgtaattgcttcgcttctctctccttcaccttcaggcttctacagtggttaagagtgtttcctttggagtcagtccagtttgggtttgagtgttgaccttactgcttattagcttgtattctttacaaatctcttaacctccctaaatcttaaaactgaggatagtaatagctagcaaaagagtaaaattcagtaacaaagtataaattaagtattaattaagtactcagcacagtacatgggcaatagcaagtactcacagatgtgttgagttagctacaggcatcatcctcctcaacatcattatcatcttttccagtttatagataaggaaaccgaggctttgaaaggatagggaactgaacgtaggtcagttttcccacttaattttcaggagagttgaaattcaaattcagacctgacttcttccaaatccttcttttcaaactattatgtaacactgcatcaaatgattttcttataaaacctgaagctccatgagagcatggattaggccatgctcaagataggcaaaaatataaaacatgtaatgtgcagttatatgacctggacttactcaattctgattacttattgataacagtggtgaatattttcatagaactatctgagcattaacatgcaacaaacccccatgagatgaatttacctatataacaaacctgcacatgtaccccccaacccagcataaaagtaaaatgaaaaaagaaataatgaagatagtttaacagaacctgacaaccaaggtttgtgatagtatgatatttaaccctttactatagctcagagcaaaatactcccctttgttatgcttgccaatttctgaaatctgacaaatgttatgacaatttatttttcttatgtcttctgtgctatctcattgaaacttcaatatgatgtaagatgcaataaaaccttagatagatgtttatattttaagcaattttccacaattcttttatatacaaatatgtagttcttataatagttttgcttattgctaagttaataaatgcaaataatgatgaatttctgaagttataattatgagaaacataattcaagaaggataatttatattattttccaattaaagtaaaaatgcattggtgacagagatacaaatggtgccattgaatctgcccatttattaaataaaaagttcactgatagaaaatattgaaaaggaagttatttactttatttctttgggcttatcgtctatgaattgtttttctgtagtgtaggcaatcaacaacattttcttccttcagggtctgtttatgtagagatttcagaaaacaaactaatggccacatataagtcaaggacatatttgctattttacatttttgagacaggaatgtgaactattcaatttagactttttataaattaatatttaaaatgcattacatataggaaataatatatattaatttatgcatacatacatacactaattccacatttaaaattaagatggagatgataaaggcaaaagagaataaggtctagttgtgatggtaaatgttaaagttgatacctaggaagaaaagagaaagaaaaagaaaacaggaaccaatggaaaaaaatgagagtagagtccaagcgatgaagaagagagaccagcagaaggagagacaaacaccaaataaagagaggagggtgaaaaaagtgtaactccacgaagcaagggagaagaaagaagaaatcaagatggagaagaaaaaagaagtaattggaaagaaatgtgaagagagagagagagactacatagaagtttaaatatatgagtatcagatgttatcattgccatttaaaaatatgattaactctattaagcttatcaaggtttttgcgcttatgtcaatcttaaaaaaatttatataataatttttaaactatgggattgtacattatgtgtttcttccttaccatgcccttaagatcctaataacaagaaagtatgtattattagcaacactcctaccctaaagagcatatgaaacatatacaaacaatctgtaaatattttacaggacaattattttctttttactcaaaccataacctgtagtattttgagagcctattttaggtagtgaatttagaatgtcttcctcctcctattctctggccgatatagatttggttctccaccatactgtgatacgtttgaaaaggggaactgtattttatctttctatccttatcatccagagcagagcattactagtaaatagaaaataatcaatattttagtgaataaataagagtaatataaataaaaggatgaaatactgaactttagcagaaattttacataaggtaaagtgagcatttaattccataaaaattataacatcaagcaagattccattttattttcttatataaacaagatcttggtgaatggtacaagggagaaaagtaaaaatattaatgacttaaaaatccagatcccaatagtttattccatatttgttcagtgccaccagtttttatcaactagcttaactatttagctataaagaaaacaggaaaatacatgtattgagcacattccatgtagtagtggaacatagatgaaactgatgcacagtcccaactggtcaacttttagcctattctttctaagtaattgcaactggctttttctccaggtgtgcttagtttaaccttagtccaatccaaatagttatagttgtagccataccccagctccaccttccttttctactggtgttcattgttcatgccctctgaaggtgttcattaggctactgggcataagcttgtgttcactaagtttcccattaaatctcagttccctaaattctccagtgaaagggcatagaaaagaggaatagatttaaattactttaccctcagattctttatcatatgacccaaattcctttagtattataattattattttttcatttatttttagcttatatgaacatgctagttgagtgatattttctgataatgctagcttaatatctggtttatatttttatttttaagaataagagaactgtccactaacctaacaagtgcaatgactagtacattttaaaagtactataatagttgaaaaatgatttacataaggccaattactttgattcattttaacctcctggatttattttctgaaaggggtattattttaatgacagttaaatatagttattttgacagatggatttaccatattttcattattatttagtaggctgaaagcttttgaattggctcataaaccagtttcatgatgtaccttggagtatcatcttgaataaaaaatgttttcctgtttcatttttcactgatctcactttccatttcattattgtctttagaaagtagctgagtgagatataaaacaattgtttctcttcagaaccatgaattttaaactggctgaaaatcagatttaaatttgcttatatgaatgcagtaactcagtattgctaataaaacattttttctttctattcatcagataatatattaaattttgtgaacctactatgtgaagagtactgatcaaaattccatgttaatttcacaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtaagggagtttagttacttacatataaatgttttttaatagtaaattgtcatgtgaattaaattgatttttttacttaaacttgatactaaataattgacaactctttaatttagaaattttatagataatacaggtatttcttctttatgagtaaactttcaatatgagttcgtttgtgttgacatagataactgtgaagaatcatgatattgctcagtaaggaaaaattctatatagctactcctctaagtttatttttattaaaaaattaaacttgttgaattctaggtaactttttaccacataattattcttgcttagaaaatggggttccaatataaactaagaattttattttgacagttaaaaacaaatagcaagttatattaaaatatgcattgtattgtcaaatatggctaatcagtattttgcactgcattattaagtgagatctctttaattctaaaaaaacctatatataaatactctagctattgctcaaatgactaatgagtttttgaggaagtaccttaattttccaagctacataatggaaaaatttccaaaattggtgccaaccaccatggttggtttgatttggtgaactccttattaatttcttactaagatcatagcaatattttgagtcatttagctccatatctacctaatcaataactctacaactttacctagaatcttacgtagattgcacaatgtcagggcatagggctttttttatatgaagggaatcaagtacttttagtataaatagttgtgagctgcaggttttattttcttctttactaatacatattgaccagctacttatttttacagtatgatcttcacataagcagatttggaaagaacttgtctgattcactttgtaaattttatattatcatccagaaggtgtttttatgaaggtgtgtcttcttggggaaatgagctctttagtttcattatgtagactatgtagccaatgttaaatattttaattgaatctcttctgagtggtaaacattcagtatgaagtatgtataagggattttccttgttacagaaaattaagttcttataaattatctttaactcccttataatttattggtatataatttacagcagtggtagccaaatgtctgattctaaaccggagagatactataatgttaaactgtcacttccaggacagaggagatcagctgaatttggcatcactttccttcctccatacttggggcactattacaccaatctctgccacaaccaatcttttccctctaaactactgatttgcagtgtttgcttcctccagttaaagcagtcatgttttttttgttttgttttgttttgttttagccctaagttcatacaactaaatgagaatgataatagataaataaattattctctggaaaaaacatgggaatccctgacaaacataagtatcagttagattttgagaaaagaagaaatgtgatgcttctgagtatgccaaaacaggttcaaggttttaaaatatgatttgatttcttagacatcaagcattcattcccttgtgagttaggacatctcacagaaaaacagtagaaatactccgtatgatcttcaaattttcctatatattattaaaccgtggacagtttcatatagtcatgaataataatcaacaagttttaacttacaaaatgtttatataaatatatatatatacacacacacatataataattctagttcacaacttttcttaaactaaacttgtttaggaaattttgcaattaattacaactaaagattccaggccttggtgttcttaacatatcttcaatgctagtgtattaatcagggttctctagagggatgggactaataggatagatgtatatatgaaagggagtttattaaggagtattgactcacacagtcacaaggtggaatcccaccataggctatctgcaagttgaggagcaaggaagccagtccgagttccaaaacctcaaaaagtagggaagccaacagtgcagccttcagtctgtggccgaaggcttgagaaccctgagcaaaccactagtgtaggtccaagagtccaaaagctaaagaacttggagtccaatgtttgagggcaggaagcatccagcacaaaagaaagatgaaggccaaaagactcaggccagtctagtccttctacattcctctgcctgcttttatcctagtcacgctggcagctgattagatggtacccacctggattgaaggtgggtctgcctctcccagtccattgactcaaatgttaatctcctttggcaacaccctcatagacacacctaggaacaatattttttatccttcaatccaatgacgtttacactcaatattaactatcacagctagtaagtacatgtatctaggataggtgtatagggcagctttggctgcttattcaggattagggaggttgagtttgggagatccagactggaaatacaatatatgctaaatccatagcagtaatggtttggccagagagggaaagacaaaatgatattagtcctgtataggataaaaaaagtacattaggagaaatgcattaggagggatataaattagaaaacttctatttgaccagcctgatttgtaatcttcataaacattctagtgtattttctagaaaatacacacagtgctattttaaaccatgaactatttgccagatttttaatggctattgaaacaaagaatcccagaggtggtagaattttttgtaaggaccacaagtcttattttatgaaatgaaaagagttttgctagattgaaagtatgtatagaatttgggtaattatgtagaataaccataccacagagaaaaataaggtacagcccaccttttatgttagaaatgtgaaaggaagccaggtaaaactaaatgccaagagaaaagaactagatggagtggcccacatggggctttcatagtgtgctacgacatgagatactagtctctaaatttgtggttgcccctctcttcttcatgtcattactccatgttttcctatcatcaggcagatgatagagtgaagaattataatttcagtggtagaattcagataaattaagacataatatgaccattctgctaaaataatcaagctatctataaactagagggttgaggaagaagctgtggattttgctgtgcatatatcaagcactgagaaaatgaaagcctttccaatgcttaactgccaagatgttacaggtgtatgaatactaagtaagagctaggcaaattgaagaaagcctgggttataattttgtttctcttgtaattagaaaggcaaattttcagtaaaagtcaacataaacaacatacgtaatattttgcttctcagattgttctcacatgaacataaagaaccagtatctaattttgtaaatcaatggcatataaatagtaacaataataatggcattgactattgaagcaaattcatgtacattttgctttgttttacatttgtctttgggaaagcctttgattttagataagcagggagaaagactttgcctttctctgattccattctgccatggttgcagtgttccagtgctattttaaatacaatctttagcatccccatcttttcacctttaagcactttaacttgacttttctccagttctataccccataaaataaagatattcagtgcatcagtctcacagttacatcataagcatttcagtgagctttcctataaagagttgagaataccatctggtacatagtagtaaatgtaaatattagctgccattagaacttctcagacaggtgtatctatctagacatacagggatgtgtgttatgtgattatgtttgtgtgtgtgtatgtgtgtgtgtgtatatatacacacatacctagtaggcccagagctttttagaaaagaataaaatatgatctcatataatccctccttgaataacatgtggcattatgtacattttcggataagaaaactgagttttggaaaggttaaatccagataatgtagctcacaagtcagaatttgaactgagacttgtctgattctaaagcctatagtttttgtacaatttaggctgtgatctagacaaagatcaaatgatagaaacaaagagtggaaactgtttaaaaatgacatgacagtataactacagttattgattctgtaaagtaggagattctcccgtctgccatcttttctctttgttagaaaccagccagcacctctgtcttcattcctcctatggaaagtggcataccaaaagaggcattgtgggagcagtggtcccaggtgcaggcaataagaggtatattttttaaacagtgaagtggaataaaagttgatctggttttaaaaatcatcttacccaggtaactctaaaaatgttagtgatggccaggcacggtggctcacgcctgtaatcccagcactttgggaggccgaggtgggtggatcacctgaggtcaggagttcgagaccagcctggccaacctggtgaaacgctgtctctactaaaaatacaaaaattagccaggcatggtggtgggtgcctgtaatccaaactagtcaggaggctgaggcaggagaattgcttgaacccaggtggtagaggttgcagtgagctgagatcacgccactgcattccagcctgggcaacagagtgagactacgtctcaaaaaaaaaaaaaaatgttagtgataaaatagttttctctgtcagagtaaaggtagagggggagtattcccatcacagcctctaagtgtggtttgcaaatgtccatggcattaaacattgtcaggtttagattgggaagaaggaacagtaagacaagatagggcaaccaggtaataccaggacccaaattctattacattagggaacctgatgttaaaaatctgaaaaacaacaacacaaagttcatattggcaaggaaatgtaagtattataagcctagctggaaaagcagagttcaggccaattagcaaagtaggaaatccaggctcactcacagggaatatgagtgggcccaaggggactagatgataggaactggaaaccaggcaacatgtctagatagaaagtataaatatgggtatcagtacaaactttgataaagaagcagagtcttttccctggacagaattaagcttagaatcagagggtgcacaggacaagtctacagtgtcaaaggggaactgaatatggcaacctcatcaaacatctgaaaacagatgtttctgacatagagttttagggctacacagctttatgcctcaagaattttgatttgtcttgccacttgataggaagctactaaagccctctcttcttcgctggaccttcagccagcctctagaaaatgcagtagattctcaaggatatcacttcagcatgaaatagatttcacagaaaaatgaaatgcttcacttccaccttgttttgttgcctttcaaagtacttaggtacttaggttattgttggaattttataaatatgtatatgccattttacgtcatttgcagcatgaaatgccagttccatttagtaaagagtaactgcttcatttttccccaagatttacatattttctcttttaatgatcagtgcacacactttttaaattgagcactgtttcagatttatgttagttctcttcagtagtctccatcaacatcaacatcatttgcttttactgatattttgttggaaacaaagcaacaatgttttctaattaggaaataagaatttcttaagtcaaaaatttattcaactcattcattcactcaataaacatttacaactcatttgataaggagccatgacttccatagaacctttaaaatgttatggaaattagcatgtatttttagaacaattttaatgaatagaaaagaactcatttatatgctgtaggaagtaaggtgaaagtcacagataagcattctgttccaatagcttttctatggcaggagttatattgtcagtttcaaaataccataatgctgtaaaaattacctgaagagggtttaacctcatttatacgtttgcctttggcgagcactttggttggagataaggaagaggcaagggtaagatatgtttctttcaatccattcagacaaggctgtggaatcccagtgctatcttgagtgcactagttggatttctcatcattccacctttcatgggttatttaatctctctgcctcattttatcatctgtaaataagagactaattttatcactttatagttttattttgtgagcttttaaatgagatttatgtaaagtgcttaaaacagtgtctccttcatggtagtaaatgtacatattagctattattactttccaaacaggtatatctggtcctatatgggaagcgcgtgtgtctgtgtgagtgtgtgtgttgtatatctgcaggcatttttatgtacataaacattgtgtatccaacgcttactagaaatagataaaatgcttatttatttggatttattcttttaggttattagaattgcattgtatgccaaagactgtgaaggaaggatagagaaataaaaggagggagggagataaatagctttccgaaatgcattatttgtgtcatcttcatggggcctcaaagattcttaaagatgcttccatctgcatactctgaattacaatatggaatttataaagatgacaatatttctgaaagccagaatgactcgtgggatgtctgtgaccaatactatgaaactgaaccccaaatgtctatttttatattctaatacggcagcctgaattatttttcttctatattcagagaacatttcttttagtgttgtggcatattctgaagacagttagaaggctaaaatacttttagttgctaagcagaagttaatattaatgatgtgtcttgctgaatttttcaaagtgttttgaggtttttgtccctatcgatatttaatttctgaagagtggtggcaactgcaaacagattggtgtttttgatttttacaaacagtatgaactgaatatttatgaccccccaaaattcatagttgaagccctacttaatgtgatattatttagaggtagagtattttggagttaatcaagtttagatgaggtcttgaaggtggggacttcaatgatggaattagcatcattataagaagaagtgacttgagcttgctttctttcctctttgaggacacactaagatggcagccacttgtaagctaggaagagagccctcacctgggaagtgaattggctggcatcttgatcttggactttccagcctccataactatgaggaataaattcctgttgtttaagccacccagtctatggtgttttggtatagcagcctgagcagactgaaatcccaagagaaggtatatcacttctacagaaagtgtggaaatttcttcatgatacaagtctctagtaagttctcttagtagattagtccatattgctaggatttcctgtatctaataagaataaatgctaccgtcccattgatgcaaatgaaagattttcattagccttatagagttaattgtgttattgcacagtatctctcttttgtgtatcaataaactgtaaagaatttaagctgtaagctcaaactgctcatttatctttgccactaccacttcagcagaacagtatgaacaacttgcctttagtttatacatagggtgagtttactaaaatggaaattcattttctaggcaggaccgctatctctcactcacctgataggatagccttaatgcaatctgcaaatctcactgaactgaggtgtttctattacctttttaaaacaaacaaacctttaattaatgcttttatgtagtagaaatgctgtaaatacttctgccactatttatcacttaataacagtgatttaaaaagtgaaaatttctgaaagcaaaatgaaactaacagaattcacatttacttgtattctcagtattaagtgcttaaactgtgatatttcacttattttccagaacaatcctgtggaataggtgttatgatgtcccttctgtgtttttaaatttttatttcaatttttgtgggtacatagtaggagtatgtatttatggagtacgtgagatgttttgatacaggcatgcaatgtgtgataatcacatcatggaaaatggggtatccattccctcaagtatttactttttgtgttacaaacaatccagttagacccttttaaaatgtacaattaaattattattaagtatgatggctctgttgtgctatcaaataataagtgtcccttttgaagatgagtttagtaagttgcagatgctacttgaatttagttctgatttagttaaaagctcaaattttagaaagcaatggtttaaatcattcatgtgtcagatagctagtgtttccaattacctagatggagaatcaggacaaaaaaattgttctggcacttacatactataggttagtgcaaaagtaattgtgggttttgcccttaattttaatacataaaatgagatattcatttatcaattggtacggtctctccaacaactttgacaaattaccagagttcatctttttaaaatgaaaacaatagtatgtcacaggactgttatgaggctgaaaagaactatgagccaaaggtccttgttacaaacatgaggccctcaatgtagtaattagaagatgaacatgaatttgtaaattgcaatttgaattctaccctagaggtaaaaatataactaggtttccttttttaaggtattcaacaaatgtgcactatttttgaatatgtgttggatatcataaatacttattctctttggctcccggaggttaaagaggatctttgtacaaaagttaaaagaatagtttcagcacagtagaagatccttaagaaaaaccgtgtttctaacagtgaaatagactggcagaagcatatgctctgatcacaggagtgatatgccacaaccttttggtggagcaggtaggaacaactttcagtaggtcccctgattctatgagattcttttttttttttatactttaagttctagggtacatgtgcataacgtgcaggtttgttacatatgtatatacatgccatgttggtgtgctgcacccattaactcgtcattttcattaggtatatctcctaatgctatccctcccccttccccctaccccacgacaggccctggtgtgtgatgttccccttcctgtgtccaagtattctcattgttcaattcccacatatgagtgagaacatgcggtgtttggttttttgtccttgcgatagtttgctgagaatgatggtttccagcttcatccatgtccctacaaaggacatgaactcatccttttttatggctgcatagtattccatggtgtatatctgtcacattttcttaatccagtctatcattgatggacatttgggttggttccaagtctttgctattgtgaatagtgccgcaatgaacatatgtgtgcatgtgtctttatagcagcatgatttataatcctttgggcatatacccagtaatgggatggctgggtcaaatggtatttctagttctagatccttgaggaatcgccacactgtcttccacgatggttgaactagtttacagtcccaccaacagtgtaaaagtgttcctatttctccacatcctctccagcacctgttgtttcctgactgtttaatgatcgccattctaactggtatgagatggtatctcattgtggttttgatttgcatttctctgatggccagtgatgataagcattttttcatgtgtctgttggctgcataaatgtcttcttttgagaagtgtctgttcatatccttcgcccacttgttgatggggtggttcttttcttgtaaatttgtttgagttctttgtagattctggatattagccctttgtcagatgagtaaattgcaaaaattttctcccattttgtaggttgcctgttcactctgatggtggtttcttttgctgtgcagaagctctttagtttaattagatcccatttgtcaattttggcttttattgccatagcttttggtgttttagacatgaagtccttgcccatgcctatgtcctgaatggtattgcctaggttttcttctagggtttttatggttttaggtctaacatttaagtctttaatccatcttgaattaatttctgtataaggtgtaaggaagggatctagtttcagcttcctacatatggctagccagttttcccagcaccatttattaaacagggaatcctttccccatttcttgtttttgtcaggtttgtcaaagatcagatagttgtagatgtgtggtattatttctgagaactctgttctgtaccattggtctacatctctgttttggtaccagtaccatgctgttttggttactgtcaccttgtaatatagtttgaagtcaggtagtgtgatgcatccagctttgttcttttgggttgtcttggctatgagggctctcttttggttccatatgaactttaaagtagttttttccaattctgtgaagaaagtcattggtagcttgatggggatggcattgaatctagaaattacctcgggcagtatggccattttcatgacattgattcgtcctacccatgagcatggaatgttcttccatttgtttgtgtcctcttttatttcattgagcagtggtttgtagttctccttcaagaggtccttcatatcccttgtaagttggattcctaggtattttattctctttgaagcagttgtgaatggagctctctgtttttctgttattggtgtataagaatgcttgtgatttttgcacattgattttgtatcctgagactttgctgaagttgcttatcagcttaaggagatttggggctgagacaatggggttttctaaatatacaatcatgtcatctgcaaacagacaatttgacttcctctcttcctaattgaataccctttatttctctctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttggttttgtttatatgctggattacatttattgatttgcatatgttgagccagccttgcatcccagggatgaagcccacttgatcatggtggataagctttttgatgtgctgctggatttggtttgccagtattttattgaggatttttgcattgatgttcatcaaggatattggtctaaaattctctttttttgttgtgtttttgccagcctttggtatcaggatgatgctggcctcataaaatgagttagggaggattccctctttttcttttgattggaatagtttcagaaggaatggtaccagctcctccttgtacctctggtagaattcggctgtgaatccgtctggtcctggactttttttggttggtaggctattaatgattgcctcaatttcagaccctgttatgggtctattcagggattcaacttcttcctggtttagtcttgggagggtgtatgtgtccaggaatttatccatttcttctagattttctagtttatttgcgtagaggtgtttatagtattctctgatggtaatttgtatttctgtgggattggtggtgatatcccctttatcattattgcgtctatttgattcttctttcttttcttcttttttagtcttgctgtgtggtctatcaattttgttaatcttttcaaaaaaccagctcctggattcattgattttttgaagggtcttttgtgtctctatctccttcagttctgctctgattttagttatttcttgccttctgctagcttttgaatgtgtttgctcttgcttctctagttcttttcattgtgatgtagggtgtcaattttagatctttcctgctttctcttgtgggcatttagtgctataaatttccctccacatactgctttgaatgtgtcccagagatgctggtttgttgtgtctttgttctcactggtttcaaagaacatctttatttttgccttcatttcattatgtacccagtagtcattcaggagcaggttgttcagtttccatgtagttgagtggttttgagtgagtttcttaatcctgagttctagtttgattacactgtggtctgagagacagtttgttataatttctgttgaggagtgctttacttccaactatgtggttagttttggaataactgcgatgtggtgctgagaagaatgtatattttgttgatttggggtgtagagttctgtagatgtctattaggtccacttggtgcagagttgagttcaattcctggatatcctttttaactttctgtctcgttgatctgtctaatgttgatcagagcgcctctccccctccaaaggaacgcagctcctctccagcaaggaacaaagctggacagagaatgactttgatgagttgagagaagaaggcttcagacgatcaaacttctccgagctaaaggaggaagttcgaacacatcgcaaagaagttaaaaccttgaaaaaagattagacgaatggctaactagaataaccattgtagagaagtccttaaatgacccgatggagcagaaaaccatggcacgagaactatgtgatgaacacataagcttcagtagccaatttgatcaactggaagaaagggtatcagtgattgaagatcaaatgaatgaaatgaagcgagaagagaagtttagagaaaaaagagtaaaaagaaatgaacaaagcctccaagaaatatgggactatgtgaaaagaccaaatctacgtctgattggtgtgcctgaaagtgacaggaagaatggaaccacgttggaaaagactctgcaggttattatccaggagaacttccccaacctagcaaggcaggccaacattcaaattcaggaaatacagagagcaccacaaagatactccttgagaagagcaactccaaaacacataattgtcagattcaccaaagttgaaatgaaggaaaaaatgttaagggcagccagagataaaggtcgggttacccacaaagggaagcccatcagactaacagctgatctctcagcagaaactctataagccagaagagagtgggggccgatattcaacattcttaaagaaaagaattttcaacccagaatttcatatccagccaaactaagcttcataactgaaggagaaataaaatcctttacagacaagcaaatgctgagacatcctgaaggaagcactaaacatggaaaggaacagctgttaccagccactgcaaaaacatgccaaattgtaaagaccatcgatgctaggaagaaactgcagcaactaacgagcaaaataaccagctaaattcataatgacaggatcaaattcacacataacaatattaaccttaaatgtaaatgggctaaatgctccaataaaagacacagactggcaaattggataaagagtcaagacccatcagtgtgctgtattcaggagacccatctcatgtgcagagacacacataggctcaaaataaagggatggaggaagagctaccaagcaaatggaaaacaaaaaaggcaggagttgcaatcctagtctctgataaaacagactttaaaccaacaaagatcaaaagagacaaagaaggccattacgtaatggtaaagggatcaattcaacaagaagagctaactatcctaaatatatatgcacccaatacaggagcacccagattcataaagcaagtccttacagacctacaaagagacttagactcccacacaataatagtgggagattttaacaccccactgtcaacattagattctatgagattctaatattctaaattcttagtgttggagctatatgtagtttgctaggaaaatgttttcaaactgcaaatcaatgctgctgcctccctattaataagttttaaatgatttgtgtttatttttgcaaacatcttttaaagtggaaagatgagaatttaactctgtcatcttaaatttgggttaaaatggatataaataagttttgatgcatttttcaagctttgaaatgggtaacatgactttcaagttggaaaaagataaatcagttgaaacaaaatcgctgtgagactgctgatttagctgtgagtatgtgttgggatggagggcatgcacatgcataggtgcacatgtgttggagtctatgaaagctgtctattaagataatgctgttcttaagattgtccaaagcatttttaatgttatattttcctgtgatagtcagagtttaatattggatagctttttatgctgtcatcaaagggcaacttcgtgcttctctctttttcccttaccaaattccataattagtgtcatcgcctcatatccagtcgggcatatttcagccctctgcttaatataaggtcctttgacgatcagagagagcccagatgaggactgttgtagttgcctatgacagtgcaatggtagctaaatgtaggggaaagggtattgaagataaagtctgaaaacctgattttaattatatctttgtcacataactgagtaagtcacgtaacttatctgtgttcagcttctgcatctataaaatgggagcagtattataggtctcacatatttgttgcagttgacacaaaaaacttgttcagcaaatgattgtttggaatttgtctattcataattcaaaataacgatatatatgtggaaaattgttgtaaattaatcaacagtatcagcaattgactccatctggagttattcatatgaaagaagaccaagatcagagagaatgtctttaggaatttgctatgaaagaagggacagggactgatattagttgaatgcctaatatgtgctaggtaccatgctaaattttttatatgtttattcattactttcattttcaataaataattatcagtcacatactgtgtttaagtgctaatctaggcattgggtaataacactattgagatatttattttattagatttggattttatttattggattttatgtgtttatccagcttttttgggttatattaataattaaataaaaatagtataaatttaaggttgacaatgtgacaatttgatatatgcatagattgtataatgattattacaatcaaattaatacatagttgatctattatcagacataattacctttgtgtttctgtgtgtgtgtgtgtgtgtgtagtgaggacatttaatatctactctcagcagatttcaagtataaaatacagtattagttactatggtcagcatgctatatggtagatccccagaatgtagtctttataactgaaaatttctgccatttgactaacatcttcccatttcttccaccctcaccccttggcaaacaccattctactctctgttcatatgagaaactcagagagttatttggattccacataagtgagatcatatagtatttatctttctgtgtctggcttatttcacttagcttaatgtcctccagattcatccacaaatggcaggattttgttctttattatggctgaatatttctttacatacatctgtgtgtgtgtgtatcacattttcttcatttatctgttgatagacacaggttgatgttacatcttggctattttgaataatgctgcaatgaacatggaagtgcagatatctcttcaaaatcctgatttcatttcctttggatatgtatccagaagtggagttgctgaaaattataattttacttttaattttttaggaacctccattgtgttttccataatagctgacccaatttacatcctcaaaaactgtgtacaaatgttcccttttctccatacactaactggcatttgttatctcagacttttgataatcatcattctaacaggtgtgaggtgatatctcgttgtggctttaatttgtacttcccttatgattactaattttgagctgtttcatatacctcttggccatttttaggtattctcttgaaaactgtttattcaggtcctttgttcatttttaaattgggctgtttgttgtttttgctattgagttgtatgagttctttgaatattttggatattagcccctcatcagacctgtgatttgcaaatattttctccccttctgtaggttgcctttttcattatgttgattgctttttttttgctatgcagaatatttttagtctgatgtaatcccacttgctaatttttgcttttgttgactgtgttgttgttgtatccaaaaaactcattgctaaggccagtgtcacagagctttgtccttatgtttttagctaaaagttttacagttttgggactcacatttgtgtctttattccattttgagttgatttttctgtatgtcataagagaaggatctaatttcatttccccaaccctatctagctgcccaaccaatttattgaagagaagattcttcctccattgtgttttcttggtgcccttgtaaaagattgtgtagatttagttctgggatctcattctgtcccattggtgtatgtgtctgtttatatgcaatcaccatactattttcattacgattctgtagtgattagtttgaaatcaggaaatctgacggctccagctttgttcttcattctcaagattattttggatattgtagttatatatgaattttaggattttttttctatttctgtgaattttgatagggattgcattggaatattgatagagattgcattgaatctgtaatcacttcgggttttatggacatttttacaatattaatttttccattccatgaacagatatttttccactgatgtgtcttcaatttctttaatcaatatattatagttttcaatgtacacatcattcacatccttgatgaaattaattttaagtagtttattctttttgttgctactttaagtgggatcattttcttaatttctttttcaatactgtgttgaataggataggcaagagaaggcatccttgtcttctgctgcttttcaaggagaatgcttccagcttttgcccattcagtatgatattggctttgggcttgtcatttgtgatgcttattattttgaggtatgttccttcaatacctattttattgggagtttttaacatgaatggatgttgaattttattgaaagcctttttctgcatctcttgagataatcatgtggtttttgtctttagttctgtttttgtgatgaatcacatttattgatttgtgtatgttgaactaaccttgcaacccagggataatgcctacttgatgatagtgggtaagctttttttttttttttttttgagatggagtctcactctgttgcccaggctggagtgcaatggtgtgatctcagctcactccaacctctgcctcctggattcaagtgattgtcctgcctcagcctccccagtagctgggattacaggcacccaccactgagcctggctaatttttgtatttttagtagagatggggtttcactatgttggccaagctggtctcgaactcctgacctcgtgatctgcctgccttagcctctcaaagtgctgggattacagacgtgagccaccacgcccggctgttagtgggtaagctttttgatttgttgctggattcagtttgccagtattttgttgaagaattttgcatcagtgttcatcaaggatgctggccctaagttttttttctttttttattgtatctctgccaggttttggtatcaggatgatgctgcccttacagaatgagttagggaggagtccctcctcaattttttggaatagttttagtaggaatggtaccagctcttctggtatgaaacgtaaatgagtttagtataagatatataaaaaccaaattttattggtgttctaaaggaatcaaatgtattattctgctgaggactggggatactttcagaaaagatgtggcatgagaggtggacttggaagcatgtgacaaatttgacttctggaagagggactaggggaggccttttttaaatctatatttattctgaaaataaaagatagtaattccgtagatatataaaaattgtaggatttatgggttaagatggtctcctttaaaaaatgaattattgaggggtggatcaagatggaagaacagaagtttccactgactgtctccttcacagggacaccaaattcaacaagcacgtgtgcacatgcacacacacacacacacaaatacctccataagaaccagaatcaggtgaatactcacagtatctgatttaaacttcatatcgctgaaagaggcactgaagactgtgggaaagacagtcctcaattgttgacactataccttcccaattccccctgtagtagctgcaaagcatggagaaatttgtacactggagagaaggagactgcagtgattgtgagactttgtattgaactcagtgctgtcctgtcatagcagaaagcaaaaccaggctgaattcagctgacactcacacagagggagcatttagaccagccctaggcagaggggaatcacccatgccagtgttcagaacttgagttctgccaaaccttgccaccatggactaaagtgctctggagtcttaaataaacttgaaagtcagtccaggccacaagtactgcaagttttagtgctgagctgggcctggagccagtggacttgtgggagacacaacttactgagataccaacttgggcagctaagggaatgcttgcagcacccctccctcaaccccaggcagtgcaacttacatctccaaaagagacttcttcctttcgcttaaggagaagagagggaaaagtaaagaggactttgtcttgcatcttggataccagctcagccacagtaggatagggcaccagtcagagtcatgaggcccccatttcaggcactagttcccagacatttctagacacaccatgggccacaaggggaacctactgtattgaagggaaggatccagtcctagctggacccatcacctaaagagcccttgggccctgaataaccaccagcgatacccagctactattctgtgggccttaagcaagactctaagatgcactggcttcaagtgagactcagcaatctcagttgtggaggctacagtgagcgacttcatctggttgagaaaagcagaggggaaagtaaaagggcctttgtcttacaccttaggtaccagctcagccccagtaaggtagagcaataagtaggccattgaggttcctgattctaggccttgctcttgtgtagcatttctggacctgccctgggccagagggcagcccattgccccaaaggataagccccaggcctggcagcattcacgcaagtggactgaagagcccttgggccttaagtgaacatcagcggtagcctgtttgatgtccctgtgggcctatggtggtggtggccacagggtgagcctcctctgcctgtggaaaggggagggaagagtaggaaggtgtatcatggtttcagggccagctcaaccacactagaatagaaaaccacgtagacttccaagtttttttattccagtccttagctatcagatggcatctctgggccttggggtaactcactgcagtgaagcaaaggatacaagcctggctaactttgccacctgctgcttttagagcccaagggccttaagaaaacaaaggcagtagctaggcagtggttacagcaggtcttgagcaagacccagtgttgtactggctttaggtctgacccagcactgtcctagtgttggtggccacagggttgtttgtgtccctctatcccaagccccaggtggctcagcacagagagagagactcccattgtttgggagaaagtaagggaagagaaaaagtctctgcctggtaatccagataattcttctgggtcttatccaagaccaccaaggtggtacctctatgggtgtgtaaaaaccacagcattactgggcttgggtgcccccagtgcagagctaatgcaggtggcattagatctagggcttagatcacaacaccgaggccctttcaaatacctggaaagccttcccaagaaggacaagtacaaacaagcccaaactatgaagactgcaataaattctgaactcttcatgcacagacacaagtgaacatcaactagcatcaagatcatccaggaaaatgtgacttcaccaaatgaacgaaataaagcaccagcgactaatcctggagaaacagagatatgtgacctttcagacagagaactgaaaattgctgttttgaggaaattaagaaatctgagataacacagaaaaggaattcagaattctgtcaggtacatttaacaaagaaattgaaataattaaaaacctcaagcagaaattctaaaattgaaaaatgtaattgacatactgaagaatgcatcagtctctttaatagcagaattgatcaagccgaagaaagaattagtgagcttgaagacaagctacttgaaaatacacagtcagaggaataaaattaaatacctagcaatgaacttgaccaaataagtgaaagatctctacaatgaaaggtatataacattgattcaagaaattgaagaagacacaaaaaatggaaatatatttcatgttttgaagaagacaccaaaaatggaaatatatttcatgttgatggattggaagaatcaatattgttaaaacatccatactacccaaagcaaactacagattcaatgcaattcctatcaaaataccaatgacattcttcacagaaatataaaacataaccttaaaatgtatacagaatcacaaaagacccagaatagctaaaactatagagcaaaaagaacaaaactcaaggaattacaatacctgacttcaaattatactacagagctatagtaaccaaaataacgtggtactggcataaagaccaacacattgaccagtggaacagaacagagaacccagaatatagccatacatctatagttaactcaattttgacaaaggtgccaagaacatacatttgggaaaggacagtctcttcaataaatgatgctgggaaaactggatatgcatatgctgggaaaactggatatgcagaagaaagaaactagaccactatgtcatcatatagaaaaatcaaattaaaatgggttaaagacttaaatctaagacctcaaactatgaaaccactaaaagaaaacattagagaaactcttcaggacattggagtgggcagatttcttgagtaacatcccacaagcacaggcaatgaaagtgaaaatggacaaatgggatcacatcaagttaaaaatcttctgcacagcaaaggaaacaattagcaaagtgaagagacaacccacagaatgggagaaaatatttgcaaactacccatctaacaagagattaataaccagaatatgtaaggagctcaaacaactcaataggaaaaaaaaaaatctaataatctgattttaaaatggacaaaaggtctgagtagatatttctcacaagaagagaaatggcaaacaggtatatgaaaaaatgcttaatatctttgatcatcagagaaatgcaaatcaaaagtacaatacaatagcatctcacctcagttaaaatggcttttatcccaagagacaggtaataataaatactggagaaaatctggagcaaagggaacccttgtacattgttggtgggaatgtaaattagtacaaccaatatggggaatagtttgtaggttcctcagaaaactaaaaatagagctaccatacaacccagcaatcctactcttaagtatatgtccaaaagaagggaagtaagtatatggaagagatacctgcactcccatgtttattgtagtacccttcacaatagccaagatttggaagaaacctaagtgtccatcaacagacaaatgaataaagaaaatgtggtacatatacacaatggggtactattcagccataaaaagaatgagatcctgtcatttgcgataagatggatggacctggaaatcattaggttaactgaaacaagccaggcacagaaagacaaacttccttctttttctcttgttctctctttctctttttcccttcccttcctttttctttccttctgtctctgtctctctctctttctctatctttctctctttctctctccctttctctctttcctttttcttgctgcttttatgctaagggctggcattctgattgctcttttttcaggtttaatccttattttaataaagttttcaagcaaaaaaaaaaacaaagtaaggcaaatttcccacgttctcacttgtggaaactaaaatgtaaaaaattgaattcatggagatagacagcagaagggtggttactagacactgggaatggtagtagggtggtcatggcgaagtggggatggttaatgggtacaaaaaagagaaagaatgaataagacctagtatttgctggcacaacaggatgactatagtaaaaaataatttaattgtacatttaaaaataactaagagtataattatatataatatatactgtgtacccacaattaaaaataaaaaattaataaaaaagaaaccaccacacaaaaaatactaaaaaaatgaattcttaatattttcacttgatatgctaaattgggtcacaggatttacttttgtgacatcaattaacattacttagcactccttatgtgtttattcaaaatatagcagacatttgccattctctggggatatatttaaagttctggtaaatcagaaatccttgaaaaataatagactcaatattattttctaaagagtgagtggatgaactctaggtagaataataacattgagtattaatatggtggtgggaggtacagaaagtttgcaaaaaacattgagttacccattttgattggaacatggagtcaattacagtggtagaggtggatgaacctgggaaactggagccctagtgttgaagatcttacaggactgtcagaaagaaattttgaattgcccacatctaacaatgatttagaatgaaattttgacttgatattttaatgtatttctcttccctaacatgcttcagtattcaatatcctttatgataaacaacctgggaggtagaaacagtattttccacacgatggacattcctgtgcaggaattggaatgcacattgaaagacctactgagagttttatcaggaggagagctttctgtgatagacagtcatttggaatccattttccttcatttgggagtagttcccaggccaaatcactgttctatttatatccatgacctccttttcaacactgtaccagctgagcactgtgtagagtcatccttaaaagcagccgtatttgggtcaaaaatgtcaaccaaaatgagtgtaattagacaaaaatttttttttaaagaaagaatgaagaggctgttttgtttttgttttgtttttgtttttgtttgtagccttgtcagtaaatccttaaacctgtttccatttgaattgctaaatcattatgtacaatgagcttgggtgtgtttaattgagctcaacaaactttctttggatcattgaatgcctactgtgccagattctcagcatgtgtggtgtgtacgtgtgtgcatgtgcacatttggactggttgttgtagtctgcactttcaacaaacaaggaaatatctggaaaagtttattaccctatggatggagtggagaacagagaaggagtacatgggaatagctggggtcaggttagaagtgcttttctcctttctgaaagccactgctctttaaaaaaaaaaaaaggtggatatcggggtgaatattgtactatttttaactcacttcatatacagaagtcttcagactttgggaatcatttaaaacaactgaagcttgtgaatgcagatagctggcccttatatccatattttgattcagtaaatccaagtggagcctgggaatctaatttttaacaaataccttctgggtgattcttatgcaggttgtcctgaattttgcaattgaaaacttgcttaagggccacttctgacccctaagtgtagaaattgaatgcaatttaaagcatttaatagaactcttatgggcatcctgatactgtactcaggtccagggatataaagttaagtaaatatctagtaggcggagaggagtataaacatacacacacacattaacatgatacatactgtgagagtgatagaaatttgtccatcaggtatggttgtaagaaagttacagatacccccttgccaaacaaaaagaaagaaaattacagatccagaaatcaggaaagaaaagttgaaaatcctgagggctgagtgctgagatagactttgcctagtttgcagctttgtttgggatgtgccctgaaaaagtcgtatactcagtgaagtggaaacggtttttctctttgcatcttctcctttaaaagtaatatgtgcatccatgaggctttcaggggcctttagaaagagtaaataagcctagtttcaatccatcgtctccgttagggtctctgagaatcagactgtgaatttaaagctgtactggagaaaaaagctacccacatctaaaaatgatggtgggcattaagagatgagatgaccttttattttcctgagcctatgcaaggagtgggtacctatgtacacagattcttctctctgaagtgcctgtgtaggttaatgacaatgccagctgaggactttcagttcttcatatgacagattaatgcccatagaaagttagaggtattatgaggttactttaatgactctttatcacaccttagttctgtagatattacccatgacttcacatggaggacaagtacggagctccagcctctgcaacattaatctcattaatatacaaaaattattgctagaatattaatctttcgcatcataaaataagatcctataatgcagatcttcatattgaatgactacaaggttacttacagaaactaaaaaaaatcttaataactttcctttttggtaatcacatttatggggaaggataaaattaaaatgtggaggtagaatcacaatataatgtctgattaaaatgcttatgcttatgcccagatgccaaagaggtagaggctgcttctttgttccctatgggaggtggagcccctttttcctcagttttgtttatctcttgttctggtcccagcaactgggaccaggggcactccctcctctagagctagggagaccgaggtatggcaattttcaggctaccccaccctgccagtcatcacctgtgatgacttagttttctactggcaccactagtcttggtgagcatcctgctttcaggaaggagtgccctcttaacccccataaatactgggagaataacctacagggttgtggctggcaccgggactcaggcaatagctggtatgttgagttggctaaaaaagtgacaactgaggagtgtgccattttctcaataacagcaggaaaggggaggaaagcagcggaggtggtgggtgaaaagaaggtggagagatgctggtggaggaagaaatgtaggttgaagaagagttgatgaagtgatatccatgtagagaagagaggaaatgatgaaggaaaataaagtgacagagatgaaggaggaggcaaagccctggcctctgaatgccacggactttctgaaggctggagctggagacagtacctgcacaggctaacaggggcttcctccagctggagcccaagtttgggtggatatggtgacactgagatgagaccacagattcatcaaacaaaaaatatcccttctgggatgccaccttttgaaaccacccccacccaaggtcatgcgtaggggccaaggtgcagatttgctgagggccatctcaattaagaggtaaagagttcagacatctaacgacatgctacatgttcaaaatctttttttgaacaaacctctacttcagaaacaaggtaatcattaaacaatatggggttagatcctctggacaagtgggatttcctttcattccagtcacatggcaaggatcccatgccccagtcctgtaggagcaggatatcacctataggttcttcatctggtcctcagactgtagccttccagaacctgataagattgctgttatttttaaagggatctctagcccaactcctgaaataccaactgtcatgtggagggaaagccaggttaccttcagcagggcagcccatggagatactcaggctgttctggtatcagtgtagccaactcctacttttggaagttgcccctgctccagatcatctgccatctattgttggacctgtgcttggccaacagtgatgtctatgtgctgacctccttgcatcttggcttctccggacttttagtgctcccagcttcaagaatgtggcttttatgaacatgcccatcactttgtctaagccaggaaaatggtgaaaactgcattctttcatctacatggcttgaacccttgtctgtgtcagggccttcctgtctctctttgatgtaggtctttatgagttatcttcaaagagggtcagtgtatctttaagaaccgcaacctcaggaacaacgaaaggctgggttcaaggctggtggcaagctggttatcttcgagtatgtcccatgggcgttccatggacctaatacctttgcttgaccacaatcacgtagattttcatctttggttaagagttcacttcagccaccctactgagtatctggcaacacagggacataaacagtggcaagttgctgtgtatgtctgaagtgaaggataaaaagtagagggcctcttaatgtacccaagaccatagtttttcctgctcttctgttactagtaagtatccatgaaagtctgggctatggttttgtgtgtgtgtgtttgtgtttcctggccaaccttttggatattcttgtgcagaccgccattgacctcattgttcagtttctagtcaccaaagacttccacaactgcttatggactcagactcttggccaaccattggagaagccctctactatgccccatcctccctgtcacccaggaaccacaacaaatgtcagctgattgggctggcaggtgtggcccagttctctcagcaagggaaatatggcatcctttctaagaaccaagcattcttggtgacagccaataagcccatgaagaatatgggacatttaccagtcccctttcacccacctgagcatgatgaggtgtccaggtgctctgtgagatactaagagagaaaagaaagcatttctcatctttaaagtttatctatatctgtctgcctacatcttattccaatatctcttctctctctgtctctttttaaggcaccagagcaccctagaacacaaaacggctggaaagcagactttctaatttgctgcttctcttgattgtgtcctgggaagattgttcagtaatgtagactctgaacctctgctcttatgccccatagaaaattcaaagaggcacagacctaggactgtcagattgaaggactgaggtggtcaccagtcccatggaacagggatggttaattgcctaattgtgtacattgttctttttggctaatcttatcctcaatactgaccccctcaccccgacttctttcttccatctgtgcccaaatatccaagaagttcccagatatttcttaagtattagcctagagggcaaggagaaaaatgttatgggaatgaaatttaattaggagctaaaagaaattcttttaaatgatctaaaactaaaataaacaaacaaggtaaatgggatgggcgtggtggcttatgcctgtaatcccagcactttgggaggctgaggtgcacaaatctcttgagcccaggagttcgagactagcctgggcaacatggtgaaaccctgtctctacaaaaattaaaaaaaaaaaaaaggcaggcatggtgacatgcgcctgtagtcccagctacaagggaggctgaggtgggaggattgcttgaacccgggatggaggggttgcagagagcccacatcatgccaccgtactccagtctaagtaggcagagtgagaccctgtcttaaaaaaacaaaaaaacaaggtgaatgcatagctctaatatatttatttacaccacctttatttctggaataatgtaaagattttgattctgaagttttgagaaaagataaactgagataggcaaattcttcaaagttttataaaagcagctatagtaatatgtaagggagcagttgtatgtatttttagtacttaagcctcctcttctatgttcagaaaataatgtaagttttttcagacatttgcataagcattatcttttccccatctccatgcttagtttagccatctttattcttacccagtgccattcacgaacaggtgggagatggtgaaaataaatgaaatgcactattttaaactgtgtctgttgtatttaaactatataaaaacactgaggcaattataaaggaattcagaacaaagtcaacttttagacagtttttctttttttttttttttttttttgtagtctgtttaccatgtccacttgtttcattttggtttagctcaaggaaataaactcaggagcaatggaattgatacatgacactttcacttttcctgctcctcatgaagcaaaacccactaattactttgaaggaatccactaacacttccacatatatttaattttgctaaacttgtatagagctgccttagaggaagagagaagagagaaaaatggagcattcctggaaagctgcattaagactgttgtgtttctgccaatattcttaaggtgccgaatatatctggaaagaaaaaaaatcacaaagatatattacatacactttacttaatgtatatgccaattacttaaactttccagacattttgatattagagaatgtgtgattatttattcattcatgcagtacacaaggtagtttggcatttcccattctctatacattaagcatagccatgtaacttgctctggtcaatgaatcatgaaaagaagatatatatgtcacatctgggaggaagctttaagagctcctgtacaattgggtcagaacctcttttcctttgctgtggcgactagttcccgacgtggaggttctgttagcattgttcctggagtgaagagatgtggcacagtttctcccctccaccccaatcccttaatccaaatggatatgtagaatgaatgagaaatacactgttgctaatttagtgcattaagatttggaggttaaattgttactgtatcataatctaacccagcctatgaaaacattttttaggtttctgtatgttggatatttatgaataattgtgagaatttcatttcctaatatgtgtcactgtttttttgatgtctgtgtcttccctacctctttggtcctattgtttctaatatttggaaactaaatatatatatttagtttacacacctatggagagaaagagagaaaggtctcgttctcgctttgtcacccagtctggagtgcagtggtgaaatcatagcccactgcagccttgatctcctgggctctagcaattccaagtagctgggactataggtaaggtccaccttacctggataatttttatttttgtaaagattgaggtctcactgttgcccaggctggtcttgaactcctggactcaagcagtcctcctgccttggtctcccaaaatgttgggattccaggtgtcagccaccacgcctagtcttaaagttttatacaatcatgtacggattgtaatatgaatttgtcatatttacattgtgcccacatttattttctacttcattcatttatgtatcagttggtaacatattggtctaacttttctatgcaattagagtacatactcctaaggagaaaatgcaacatataactaactaatctccatgtattcttgtgcaaattctagtcatacatatttaatggaattcaatgcatttttttttctgaaaagataattgagatgctgatgaggatgatgatggtgatagacatttcaggaagtgattgtgctctaggaacttggatgttcagagctactgcaaagcattttgatttgtgcaggcaatttactgactatatgttctgatatctgactaccagaaataagttttgaagtacacagctaatagcatcatagatagattttcaaagtgtatacaaatatgaacgggtgggataatgtgaagattagcaaagaacattgtcttattaggggtaaaatggtaaataggcacattttagatgtttattctttgatgggtgtcttcctcagtgagaattatttccaggaagtatattttagtctttggaataaaacttttgccaactcatattgcattgtctttctattcttatagtataattttattttcatttttctggcatcagaaaacaggtcttaaagtgaaatttttgaatataatgatagatctgggggtatttgaatcagttttaatgcatatttcctgatgatcaagtgataagttttgcactgttggtctcatgagcttcttaagtgttctcataatattccctaaattagtgctcatataatttcatgcagtatatctttttaatattgtagtgttggaatgcttttacatggaaatttaatttttgatattaaaaataacagaatattttataataattcttggtatatttatgctggaagcatctccatcactgacgcatatttttcctatacagatctacatagcacacagatctagatggcgctcataaaatgaatggtgaaaataagcaaacagtgaaaattacttattgtgattatggttagcatggttgattgacttattcatttagcaaatattcaataaatatgagatatttaataaatagctatattatagacattatgctaagctctgtgaatacagagatgaaaaaaacatagtcccatttcttttttttttgagatgatggagtctcgctgtgttgcccaggctggagtgcagtggcgtgatctccgctcactgcaagctccgcctcccaggttcacaccattctcctacctcagtctcccgagtagctgggactacaggtgcccgccatcatgcccggctaattctttttgtacttttagtagagatggggtttcaccgtgttagccaggatggtcttgatctcctgaacatagtcccatttcttaaaagctcacatcgtagccagggatatgtattgactttatatagatacatattgattatagcttgtgctgaacgttaaagcagaaagatgtggaagtgctgtggaaacagaataaagaaaggattagttctttgagaaattatttgataaaaactaaaggaaggaacatggagcacatcacagaaaaagtgacactggaattgtgcatttagtacaatttttcatcacttcagcctaattaataatattaaaactattgaggattttattaggttggtgcaaaagtaattgcagtttttgccattaataccaccatctctattgtggataattagagagcttttctctaaagtaatagaacttttattccatgttctatgctttggaaatttgggagttttaacctggggtaaatatttaaaatatttattaacagcaatggacattcagaatggatgtgacaatagaattagaagagggtctggaaagacccctacggtagctgttaactctcaattatatggttatggatgggcctctgcacctcaatttttcatctttcaaatgtcactaatacttgtttcttcctttttttaaaaattatactttaggttctggggtacatgtgcagaacatgcaggttttgttacataggtatacacgtaccatggtggtttgctgcacccatcaacctgtcatctacattagatattctcctaatgctatcccacccctagccccccaccccccgacaggccccagcatgtgatgtccctgtccctgtgtccacatgttctcattgttcaactcctacttatgagtgagaacatgcagtgtttggttttccgttcctgtgttagtttgctgagaacaatggcttccagcttcaaccatgtccctgcaaaagacatgaactcatcctttttcatggctgcatagtattccatggtgtatatgtgccacttttttttttttttttttttgagaccaagtctcactctgtcaccaggctggagcgcagtggtgcaatctcggctcactgcaacctccgcctactgggttcaagcgattctcctgcctcagcctccctactagctgggaccacaggcacgcaccaccgtgcccagttaatttttgtattttcagtagagatggggttttaccatgttggaggatggtctcgatatgctgacctcgtgatccgctgcctcaacctcccaaagtgctggggctacaggagtgagccactgcacctggcccaatacttgtttctttcatgtaggatatttgtgaagataaaatgagacaatgtacataaagtggttgacgcaatggtatggggtatgaatatttaagaaacattaggcgttacaatttttaagagtaagaaagaacagacctgacgaaaaattacagatatatctaaaagtgtggaacaattttcttcaggtggaaaaactgggaaaaaaatgctttccaaaggaatacttgaaagttggaaggagatgaagggatggctctggaaaaggcgattatttggaaattatctaggcaaaatactgacagtcctgttttcgtgggggataattattttatattatagttgttcctaatttcaatgatcatctctagtgataatgttaatgaacaaccctggagtgagatgtcagtatttgactgtggctgtttgcaaactctgctgtgattataaacagtagtctaattgcttaatttattgatgttttgccgacatgtttttcagcaacatttgtgattgcagataactaatcatttctctttgggctcattatcatacgtttgcatttgatttgtctgattgctgcaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcaggtaaccctcccaacaatctagtttgagtagtaagtgcaccattaactggaggaggcaaataattcccttccaagttctactttttgtaatttatagatctagacaagttgggtgcttaaggaggacaaggagtgactagagataactcataaatccaggaaaagaacaaatggaataggtccaagataggaaatggtttgtggaaggcaaattactgtggaggaaagaaagagctaaaagattagacccaagggaagaacttactgtcagtgaccaggtcacgaaatccaagcaagaatgatgatgatgagattcggagttttagaggtaatccaagaagtaaaacacaaaaaaagcaagaaaatggaggacctgcgcaacttcctgtagatagtatacaggtattccttgtgaaacatcagacctcagagttacttctggagtttttcttgtggcagagtttgaagattgcagcctgtgaaaactttaaaaacagtggaaagtccagatcctggtgtgttgtactcttgggtctgatggtcttctgcaatctgaggtctacctctgggaatgaagaatgaatgaggtcatctaccatatttctgcttgagcccagtgatggatcccagaagtgtcattactttgaaatcagaaatcttatatttggggaagtaaacttgtattcaagtccacccttttataacagcttaccagctaagagttaagaaaacacgggggcgggggggcgggcacaggaaatggctaaaaatatgagtaccgttctagttctggcattatagcagattggggacactgaacaatccatctgattaaaattatgaaaatattgggttaaatatattaaaaaatatttttaaaaaactattaggcacttctctgagctcacaggaacaggaaaaacatgacaattacactacgtgtgtagattgaaaaaaaaaaacgtaattggtgaatttaacttaagagccctgttattagcaatgatagaaggaaactgggaaatactattcccccctggaggatgccaacttcaatcctatcctcaaattatttccacagattccatgtgttgtaaaaataaggtcctagtttgtggttgtatttttatcttttagttgttcttgataaaccagaaggtttaattttaatgttttaaatgatacatattttcttttataatttgtaaatttttgacctgaccagttcacaaaaaattcttcctgacttaagtcagaatttcctaatgataaatttgcagtttcatagtatgggtttttacatttaacccacctggaagataaaggttattaaaacgagtaataaaaaagaaaaaagccacacacacatgaaaacaaagtactatggggaagaaccgggggaaattatagatgtgaaaaaacatacctgggatgttttcagatatcaaacttatcagacacagaattaaaatgacaatttttaacgtaactataagaaataaaaagagctgaaaactgtgagaaagggacaagacttgggaaagaatcagagaacttctaagcaatcaacacgatgcttaagaaaagaagagagaacaaagtggacaagtttaaaagcagattagacatagatgaagcaagagcttgttcactaaaagaactgaagaaattatcaataactaagttcagatatttaaaaatggggaatatgaataagagaatgtaaaatataaaatatgtgggagacagggcggagagagtggaaagatgtaatatatattcaattgaggttccaaatgaaggtaacagagtgaatacaaaaaagagaattattttcaggaactattaaaagatgtcaatcagtacccagacacagtaatcagcacccagacacagtaattccaaagaattctgcaaaagttaaaccataggaatccaaaactaaacccatcttaacgagactgcagggcatcagagaaaaagagcaattgataaattataaaagtgacagcctgggcacggtggcttacgtctgtaatcccagcacttagggaggctgagagggtggatcacaaggtcaggagttcaagaccagtttggccaagatggtgaaaccctgtctgtactaaaaatacaaaaaattagccaggtgtggtggcgggcgtctgtaatcccagctactcaggaggctgaggcagagaatggcgtgaacccgggaggcagaggttgccgtgaaccgagatgcgccactgcactccagcctgggtgacagagcgagactccatctcaaaaaaaaaaaattataaaagtgacattgattggtgtgaaaaggacaaggcattcaataaatgcttgggggactcttggctattcatgaagaaaactaattgaaattggtattgtactttatgaatctttatataaatcaatttttggtgtgggaggtaaatgtaaaaattcatattataaaactataaatttgtcattagaaaattttgacaagtagggaaggattttttgtgaacttatcaggtcaaaaatttgcaaatcataaaataaaagtttagaacattaaaattaaaaccttcctgttaagaagaactaaaaaattaaaatacaactacaaattaggagaatatttttgtgacacatgtaatcaataagtatctagttaaccttgtcagtaatcaaattaatagaaatttacaacactatcataagcatttctccctactagtttgacacaactttgaaagtctgacagtgccactgttggtgaggatctgtagcagcaggaaatctcacccatagctagtggaagtataaatggtacaatttacttggcatcacctggtaaagtttaacttttgcatgtcctacaacccagcatttcctctcctagacgtttacacatgtacaagggaagtacttgtgcacgtgtagcaaaagtcacacacaagaatagtttttgtaacagtctcaaactctagctaattcaaatatccatcaacagtaggatagataaactgtgttatatttataccttggtataccatatagttgggaatatgaaagacctcagctactgacatcaacatggatgaatgtcaaaaacataatcttgaacaaaagaatcaagtcattaaagaatgctgtagtattattccacttaactaaagtttaaaactggaaaaatggaaacaattctatttagaaatacttgcattgatggcaaaaagtgtaaaaaataaaaggaatgattaacacaaaattcaagctggtgcttatctctgagggaaagatatgggaagtaagaggatacaatagggaagataaacatagtataaaattttttattttattactcttctttaatatgcacatatatgtttatatttaaccatttataagtggaaagagagttttctaaccactcctaccagtgatgaaaatgggaaaatatggagcattaaaaataaaatctagtttaagttccctcagggaataattattgaatggtacttctaccatgccaggaaaacaaacaaaaggaatactgtctcacatttgctgcacactgcaaatatagacattccagattgaactaatcagttcttaaattttcaagcctaccagctgggcaggcttctcatttgggattgtttttgatgttggattttcttttatggagagtatgtttgtattgaatttagcattgtcatagcacagttaaattacccgagaacaaaaccagggaattgtgttttacagtgtgttcatcaatattttcatttgtgggatttaatattagctctttcttatgaatcagatagtcttattaaatcagaagaggaaatatccataaagatttaataagaatgcagaaagagaattcaaaataataaaccaccttagtaattttagcttccttactaatttatagtatttgcatgatttgggattatttttcatcatattaatttgattttaaattgccttctagcttggtgctgtgggaacatttccaaacttattgagagaatcttttattatgaaactgctggggtgttgtagtagagttgatatgtgatagcttactgtttacctcaaattatgtaagtttttaggtgatttaaattacaagttattataatagcaataattgactaaaactgaatccaaactttgaaaagtaaattgataatttgtatatggatttatgaacctttgaggcatcctgtaatgatgggaaataggagccaaaattgtcatatacaattgcttggaaatgattggtaatgcccttgactcactaattgtaaaactgcctgcatttatttttttttaattttgaaaataaccagagaatgtagcattttgttttttcagcctataaatactcaagtaaattattgttcaataagtactctaatgaaactcagaggctacttctggactatatctataaagcattcataaatatggtctatctatacaatacattctgaaaaatcagttcatgttgactttaattagaactgcttttataaaaagtgagtagaactttttcaccctggatcaatatgatatttcttctgctggctgaaaatatggaagaacagcattatgactgtttcctttttattcttcccaagggagaatctgattttcttgttttttttcctcaagacacagggtcttgctctgttgtccaggctggagtgcagtgtcaccatcacagcttactacagcctcaacctcctgtgctcaggggatcctcccaactcagtctctggagtagctgggaccacaaacatgtggaaccacacctgactatttaaaaaaaactttttagtagagatgggggtctctctatgttgcccaagctggtcgtgaactcctggcctcaagcaatcctcctgcctcagcctcccaaaatgttgggattacaggcatgagccaccatgccaggactgaatttttaaattttaaacagtagacaattgaaaagtaaaattatatttgtattctctcttccttgtttgcactagctatattgtgaattcaccagagaaatgtattactttagttctctaatcttgtgaacccaaaggtattttgaatagtttttagtgctgactggctaacttacactaatagtttaaccacactttgattaaaataaccaaatatttattactgcctatgacttattctttctttaaaaaacactgttgatagggaaagggaagttgggtcaaggattaactagagaatgtacctagggtatatgagaaagacaaatagcattttcacgatttaaggcttttgaagaatattgagtatgtccaaatgtcttttaattctgtacttagtttaaaaactattttcattaaattttatctcataggcatacaaattcaaattttcttcattagttcaaagacagtgcattttatataatgaggcaagtatgcaggaaacattgtgaactagagttaaacaatgtgtaatcatgttgtaatactaatgtgtttagcaatctcaattgcaaatcagggaaatgctatgagaaaaagactcacagcattccctgatttgcaattgagattgctaaacacattagtattactgcctggtgcaaaagcaggaatattaatgtgcaatttacatgtattgtaacacattaaattacagctccttaagcttcaacttttaatgagcttacaggattttttgagattatgcaataattgttctctaattaatttttaatttttagcttcaacttttaatgagcttacaggattttttgagattatgcaataattattctctaataatttttaatttttaaatagtttttgctatttccagaggaaacctgatgttgttattttaatatttggagggatttgggttttggaaatattgcaatatttaattaaccctatcagatttcagcctgagactgtatttagaaaaaagaaaaactaattacagttggcactccatatccatgagttctgcatcctccgattcagccaactgtgggtcaaaaatgtaggtaggccaatgatagttgcttcagtattgaacatgtatagacatttttttcttgtcattctctaaataatacagcctaacaactatttactcattatttacaacacgttacatattataagtaatctacaggggatttaaagatttaaagaatgtggtaggatgtccataggttgtatgcatgtacaacactacttaatataagggctgcaagtctcttatattacttataatacctaacaaaaagtaaatgctatataaatcattgtaatactatatcattttgtttgtagtttttaattgttgaattgttatttttgtttgttatattttttttattttttaatgccatattttcaatccacggttggttgaacatgcagatgtgaaacctgtggatacacagggtcgactgtatttggtaacctaattaattttctaagattctttgataattatttatttataaaactcaagttagtactttttaatcacattgagattaaaaacatataaggagaaaaacctaaggggtcagaaaaaactacataggcattatataaaattactgttaagatactgatcccagttatcctcatttctcacatttatcaattaggagtatttaaatttgcttttaatctcctagataatgcatatagtggcagttttcataagtcagtgttctattgtaacagtaatatggaaaaataccgtataatgttactggtgaaacttaggactagatagatatattttccgatagatttatcattttgaatagtaaatttatttgtaactataaatgtgtttgtttttaaaaagtatttatttaaagtattaatatttgtgagtgtaccagcaaagttatgagtctcttctgtagtttgcttccttttaataatcaatgcctcattctacatactctccttagatctattttccaacttgccaatacttccctcagttggttgtaaaaattattgattaaactcatccacttgatgcttaaatgctgattataccagtttatagtgttttgcagttccatttgtctgacaaaatttttcataccgtttttatttattttcttgaataaatcatctgtaatgattgtaaatgcttctcctggtaagtcagtctccagaactcctgcagtctattacatcatttgttctttcacttaattttcagtcatgttacttgtttcctgtgtgactaattacacttttttttgtttgaatgctggagattgtatataaaatattatagaaataatttaagacttaggatgattttgcagggaaattttagtgtgcttcttgaaagagactaggggctctagcagttagcgatcaggggatttaaagctgggttttggtctctgtgaggacctgtctacttctggttcacctctatgttttggtattacccttatacctgtggtcatgttcccatctcaaagtggggagggctttctaaggtctttgccctaggaattcttaggctccagtttatgttctcttggccctggctgtcaaaaatgctgctcagcttctcaacctttccattaccttttctggagccagaagatgcccacaggataaaagcaccaccaagtttacttttcacttctcaggtttatcttctgccatatcttggtacaataatttttcgttactttgttagctgaccagcatagggtaattcaaatgatataacctgctattttatatgtatatatgctaagtttcacaataattctgtgaaggaattattgctattatttccagtttgtaaatgaagaaaataagcataaaaaatagttaaccagagcttctaatatatatactgtgtatacattaaataaaagcatgttaaataacatttatattgtcaaatcttcctattgccttgaatattccattaaagttagacttttcatggctttagtcttcaataaatttaaatgtatgttagatgtcctctttgaaaaagtagaagtaagttctctattttaaaggtattccatccaaaaataaaataatttgtttttaaattagaaagtaagagacattctagctgcatgtggtggtaggggggcatacctgtagtcccagatactcgagaagctgaggagggaggatggctttaatccaggagttagacaccagcctgtgctggacagcataacaataccttatctagaaagagagagagagattgacattgattaaattcagttatgtgaaaaaaatgagtgttattctatcaatcattttgtaaactgcaatcactggccagattgggtgggggatgtattagtcatgatgctctgctttttttctatattttccccttgtttattgtttgttgtggattgtaatgcagaagctacatatttaaacgttttatatttacattatttcatagggtagtcattgaatttaaagattaggtcatattctatttaattatttttatttattgagcacatttgttttaagcatagaattactcttctggcatgatgctatagtgctgaactttaatacacaaatttatttatagacagatctacttactgagcacattatttgttttaattatagaattactcttctgacatgatgctatagtgctgaacttcaatagacagagcatccttaataccttacaattcctctgtaagatatcagcataatgatttaaaacacaatattgtgtctgtgatgtgtatgtcaatgagacagaattccactgctagtttattttagcttttatctgtaatcatgaaagattccaattttatataatcacagaattttaatcatattttcagactataaaatagtctatcaggcatacatttctaaaaatgctagtcttactgaaaagttttattatgatatttgtcaaacagatttcccaagcagtccttttgtgaagatatttgcatatttatgctacaagaaagaatagttaataagttagtgaaagaaaaaacaaaaccaagtgatgggaaaaaaagctaaactgattcacatgaaactgtgcatgcaaagcacaaaattgcttagtttgattttgtgcaacagtcttgactttcacatttttggaagaaaaatacattctttagtggagacatggtttgagtattttgttagttaaatattatcatcactatgaggataactacctttaaataagttataatctatttcatgtattttattcctgcctcttgtctccagtgtcccactaagactactgatacaatgtccatagaagaggctaaaagttatattagcaaagtcactcatttttatttgatttttgtgtggtgtgctttagaagtgtgagacttccaagcagttaggaagctcgtgtttttatttatctgacgtttatgtaaagaataggaatctccatctgccaatattttttccctggtagagacagtaaatgtgatttcatcaacccatttagtaggttagcccattatctttagcatatggtccctttcttaggtgtttttgaatgggtttttaatcttttactgacacttcagtctcttttaagcctatatgcatataggccaacatgagtagcctaactcttacaatatgaaaaatgatatgaaaatagcaagatacaacacataagacagtaatgtgctatctgcatgctaatcacactattgatttagttagttagttagcttttacgtttttgacctgttgttttgagatctcatatctcgtttcaaataaaagtttaaaaattatttaatctctttatttgttttctaaaattacaaaaaaaagatctctgaaaactagtattacagaagatagttaaaatcacctataatttaccaaccaattatagacatattttacatttttatgtatctttaaagtctttttatatgcaaacattcaatacaaacacatagaaatagaaggtatggacttaaaaagtagattattttaaaaactgaataagcttcattcaacttggtaatatcatgacacacagtgtaccaaagatgcagagaaatatgcagaaaaaacttggttagccctaggaagaatctttcattattattaactcactttggttttgtatttttctgttcctacaattgaatttttgagacactggaaggtaactctttaatcacctgagttgcaaatgtggtactaacaattcagtgtcacaagtgcttttcaaagtatgttaagctttttgttgatgtcatgtcaggcatatggtaattgtctgggtcaccactataatattccttatttggaatgtggtttcctagcaactcttgctttttcctaatggctgaattgatttctggacatttgtaatgcttcctactgcatcagaaattgtcaccttgtgtgtaaatgttacaagaccaaatttacatgtagattccattttaagaaattattttgctttatcacttgcctttaatgtgtttgttcagaggttaaaccaatcaatcataaaaaatgaatttagaaaacctcattaattcagactctttagggaaatatggtaattttgacaaattccaaaatatatgcaaatagttcttagtggggaacctcctgaagttgaagaaacagagtaattttgatggtcaaatgaccatgtaatcaggaggttgttagaaacacaggtccggagtatgcatggggtgtcccaggggagaaaaggcttactttggaggcttgctgtttcaactcacatgaagcctgattctacatgaatctggttggagccttgctggcagcgacttttactcatttattcaacaaatgttttttgaatgcttatgattttctaaacaattggttaggtattagaaatgtgagggtaagcaaaccaggtacatccctgatcctcccacgaattacagcctatggaaccaacaactagaaattactaacttggtgaggaaggagaaatagactcagttttctctcaatactctttccaccttaacatcgagaggtttgggttaggcttttaggaatataattctttgtagagcaaatattcaggatgtcatttacattcagacctacattattttggtgtttttgtagatttcatatgttcttagggaagtgaggttgaaaggcattaaaaaccaactatgtggtaggggttagcttgacatttacatattatctcacttaatctacacaacaactaagaagggcatatatgcaatttttatatacttaaaagataaaaaaagacattggggttaaaaatatgtacaagattatagaggaaaaaatgcatactggacactttccagatgtcagacttgtgccatgtctttatgcactatttattcctgccccccaacccccccccaaaaaaatctgcaaagtaagtttcgttaatcttattttacatttaaagaatttgagatttagaaagtttatataatttgatcaaggttatgtagctagccaattgcagaactaaatttgaatccagatatatctgtttggaaaaaagaaaaaagctttgctttttttcagtataggaaactggagaatgcccagagtagaattttattacctgagtacttaataacaagagttacttctcacctagtgcttactacgtgctcagcattatgccaagctagagtgcgtgagcactctctctcttacatgtcctctcccttcctaatatatatgcatatacacatacacctgtataattatttacatgtatgtgtatattttaggcatattttcatatttgtgaaatatgcctgtactgtatatacataattattacaacaatcatggaccatggattagatgttatctctatttataaatgggaaaaccaagactgaaaggttaagggactttttgtcaagagtaaataatattactaagtaagaattgattcggaattggaattcaaatctgtttgacttcaaagtccatgctcgtaaccattaccctatactgccactcacaatacaactggaatgtattaatatgatttctaatcttatgactaagctaataactttaattttccttaaaaaattattgctattccctgttccttaagaaagaagtgtgaagacgtaatagcagtgcaatgtcttgaaggcattctaactcaaggcaaactcacatcgagatgttgaaataatgaggacaattatgtcgacatttaacagaatgagttgaaaattgatagttctatagaatttcaaaatatctgaagaaaaaattaagttgggaataatattgaaatatacacttctgtaatattagctttttataaaaaatagaagaaatgaactttttgtagaaacataataatccaaaaactaggaaagcagaaatttaaaaccgtatcagagaatccaaaaggcatatttgcttttttggacatattatcttccagatggtatcagttgatccttttggatattgttatctaagattattttttatttacgtaacgaaaagcactgattgattgaaaaagaaaaatgtagtcaaatagtttgatcagtcagcctgcaagcctttactgaatttctctcatgtgcaaaaccacataattgagttgcagactgaactgcatgagtgccaaatactaatctgctttttttcttggctctcaagtcaaaattctgtatacacaatacccaaacatctggtcacttaaatccattcagtcaaaaattcaattgaccgcccagattttctgattctaggattccattcaacttgtttgccttaattagttagtttatctgaaagctatgtcaaataggtaatagcatatatttagttatttcaatagtacttggcatcttacatatgaaaaggtacagttatggagggaagaaaacacaggttctgttcctcccacctccatcaagcttttaacagatttaatgttgttttctgccttctatactgtttgccttcctttttgaattggtctcacccatctctcactgccccccactctcgggacccctcagtctccatttctctctcaatttcctaaaagtgacatcaattttccatgaattacctaagaacgacttaccaaaaaaaattacattgttatgaataatgtacgcaaaactgttgatactggctaacttaggggaaagagctttttccatttttaatcttacagttttatatctgttcacattttccaaatatacgtatgaattatttatgtattgccttttagtatccatagaaattatatgggagttgccatcacggaccatttttctttccttctttaaagtttcctatacttaaaataactcataaatataatttctaaagtaagcacaaattctcacttatatatttggttcacaggaataatcagcaggcaatgcctacaactgcacagaataaaaatttttattggctaaaaattagtgggagcatcaaatgtctttgacaaaattacactgtgaaacatttggccagcctaatgagggtttatagaaataatgaccataaaagaaaactatactggcagaaattaatatgagcaaactactgcttaatgagtcccaaatcatcactgtaaagtttcaatgggaaagaattcatgccaattaaaatattttcagagggacacaactggaaatgtaaaatattagaataaatgtaaaatattagaatcaatttatatgtagtatacagaaaatagatcaaggaattaaattgacttaatagcatttagtccagaaaataattttcttcataataattcttcagtattattatatttcattcaatctttgtactcctttgttggggtgcaaatgtcttgaactataactgttttattagcctaaggaattatttgatgaattaacagaagctgtatcatggttctagacattcatgctcaataaactgaattaaatgttaccaactggtaggagaaagtagagaactttatttagttgtggcagtgatagctattatatctttggatgattatagtttttatctctctgatcctttgctgcacaagtaagtattcttttatatttgcaactttttgccatgtcttttacctcacatataaataagtaaatacattgacttccaggtttttaataaacttatagtattctccatttcttttattgtgttttctcatctttctcttactctaaattgcatattcataatcttgtccttttgaaaaatactaaacttatcccatgctcatattttaccccagcactcaaaatacaaattagtaattttgctacccaaagtataatgaagtaaagtagacctgcctcattacaccagtgagaatacctattatgaggttatgattagtgatcacactgtgctctatgcagcgcagcatcctgtgctatattaaaatctcttcactagttgtgttactgtagcacactatatccaaacattgttctgtgttatttttctcttcattttaactgtagtttgtgaaaactcttactttgtggttaagaaggcctgtccagggaagcaagagtcataccatattttaaaaatatacagtttatcagagctctaagcataatgtatcagccacaaacaatcatggcaaagcttcccttttaaacttggtgcttcaagggttgtttatgccttcaaaaatttgctccaaaattactaattcctgttttacactgggaaagttattagtgtgttcaagtagattgatatttagatttaaaaattatctcaggcaaacatatttctatccatctctatggcaatgttttgatggccaatttatgccagattctagagccaaatgtatttgcctgaggtctccagatgttttctgacttgctgctggtgtctgaaaaaacgttgcaactatgactgtaaattcaccctttttgctttactgaactggggctaagacacccatccttcttttcttgtggtttagcttagccagaaatgcaccagagataatttacaaaaggataattatatagtagcttaggaaatttggttgtgaataactaacattttgtaagcttttaaaagttggaaatttgaagatcaactctcatttcatacatgataaaaagatatcaaaaaagtatttgattatacttaagttatctaactagttagcaataggatctgaacatgtgaaattcaccagggaagctaatgaagaagataaggccagaagaaggagaaataatattgtagtttttctttttctggcaattgttcatcatgatagaagaagtataatttggaaagtgtgttttgaggttattatatgaaagaggtggaaaattgcacaaatctgtggcagaaggtccaattatcttgacctcttgagtgtcatttctttattatcagagtattactatttttactgtttcctttttaatcttttaaaactattaattctttcctcagttcctgtcttccttctgtgagagcctctcattattcatatagaatttagccaaagttgacgtggatttttttctccttttaacctttagtattttctatggaaatgatgggccagttatttgttagcttgtaaaaggaggaaaaaacaataaatgtgtacctttatatccccacacctcttctgtattatctctcagaacatattaattttttgaaaataccagatctttaaaaatagtggtacatcttcaggaatatttattttttcatcatttcttctatttgttaccatcctcaagtatgtcaaaaaattagaataaaattattttacctactttgtccaaatatcaagttgtaaatactattcatgtattaaaaagtgaaaaactatgactgttataaaaaatatatgctcacataaacgatcgttttatgtatcattccttgaagttcggcccactttagaaattcacatatagccatgcctccaaactcatcatagcttagaattgttccaactacataatctcaactccaaatgtcttttcatagtcacattacttgttcttctgccactttctattctaccattctcactcatcactgtgatgtataagcctttatccattcttaggtttccagtctattttgagtatattagttttctgtgcctgacataacaaagaaccaacaaactaagtggcttagaacaacagaaatttgttgtctcactgttctggaggctagaatcccgagatcaacgtgttggccgttttatttgaagacatgttttatttgaagacactagggaaggagctgtccaggtctctctactattactagattctggtagttccttggcagcataaaatccaatctttacatggcattctccctgtgggcatggatgtatctgtgtccagatttctccttttcgtttttttgagacagagtttcgctcttgtcacctaggctggaatgctgtggcgcaatgtctgctcactgcaagcttcgcctcccaggttcaagcaattctcctgtctcagcctccccagtagctgggattacagacgcctgccccaacgactggctaatttttggtatttttagtagaaacagggtttcgccacgttgggcaggctggtctcgaactccttacctcaggtgatctgcccacctcggcctcccaaagtgctgggattacaggcatgagccatcacacctggccatttctcctttttataaggatactagtcatattggattggggggtcccccctactctggtaggaactcatattaataattttcaatttgactaattatatcagcaattaccctacttctaattaatgttaaattctgagatactgaggattaggaactcagtatatgaatttaagggggtagggcacaattccatccataataccttcttatctagaaaagaagaatcccattatctcctatctcaacatggctcctatcacccttctaattttattcttgtcttccatcatacagagctacctaagtagaaaattcttgctctggaattgatggacattactggtgaaaattacataatcatggtaataaaatacccattaagaatgcatatgttttgaactcaactgggccttaaatctgtagggatcttgtttcaccatcccctagctatgactgttgcaaatacttgcttttttttttttcaataatttcaacttttattttagattaaggggtacatgtgcatgtttgttacatgggtatgttgtgtgatgctgaggtttgggatacaaatgatcccatcatctaggtagtgagcatagtcactacatttgtttgacttttaactttgctactcttactccaaacagacccctcctttcctaactaaatgaaatgctagaagacatcaatatgaataaatttgacattctttccacacccctccccaacactattctttcttcaaatatcttctctgcctttcatctctcccctttgactggccccagtgtgtcaacaaaacctcctctgtaattaatgcaaaaatgtcattttctttgaaagcttccctctctaactatgctacatgctgctgctttgtttatgatcaaaaaataatggaaagccactctgttgactcttcattgcctaggaaataagaactaaatcctaatcagtaagtacctttaatgtgttctcaagctagttgttgaaacctatattctggtgagctttcaagatggccgaatagcaacagtggtggtctgcagctcccagtgagatcaatgcagaagatggatgatttctgcatttccaactgaggtacctggttcatctcattgagactggttggacagtgggtgcagcctatggagggcgaaccgaagcagggcagtgtgtggcgttgcttcacctgtgaagtgtaaggggtgggggatttccctttcctagccaagggaagccatgagagtctatactgggaggaatgatacactcctacccaaatactgcacttttcccactgtgttcgcaaccagcagaccaggagattccctccggtgcctggctcagtgggtcccacgcccacatagcccagcaagctaagatccatggacttgaaattctcactgctagtgcagcagtctgtgatcaacctggaatgctggagcttggtgtggggaggggcgtccatcactgctgaggcttgagtaggtggtattatgcccacagtgtaaacaaagctgccagtaagctcgaactgggtggagcccaccgcagctcagcaaggctgactgcctctctagattccacctctgtgggcagggcatatctgaacaaaaggcagcagtccagtcagggaattatagataaaaccctcatctccctgggacagagcacctggggaaaggggtagctgtgggcaaagcttctgcagacttaaacatccctgcctgacagctctaaagacagcagtggttctcccaacaccacattcgagctctgttaacagacagactgtctcctcaagtgggtccatgacccccatgtagcctaactgggagacatctcccagtaggggctgacagacacctcatacaggagagctctggctggcatctcatgggtgcccctctgggacaaagcttccagaggaacgatcagggagcaatatttgctgttctgcagcctccgctggtgatacccgggtaaacagggtctggagtggaccttcagcaaactccaatacacctgcagctgaggggcctgactgttagaaggaaaactaagaaacagagaggaatagcatcaacatcaacaaaacggacacccacaccaaaaccccatccatagtcaccaatatcaaagaccaaggtagataaatccacaaagacggggagaaaccaatgaaaaaaggttgaaaattccaaaaatcacaatgccttttctcctccagaggatcaaaacttcttgccagcaagggaacaaaactggatggagaatgagtttgatgacttgacagaagtaggtttcagaaggtgggtaataacaaacttctccgagctaaaggagcatgttctcacccaatgccaggaagctaaaaagccttggaaaaagatgagaggaatggctaactagaataagcagtttagagaagaatataaatgacctgatgcagctgaaaaacacagcacaagaacttcatgaagtatacacaagcttcaatagccaaatctatcaaacagaagaaaggatatcagtgattgaagatcaaattaatgaaataaagtgagaatacaagattagagaaaaaagagtaaaaagaaattaacaaagccttcaagaaatatgggactatgagaaaagaccaaatctacgtttgatcggtgtacttgaaagtgacagggagaatggaatccagttagaaaacactcttcaggatattatccaggagaaattctccaacctagcaaggcaggccaacattcaaattcaggaaatacagagaccaccacaaagatattcctcgagaagagcaaccccaagaaacataatcgtcagattcaccatggttgaaatgaaggaaaaaatgttagggacagctagagagaaaggtcgggttacccacaaagggaagctcatcagactaacagcagatctctcggcaaaaaccctaaaagccagaagagagtgggagctaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaatcagtaccagccactgcaaaaacacgccaattgtaaagaccatcaacactatgaagaaactgcagcaatgaacggacaaaacaaccagctagcatcatgaggacaaaatcaaattcacacataacagtattaaccttaaatgtaaaagtgctaaatgccccaattaaaagacacagactagcaaattggatgaagagtcaagacccatcagtgtgctgtattcaggagacccatctcatgtgcaaagacacacataggttcaaaataaagggatggaggaaaatctaccaagcaaatggaaagcaaagaaaagcaggggttgcaatcctagtctctgataaaacagacttcaaaccaacaaagatcaaaagagacaaagaaggccattacataatggtaaagggatcaatgcaactagaagagctaactatcctaaatatatatgcacccaatacaggagcacccagattcataaagcaagtccttagaaacctacaaggagacttagactcccacacattagtaatcggagaatttaacaccctaatgtcaacattagacagatcaaccagacagaaaattaacaaggatatccaggacttgaactctgctgtggaccgagtggacctaataggcatctatagaactctccaccccaaatcaacagaatacacattcttctcagcaccacattgcactgattccaaaattgaccacataactggaagtaaaacactcctcaggaaatgtgaaagaacagaaatcacaacaaactgtctctcaaaccacagtgtaatcaaattagaactcaggattaagaaactcactcaaaaccgcacaactacatggaaactgaacaacctgctcctgaatgactactgggtacataacgaaatgaaggcagaaataaagatgttctgtgaaaccaatgaagacaaagacacaatgtaccagaatcactgggacacatttaaagcagtgtgtagagggaaatttatagcactaaatacccacaagagaaagcaggaaagatctaaaatcgacaccctaacatcacaattaaaagaatagagaagtaagagcaaacaaattcaaaagctagcagaagacaagaaataactaagatgagagcagaattgaaggaggtagagacacaaaaaaaacccttcaaaaaaattatgaatccagaagctggttttttgaaaagatcaacaaaatagacagactgctagcaagactaataagaaaagagataagaatcaaatagacacaataaaaaatgatacaggggatatcaccaccgatcccacagaaatacagtctaccatcagagaatactataaacacccctttgcaaataaattagaaaatcaggaagaaactgataaattcctggacacatacactctcccaagactaaaccaggaagaagtcagatttcttaacagaccagtaacagtttctcaaattgaggcaataatagcctaccaaccaaaaaaagtccaggaccagacagattcacagccaaatttaccagaggacaaagaggagctggtaccattccttctgaaactattccaatcaatagaaaaagagggaatcctccctaactcattttatgaggccagcatcatcctgataccaaaacctggcagagacacaacaaaaaaagagaatgttaggccaatatccctgatgaacattgatgtgaaaatcctcaataaaatactggcaaaccaaatccagcagcacatcaaaaagcttatccaccatgatcaagtcagcttcatccctgggttgcaaggctggttcaacatatgcaatcaataaatgtaatccatcacaaaaacagaaccaaagacaaaaaccacatgattatctcaatagctgcagaaaagaccgtcgacgaaattcaacagcccttcatgctaaaaactcacaataaactaggtatcgatggaacatatctcaaaataataagagctatttatgacagacccacagccaatatcatactgaatgggcaaaaactggaagcattccctttgaaaactggcacaagacagggatgccctctctcaccactcctattcaatatagtattggaagctctggccagggcaatcaggcaagagaaagaaataaagagtaatcagttaggaagagaggaagtcaaattgtctctgtttgcagatgacatgattgtacatttagaaaaccccatcatctcagccccaaatctccttaagctgataagcaacttcagcaaagtctcaggatacaaaatcaatgtgcaaaaatcacaagcattcctatacaccaataatagacaaacagagagccaaatcatgagtgaactcccattcacaattgctgcaaagagaataaaatacctgggaatccaactttcaagggatgtgaaggacctcttcaaggagaactacaaaccactgttcaatgaaataaaagaggacacaaacaaatggaagaacattccatgctcatggataggaagaatcaatatcgtgaaaatgtccatactgcccaaagtaattcatagattcaatgttatccccatcaagctaccactgactttcttcacagaattggaaaaaactactttaaatttcatatggaaccaaaaaagagcccacatttccaagtcaatcctaagccaaaagaacaaagctggaggcatcacactacctgacttcaaactatactacaaggctacagtaaccaaaacagcatggtactggtagcaaaacagatgtatagaccaatggaacagaacagaggcctcagaaataacaccacacatctaaaatcatctgatctttgacaaacctgacaaaaggaaaaggattccctatttaataaacagtgttgggaaaactgactagccatgtgtagaaagctgaaactggatcccttccttacaccttatacaaaaattaattcaagatggattaaagacttaaatgtaagacctaaaaccataaaaaccctagaagaaaacctaggcaataccattcagacataggcgtgggcaaagacttcatgactaaaaccaaaagcaatggcaacaaaagccaaaattgacaaatgggatctaattaaactgaagagcttctacacagcaaaagaaactatcagcagagtgaacaggcaacctacagaatgggagaaaatttttgcaatctatccatctgacaaagggctaatatccagaatctataaagaacttcaacaaatttacaagaaaaatacaaacaaccccatcaaaaagtaggcaaaggatatgaacagacacttctcaaaagaaggcatttatgcagccaacagacatatgaaaaagtgctcatcatcacttgtcattagagaaatgcaaatcaaaaccacaatgagatactatctcatgccctcatgcctgttaacatcatgatcattaaaagtcaggaaacaacagatgctggagaggatttggagaaataggaatgcttttatgctgttggtgggagtgtaaattagttcaaccattgtggaagacagtgtggtgattcctcaaggatctagaaccagaattaccatttgacccagcaatctcattactgtctgtctacccaaaggattataaatcatgctactataaagacatatgcacacgtatgtttattgtggcactgttcacaatagcaaagtcttggaaccaacccaaatgtccatcagtaatagactgcataaagaaaatgtggcacatatgcaccaaggaatactatgcagccataaaaaggatgacttcatgtcctttgcagggacatggatgaagctggaaaccatcattctcagcaaactatcacaaggacggaaaaccaacactgcatattctcactcataagtgggagttgaacaatgagaacacatgggcacagggaggggaacatcacacaccagggcctgctggggggtcggggcttgggggaaggatagcattaggagaaatacctaatgtaaataagttgatgggtgcagcacaccaacatggcacatgtatacctatgtaacaaaactgcatgttgtgcacatgtaccccagaacttaaagtataataaaactatattctattgaataaacctttttgaaccataatatggcattaaacattccagattattgccattctgtacattgctatctctttaccatattcaccaagtttaccttagccatgttgttaattggtttgttatatttatattaggttttgttacgtttatattttgtttattttcttattctatccatctttcttggccagctcaaatcctaagaagtcatctccaacactcactatctccttagtagcaattacttccttcttccttaggaaactgataactttgtcacaatttactgttggtatttaacatattgtaacttgcaaataaattgtgtgtgtaaattcctgtgttgtatgtactaggctgtgagaactttcctgtttgggactatgtcctgttcatctttgtatatcatagtgcaaggaatttattatttgtgaattaaacagatttatcaatgtagaaatatataaaattctgcagcaaaatatggaaaattatatcctgatatacgtttgttaattctttattcatttttcatacattggttttacatataaaatattatcaagacactaccatgtgcttaatacaaggtactaaataaactgaaatttattttataatttaattctacaaataaatccactctggtagcatttggggaatataatattgactttatattttaaaataaaaatatgaaagtttattttattttattttattttgagaaaatactggcaaattagaaaatactggcaaatgtttttgcacgtggtctcttaagaaccatagctcagaaccctgggatgtgatacagtactattcacatcagtactactcagacacattgaaaacctggtcctgtgtcaagtcccatgaagggaatccctaagggaatagagaagagaatgctatttaatgatttgatgcatgatagtaaccacaggagaataaaacttcgaaagagtctttataaactgggtttaatgaaactgatcatttccagttctattgtatatcatttactgccttagctggcaagactctagaaatagaaatagagaagattcttccttctcatatgtgtacattttaatatcttgaatatagaggactacttatagaattcagtgaagtcaccaaaggttgaataattagctatttctgccctttactagttgttagatttaacattatcaacctttgcagtgaaaagtagaaaaaatacaaactgcaccaacagttgggctagtcatacattttacacagtgacaatatcccattaaaatggtattcttaaagaggagatgtgtgaattaatatgcagtggcacatagaattaaccaggcatcatcattttatttcagaagcactcatatgattaaatttctgagctaaaaattcatccttaaaagttatactttagcagaatgactgattttattttatagctgtcaatttgattgacaagtaggatccatcaagtgtgtttctattcttgtaatccagggacaccttgaaaagatttcgcaagagaaaagaaagaaatattatagaaaaaaaaaaggaaatcgcatgtctaattaagagcttaatttgtgatgaaaatacataattttttttttacatccactatggtgctaaaacaactacactggaaaaatcccttagttatggggtaattggtatgaatcaaatatctttcttatttagaaaccatttatagtgctgaattcatttcatttatagtagtgtcattttgtatttttatgcagtttgaattggtactgttttctaattgcagcaaggactttactgcataataatttaaaattttagctttgtaatagctcatgaaaatattcaatattttgttttgttgtgatggttaatattaggtgtcaacttgattggactgagggatgcctagatggctggtgaagcattgtttctgggtgtgtttgtgagggtattgccagaggagactgacatttgcctcagtgagctaggagaggaagacccaccctcagtgtgggttagcatcatccaatcagctgccagcatggctagaataaagcagggggaagaaggtgggataagctggcttgctaaatctgccggctctttttcttttgcctgttttggacacttgcttccactcttctgcccatagataccagactccatgttcattggcttttggaatctgtgacttgcaccagtggcttccccagggctgtcaggccttctgcagcagactgaaggctgcactgtcagcttttctggttttgagtctttccaacttggactgagaaattataggcttctctccccaacttgcagatagcctatcatgggacttcaccttgtaatgatgtgatccaattctccctaataaactctctcctatgtatacatagatccaattgtttctgcccctctggagaaccctaatacaatcatatttactggtgtatttagtgctagatgtttacatgatataatggtgtgagttctcaagaatctgagataaggtcttgggtgtaggtagtttacttggaaggagatcccagggtcaggaatgagagtgaagagtgagaaggaggaaagggcaatgtacgagtacgttttcaaggtcatgcctctgtgagcaatgtggactagattccactggggattgctcctaagaggcatagagaatacctcttaaattatctgtctagggaagagcaggcaagaacatatatccactggttcttctatattggttaacactccaaggacattaactccttctcacttccaggctgcattaacttacctcaaggcaaaaggtgatcagtatagaacaagcctaaaagctcctaagaacagtccagtagctatggctgaactcagaggtgggtgcagaggctgtgaggtggagcagcagagggattctgttaggcaggggttatgtaacatgattgattccgcagcccaaaggagaacttgacacccaaatagcaccaaaaacaatagatttcaaatattttctcttgtggacaatacatacattacagttatttatgtgtcgcttaatgacagggatatgatctgagaaatgaatcattaaatgatttcatcattatgcaaatgtcacagagtgcacttacacaaacctagatggtacagcctgctgcaaatttaggctacctgatacagcctagtcctcctaggctacttaacctgtaccggatgtgactatactgaatactgtaggcagttgtaacatgatggtaagtatttatgtatccaaacaagaaaaggtatagtgaaaatacagtattataatcttaagggattgccattgtatatgtgagcccatcattatccaaaatgtcattatgtgacacatgactgtatatgattctactgggcatacagagacaaaaatttatgaaataatacccttgctgtgcacaatgaggtctgatgttttctattctgttctacgctgtgttattctgttctatttaattaaacactgctcttcataactccctaaagtaatttttaaatccatggtttggaaaacattggccgaaaagataattaatttacctaagaaggtaaatattagcgtattaaaaataatggaaatcatgtaacctaagccatatacagtgagatgtttagaaataaaggtcatagttttaaggtcaagaaagactcaattcttaagaaattagaaaatagagtagcatggtttaaatgtgtaccatggttctagatttcatctgtcagtgtttcagaatctgcaaatggataaagaacatctagctccctaagagaattaacagggagggaacacagaagggctgaaaaatgaggtgctgttctccttcttttacctcagctgctgtgattcctgctatcccaattcatatacatatagtgaggagaattcgtatatacagcctgtataagtatgtgtacatatacacagccagctagatgttaccctataggtagagcttcctagtgccctatctcaggatccttttgcatcttatgtttgtttcaggttgttttgacagttgtcacttttaagcttcttttctcttttcatagagaaagagctttcagtctcctaagaggatagctctattatcataatcaccttttagaagagaaaattacctgtaatttttatgctctgaaggtgtgtcatcataattcagccacccactttaccctcaaaatcaaatggatttttttaaagaaacttctttattctttcttattgcattttctttggaggaaatgagagcttaagaatatgggaaatcccatcaagtttctatgagctttgctgcctctttctactgtcagctgttgtgtttaaggatatcacagccacagtgatctgcaagcactgctgttgtaagacttgtctcaacagagtacagtttaaagagtaagtgaacaagtaagggaatagtaaccctcacacaagccataactttccatcagatccctcatgcttacaagctccacctttgctgttgtgtacacagctcctcctggaagcccgacctccccatcccaccccagcactcctgtaaatctgtctcatgggaaagataacacaggagtgtgtgctcacaggttaccaatcaatatcaatatttcaccaaatctcagttgtaattgattatcttccagttattggagaataaaccccaaaaggggtggataaagggaaaaaatgcaaaaacccagaatgtcatgtgccttttgccagctactgctggatgtgttctacaactgagtacacagctgtttctaataaacactattagtactaatccttaagcagttattgccttctcctcattgcagtagatcctccagtatagcaatctgaaaaactgacctcattgtcaagtcaattggtgtcttgtgaaatgacaatttggtggtaaagtaactttcgcaaagtgttgcctactacagattctgaaaagtatcaaggttaaaaaatttatttaacttttcaaacctagaatttctcacatttattatttcatgggccgggcgcggtggcttacgcctgtaatcccagcactttggcaggccgaggcgggcagatcacgaggtcaggagatcgagaccatcctggctaacacggtgaaactccatctctactaaaaatacaaaaaaaatagctgagcatggtggcaggcgcctgtagtccgagctatttgggaggctgaggcaggagaatggcgtgaacccgggaggtggagcttgcagtgagccaagattgcgccactgtactccagcgtgggcgacagagcgagactccatctcaaaacaaacaaacaaaaaaaacccacatcttttgattcttaaaggacagtgactatttgcacaactcagtatggaaaataaggttttgcccagcgtgccattttttatcacgtgggtgcctttacactcctttttctacgatgctttctccaagttcccttggaatattctctcatcccttcaaatgacagagcttcctatgccagataatttttttattgtaccaccaatgtcaacctcagtgacattggccataaactacaaaatcatggctatatgtatatgcaaataaaaaatgtcacagtactgattttttatttttgtcccttgattcacttggtgtctcggtgtgacttttcaagccccagaggagtgaactccttttctcctttcctgtttccatccagctggttccagatcagcatcaaagtgaaacggatttgggtactgaaaaggtaatgagcttcacttatagggagaaggaaaacagaggatacagctatgcatattggttattacttacttccttgagtataatccttattcatttattcaaatatcatcatcatccttttgtttgtagtagtactggtagtttgttgagactctactttgtcccaaatattatttagagcatatgtaaatgttaattttttcagtcctcacagaaaccctataaagtatgtctcacattcttcactctacaaataaaacaggccaagaaaaatgaagacacttgccccagtcacatggtaatatatggcagaaccaaaaatcaaacttaggtcactttagttcaaagcttttttttttccctccactatgagctactgctctccaggcttgatcatctcttgggtgctagccactgatatgctccccagattccagtggctttcattcatggcttctacttcaccaggaagtgcctgtcctttagccaaagagaaaatacttttgtttttgccccagtttttttgtcctggtagtggggctaaagatggaaattcgccatttgtttctataatagatactgataaggaccaccaaaatgatggaaaatgtgcaagcttcaaagcaaaagcctacaagaagggagtataaactgaaaaagttacattagatagcacagatttgctgggctcaaaatatatccctctggctgtcattagcacagaactatagtaggatttaagaaatgtttgaagaattcatggcaaaagataaaatgtgttatccagttgcaagacatcatagagaccatgagggaccacatttgcaaatatagttcattctgacaacagttgtgtgtgcatcttaggacagtcattacatatggttagtcattatttatggaatatctattgtatacagatgggttggtagttaagaaggaaatattctttagctcctgttgctacaaaataaacattgatcagtgtttacaccatgccaagaaagtatttgaatattaaaatctcaattcactaaatggtggtatgtggcaacaaatggtaattaaaataaatatttgataggtttttattgtttaaaatgggaggcaatttagtgagagttataatacacagtggtataataaaatggctaataaatttcactgttttttaagaagtggagaaccaattagacaaagtacttctcatttattttttaagagagaaagagagtgtgtgggtgtgtgtccattcacacatgtcactacacattaccctagaacactgtggggtttagtaagacccttttaaatatagaatgccattaaataaaaatacagaaactagttttcagtctaaatatagtaatatagtaactgcttgttgcacttattgtgaatatttcagaggataaaccatggcaaatcgttcaatcctttccttttttctgtactttgttaactcatggtaaatttaacctgtttttctctcttaaatctaataatttttattcttttccttcataattaacagtgttttagatagtattttaaataattttatacaaagtagtttacactcacaagattttttttaaaattcaaaatatttgatgaggcagccttttcagaaatgtcaaagtagtaatgcttaactaaagtatatagcagtttaaggacaaagagaagtcaatcattatccatgttgacaacatgagtacccaccaaaatataatttttaatgaggtacacaattagctgcttttatatggatcataatataagttctgccccatcccccactccatcattctatgatgacaaattactatttttgaatgttggggaagcgctagcaagctctttctttgttcactcagtaaaacaggttttatatggctcttcaaataactcctaaaacaaacttattataagacatgacaagtaaaccttcctgcttattacttttcataagcacatcttcaaaaatgtccaaaaaaatgtaaggtcaaaaggataagggtggggaaagcttgtacaagataaaagttaaattctttgggaaggcaaccattccgatgatttaaaaagcatttatgtaacatggtgaaaccctgtctctactaaaaatacaaaaattagccgggtgtggtggtgggtgcctgtagtcccagctactcaggaggctgaggcaggagaatggcatgaacccaggaggtggagcttgcagtgagctgagattgcaccactgcactccagcctgggtgacagagcgagactccgtctcaaaaaaaaaaaaaaaaaaaagcatttatgttgatgattgatgagacacagaaagatatttgctatactagaagtttacagagtttctcatatcctcctcaactttcttgttttcagtactcttttcaattaggaatgataggaaactgtatttcttttccttgatggagtaacaaagggtgataggaatactccttatttaataatgatgtatgttatacatccatggtcttcttggtcgttcattcctgagctagtttctaaattagaacttgattcatctaaaaatggggtggattcttaaactagggacttacaggaaaaggcaaccttttagttttctgcatattgtattcaactctggaatcttgtgtccagttctgggcatgttcatagatttaattcatgtcaacaaatatttactcagtgccactttatacataaaacactaccctaggactttggttgtccaatcaagatcctatcacattctatattatgcaaataactagactttttacaaactgaatggctttccctggcctcagtgtatttacaaactagtagaagagacaaatacagaaacacataattaaaatacagaaaaataaatacaaaattagtatatggatagcatatgaaaggtaaaggaggtcccaatcccgccctctagtcatggaaaccacgagttcgttattaatacaaagtcaatggagggtaattgagtgacaggaagagagacaggtgctgggcagaaaccacatcagtgcacttgtgacattttatttaatggtaaattctatcatattcatggtaattgcctgtgactgcaaaatgaggaaaggttacatgtatttgtcttctcatcattatcaccactgtaaacttttttctaaatacccatatgtgggtggagctaatagaagccccacatttttgttagaaccattgtggtcacctgagaactcgtgacctttttcaagcgggaaggtacctctctggtagctttatgtattatgaatttgaagggacaagcttgggaacagaaagatcagttaggaggtgaccataggagtcacgtgaaagctgacaaaagcctgagctcaggcagtagtgttacagataaagaagaagagatggagcaggattcaaaaatatatatgtatataaacttacttgattagatgaagtacatgaaggaataaaagactactcttaggattatagcttgggtagtagcaatttagtggtgtggtactatgacattaatgggaacccactgaacatcaaaagaatatatttatacttttccatattagcaaaacctaaagaagactcagattaataggcaaataccaaacaaaaaaatgaagagggtacttcagaagtacctgtttacttattgaaagtagtatctgtttactcattgaaaattcatccatttgaaagcgtttacaatgttggtgggagtgtaaattagttcaaccattgtggaagacagtgtggcaattctttaaagacctagaggcagaaatatcatttgacccagaaatcccattactggatatgtacccaaaggaatataaataattctgttataaagatacatgcacacatgttcattgcagtactattcacaatagcaaagacatgtaaccaacctaaatgcccatcattgataggctggataaagaaaatgtggaacatatactccatggaatactatgcagccataaaggggaacaagatcatgtccttttcagggacacagatggttcctggaagccattatccttagtaaactaacgcaggaacagaaaaccaaataccacatattctcactcgtaagtgggagctgaatgatgagaacacatggacacatgaggggaacaacccacagtggggcccttcagtgggtagtgagtggaatgagggagagcatcaggaagaatagctaatagatactgggcttaatatctaagtgatgggatgatctgtgcagcaaaccaccatagcacatgtttatctgtgtaacaaacctgcacatcctgcacataaaagttggaaagaaaaaaaaagaaaattcatccatttgaaattcatgtgctacttttttctccccacttattatttgattttgttgagtgtattttgataacaacatgaactgtgaataaaatggcatgcaattgaaaggcagtaattgctaggtaagtaatactaagtaggtatagtggggtcatatttttaatcaagtgataaatagttggagagaacaaaaatgaacagccttgttatacatgcaaatgtcataacttcattcagttttatctgtctagctgtatgcactatgtggaagtgaatgcaagtcaaattcatgaagtaattatctagattaagaactaaaaggattcagtgcacttgattgttgacattttatttaatggtaaaatctatcatcttcatgataattgcttgtgactgcaaaatgaggaaaggttacatgtatttgtcttctcatcattatcaccattgtaaacttttttctaaatatccatatgtgggtggtgctagtagaatcaccacacttttgttaaaagcattacgtttgctttctccaggataattctgacaacaatagtacaaaacttatcatcttttattttggtcccttacctcctctatttccaataatttattggtgtctaatgtaataccataacctgttctcccaagctccatttctgtggttattttctccttttccttcttccttctcctttgatacacaataccatcacatgttgctgatctttccactgcactgccttttttgttcaataaaaatgtaaggtccccagctcacatgtatgcttcagtgtgcagctccagagctgctgtccaatatggtagccactagccacatgtgactattgaatactttagatatggctagtcaaaattgagatgtgctgtaaataaaaactacataccagacttgaagactttctccaaaataagaatatttaaaaagtcattaatgatttttaatttgattacagtttgaactgataatactttgaatgtattaaataaaatgctatttaattagttggacttttttgtttttaacatgcctattagaaattttgaaattgtgtacatctcctacatctgaggcctacattgtttttctattggacagcattgcaataaaggacactagagttaaagagggcatgctctctgctccaagactgtgcagctagactaactataatatcataaattggagccaggcttggtggctcatgcttgtaatcccagcactttgggaggccaagacaggtggatcacctgaggttgggagtacgagaccagcctgaccaaaatggagaaacgctgtctctactaaacgtgcaaaattagccaggcatggtggcacatgcctgtaatcccagctactcaggaggctgaggtaggagaatcacttgaacccaggaggcggaggttgcagtgagccgagatcacaccattgcactccagcctgggtaacgagctaaactctgtctctaaatacatacatacatacatacatacatacatacatacatacagtgatatggtccataggagagtgtaaagagaagagtgagtaaacatttctaacagggcatttgaggaaagatccatggaagaagtgatattgaatcatcatagaaggagggcaatggtgttagcatttcaagtacagaagacagtgtaagttaagtcttggtgacaagaaacaggctgctgaaacagtcacctcaaatattattttatcacatcactgctctatggccaaccatagaaaaataaaaatctatccagaaaatattttaagcttcttaccagtttttcttaaaagcatctgtttctacttccttacctactcccactgagaaaaaaaggttcctctcaggccgggcatggtggctgacacctgtaatcacagcacattgttgggaggccaaggcacgtgggtcacctgaggtgaggagtttgagaccagccagaccaacatggtaaaactccgtctctactaaaaaatacaaaaattagccggacatggtggtgggtgcctgtaatccgagctacttgggaggctgaggcaggagaatcacttgaacctgggaggcggaggttgcagtgagctgagatgtgccattgcactgcagccggggtgacagagcaagactccatctcaaaaaaaaaaaaaaaaaaaagtgcctctcaatgaggtgtaaaggtagtggtacttacggcagactagaaagatgctatgtcagtcgtgctgctagggacctctgaggagctaaactctggttttagctactgaaatgggaaagaagtagctcgcctgtacccatgcttaactccaggagggaggggaaacacaagagtaacacttcccaatagtatgtctcctgagaattgggatatcttatggttcaccataaagtatctgttgagtaaggaaacatgaacaaaggaaaaagaggcagatagaaatgaagaaagtagggaaaatcaattctaaaagacatgttttatagataataagaaactaattaggagcataaaagagaattgagggttatagctcaggcagtgcagtatcctccacaggtttgaattcaggcactggcctgtgctgcccttaggttgtaggcaagctgcttaccctctctgactttcaattccctaatctgtaaaaagtaaagtctaagaattagaaacaaggtaaaacatagtgtctggcactctgtaagtgttaaataaatgttaattttatgttcgaccactgtttgctaaataattttgaaatgtatccttttttggttgattccctgggaattcagttaggaagagaggaagtcaaattgtctctgtttgtagatgacatgattgtatatttacaattgtctcggcccaaaatcttcttaagctgaaaagcaacttcagcaacatctcaagatacaaaatcaatgtgcaaaaatcacaagcattcctatacaccaataatagacaaacagcgagccaaatcatgagtgaactcccattcacaattgctacaaagagaataaaatacctaggaatccaacttacaagggatgtgaaggaccttttcagggagaactacaaatcaccgttcaaggaaataagagaggacacaaacaaatggaaaaacattccatgctcgtggataggaagaatcaatatcatgaaaatggccatactgcccaaagtaattatagattcaatgctatccccatcaagttaccattgactttcttcacagaattagaaaaaaactactttaaatttcatatggaaccaaaaaagaacccgtatagccaagacaatcccaagcaaaaagaactaagctggaggcatcacactacctgacttcaaacaatactacaaggctacagtaaccaaaacagcatggtactggtaccaaaacagatgtatagaccagtggaaaagaaaagaggcctcagaaatattgccacatatctaccaccatctaatctttgacaaacctgacaaaaacaagaaatggggaaaggattccctatttaataaatggtgttgggaaaactggctagccatatgcaaaaatctgaaactggaccccttccttacaccttatacaaaaattaactcaagatggattaaagacttaaacgtaagacctaaaaccataaaaaccctagaagaaaacctaggcaatacccttcaggacataggcatgggcaaagacttcatgactaaaacaccaaaagcaatggcaacaaaagccaaaattgacaaatgggatctaattaaactaaagagcttctgcacagcaaaagaaactatcagcagagtgaacaggcaacctagagaatgggagaaagtttttgcaatctatccatctgacaaagggctaatacccagattctacaaagaacttcaacaaatttacaagaaaagtacaaacaacccatcaaaagtgggctaaggacatgaaagacacctttcagaagaagacatttatgcagccaacaaacatgaaaaaaagctcatcatcactggtcattggaggaatgcaaatcaaaaccacaatgagataccatctcacaccagttagaatggtgattattaaaaagtcaggaaacaacagttgctggagaggatgtggagaaataggaacacttttacattgttggtgggactgtaaattagttcacccattgtggaagacagtgtggtgattcctcaaggatctagaaccagaattaccatttgacccagcaatcccattactggatatatacccaaaggattataaataattctataaagacacatgcacatgtatgtttattgtggcactgttcacaatagcaaagtcttggaaccaacccaaatgcccatcaatcatagactggataaagaaaatgtgggacacatacaccatggaatactatgcaaccataaaaaaggatgagttcacatcctttgtagggacatggatgaagctggaaaccatcattctcagcaaactaacacaagaacagaaaaccaaacaccgcatgttctcactcataagtgggagttgaacaatgagaacacagggacacagggaggggacatcacacaccggtgcctgttgtgagggtggggagctaggggaagggtagcattaggagaaatacctaatttagatgatgggttgatgggtgcagcaaaccaccatggcacgtgtataactatgtaacaaagttgcatgttttgcacatgtaccccagcacttaaagtataatttaaaaaaagaaaaagagatggtccactctaagagaagtggagccaccaaatctaccttaaaaagaagtaatcaaaaacctcaaatgaataagcattctaaagtggatatactatctaaagccatacaattaactagttaactatcacgggggagccagagtaagtatgttaagttctcttctattcattaaaccactttgagtgtaccatctgtttcttgctgggatactgagtgataaaactgataaatttttgttctttttttgtacttgttttaaaaatcaaaatgtgcgtctacaatgaaaagcaatgacagtttgagttaccaaagtgctaagggatttgctactaggatgggtaccaacaatgttagtaaagtcagtggagctgccctctgtaggctagtcctgccctccatagacaaaagatactgctgaaggactggcttccctgagagcaatgtggtggtatgctccccagatgaaagagactgtctggtagcacctgatcatcagaaacaagcaaaatgcaatgatcactgtaagtgtcacgtttggagataaaaggcaatcctgtactttctacctttaaaaactacagactttaaaaaaaattgaagacacacaagaaatggaaagatatttaatattaatggatcggaaggatcaatattattaaaatgttcatactacccaaagcaatctacagattcaatgcaatcactatcaaaatactaatgacattcttcacagaaatagaaaaaataattctgaaatatatatggaaccataaaagacccaaaatagccaaatccattatgagcaaaaagaataagactggagaaattacattacctgacttaaattatactacagagctatggtaaccaaaacagcatggtactggcataaaaatagacacataggctaatagaacagaatagagagctcagaaataaatttatacatctgtagttaactcatttttgccaagggtgccaagaacatgcattgaggaaaggatcgtctcttcaataaatggttctgggaagactggatatccatatgtagaaaaacgaactggaccactgtctctcaccataggcacatcaaatcaaaatagattaaagatttaaattcttagacctcaaactatgaaactactaaaaggaaccattgtagaaactctgcaggacattggagtgggaaaagattcaattagtagtagctcaaaaacactggtgaccaaagcaaaaatggaccaataggatcacatcaacttaaaaagcttctgtacatcaaaggaaacaatcaaaaaagtgaagatacaacccacagaatgggagaaaatatttgcaaactatctatctgacaagggattaaaaaccagaatatgtagggagctcaaacaactcaataggaaaaaaaactaataatttgattaaaaaatgagtaaaagatctgaatagacactactcaaaagaagacacacaaatggaaaacaggtatatgaaaaggtgctaaacatccttaatcatcagagaaatgcaaaacaaaactaccatgagcatctcaacctagataaaaatggcttttatccaaaagacagatgacaatgaatcctgctgaggatctggagaaaggggaaccctcatatgctgttggtgggaaaataaattagtacagttctgttggagaagagtatggaggttccccaaaaatctaaaaataaaactaccatatgatccagcaatcccactgctagttatataccccacagaaaggaaatcagtatattgaagagataactgcactcccatgtttattgtaacgctagtcacaatagccaagatttgcattcaacctgtccacagacaaattaataaggaaaatgtggtacatatgcacatggaatactattcagccatgagaatgagatcctgttatttgcaacaacatgaatgaaactggaggacattatgctaagtgaaataagcccagctcagaaggatgactattgcatgttctcacccatttgtgggagctacaaattaaaacagttgaactcatggagatagagagtagaatgatggttaccagagactggaaagggtactggaaaggagagaggaaaatggggttggctaatcggtacaacaatatacttagatacaatgaataagatgtagtatctgatagcacaacagggtgactagtcaggaataattttttgtacattttagaataactgagggaatacaactggaatctttataactcaaataaatgattaatgtttgcagtgatggatatctcatttaccctgatgtgattattacacattgtatgcctgtatcgaaatacttatgtaccccataaatatatataccttctatatagccataaaaataaaaaattaaaaaaataaaaattaaaagaaaatactaggagagtattttattccatcaattctaaaacacacctttttccttcctgttgtttaaaatcactgaacccaggatatgtcttaccatatttgaagaaagaccatgggtcctagtgattgcaaacattcttttgctcatcttccgctaaaatcgagatgttccaacctcaaagcctgaagagtgaaacctcttaagaaatattcttgatgtcccagagaatgaaacaggtgggaaaacatggacaacaatacctccaacttgaaaagtgattcagaagagttagaccctgaaaatgaggaactttggcaataacttcacagcattattgtgcttatattttctttttatgtgtgactagaatgaatataataaaaaatatatctaaatcagtcaaatattttagcagttgttaaaggaaatactaagatatgcaaacatgtcatggtttaattttttcctggtggtacacaaaatactcataccttttgctattgatggagtcttacattctatgaaatacatttatttttttcaaacctattgtaaaagggtacataaaagataggacagagcaacaccctcaagtttgtaggatattcttatatatccttaggccaaggcaggctaagggcagaggcatgaggtaagcaaaatatatctttgattttgactttctgttctctctcaagtagagagaagcaggtcagtgtaactaaagggcaaagaatttggagtgcagtttagttcttgctccagtggttgctggtatgtggatgtgtgtgggtcatgtcaactctgtgttttttctgaggatactgataaggttcattaaaagtgtatttgaaaggtgccataaaatactattaaatcattctttcttctttgcctgttttacaaacagaaaagaaactcagtatagtttgtctcaagggagattactatattgttacctattcacatccacagtcatacactgtgactaaccagttatagcctacagtctacatgtggccaaatgtttcagagtctctaggagatagaggaatgctcccctaggaggagttgaggaatgcattttcaagagaggactgataatatttctaagagagattccctgattgccttcgatatccaagtttgggcatctcattgccaaggttccttctcctggcctgcttcctcagtctttctccccagctgttgagggctgtattccctgtccaagctcctcctcctttccaaattagttccaatcagttcccctggcctgtccccaccactcggtcagctcgctcagtacttctaaacctcatgtgtctgctccgtatctctgttcttcagagccagtctttctgtatcttcagtctagtaagtgctgctttcataaactagacttaaaatttcatcgcattttaataaaaagtaattactttatatatgatctttaagcagctattctcttaaagaggtactaaatggtgagactttctggtaagggaagaagagagaatgatgccttgaccagtgtttgaggagttaacttcttgagaaaatattgcttacagtctggtaccaacatattattggcagtaatattcattaaacattgttagcatattcgtagtctctaaacaatggctttcaaatattttgactacaactcataataaatacattttacatcctgacccagagcacacatatatgtttatgtatataaaaagtacatctaactaaaaaagattcatttaaaaaaataaaactcctagccttacaactcactaaaagattgcaaccagcagtttaaaaaaccgtgatacataacatgtccttttggcaagtttgaacagcaatgtgtttggtggtttatgttactcgctggaaaacaagcgtttttgaaaccattatagtgttgaaagaaagtataacaaataatcttagattacagttgtctgtgattattccaaatctgaattttccattcctgtgttatttttctcagggactaaatttctaaatgtgattttgtagcagatgaatgagacagggaaagtaaggctattgtttttatgaaatctaggctacattttattccaatcttgtttctgatatcttttctcttaaattgatgttatcattcagcttccattaagaaatgacttctgcatccatttgccttgtgtgtatatgttcacaaatgagtcaatcatatttcattccttaatttctgtagtgagaaaaactgtccatcctaaaggaagaacttgaagaatttcttgctctcctaatggtttttcactaaatccaattctactaaacatgtcattgttaggaataacattttgttttgttttatttcaaggatatgcttcatcatcatcattaccaccatctaaatgcattgttggcagtatggaaaggcaacaataatctttaacatttaaatattttctagtaggttacagatgcattaaatattccattttgtcttagtgaacaaattcaataaatgaggctaaatgtcttatgaagctaactttatgtacttaaaattgaagaatatgaatataaaaatatactatatttaatccatctttagttaatttttgtaaggaagaggtctagtttaagtcttctgcatatggctagccagttatcccaacaccatttattaaatagggagtcctttctctattgcttgtttctgtcgactttgtcaaagatcagatggttgtaggtttgcggcctgatttctgggctctcttatctgttccattggtctgtgtgtctgtttttgtaccagtaccatgctgttttggttgctatagcaggtagtgtgattcctccagcttggttctgtttgcttaggacttccttggctatttgggctctttttggttccatatgaattttaaaatagttttttgtaattcagtgaagaatgtcattggtagtttgataggaatagcattgaatctataaattgctttgagcagtatggctattttaacaatattgatttttcctatccatgaacatagaatgtttttccatttgtttgtaccatctctgatttctttgagcagtgttttgtaaatctcattgcagagatcttttacctccatggttaattgtattcctaagtaggtagtttatttatttatttatttggtggctattgtgaatgggactgcattcttgatttgggtctcagattggatgttgttggtgtataggaatactattgatttttaaatattaattttgtatcctgaaactttgctgaagttgtttatcagatcaaggagttttagggtagagactatggggttttctaggtatagaatcatattgtctgaaaacagggttagtttgacgtcctctcttcctatttggatgccttttttttctttctcttgcctcattaccctggccaggacttctagtactatcttgaataggagtgttgagagagggcatccttgtcttgttccggctttcaagggaaatgtttccagcttttgcccatgcagtatgatgttgattgtggatttgtcataggtggctcttattattttgaaatatgttcattcaatgcctagcttgttgaggtttttaacatgaaaggatgttgaattttatcaaaagccttttctgcatcttttgagttaaccatgtggtttttgtttttagttctctttaggtgatgaatcacattaaaggcataaatgtataacctaaaactataaaaaactcaggaggataacctaagaaataccatttcagacataagactgggcaaagattttatgaggaagatgccaaaaacaattgcaacgaaaccaaaaattgacaaaggagatctaattaaactaaagatctgcacaccaaaagaaactatcaggagagtaaacagataagctccagaatggtagaaaatataaggtctaatatctggaatctgtaaagaacttaaacatatttccaagccaaaaacaaacaacttcattaaaaagtgggcaaaggacacaaacagacacttttcaaaagaagacatacacatggccaataagcatatgaaaaaatgcccaacatcactaatcattagagaaattcaaatcaaaaccacagtgagataccatttaacaccagtcagaatggctatgattaaaaagtcaaaaaataacagctactggcgaggttgtggagaaaaacgaatgcttatacactgttgatgggaatgtaaattagttcagccattatggaagacagtgtggtgattcctcagagacctaaagacagaaatatcattcaacccagcaatcccattactgggtatatacccaaaggaatatacattgttccattataaagacacatgcatgtgtatgttcactgcagcactattcagaatagcgagatatagaatcaacctaaatgtccatcaatggtagactggataaagaaaatgttgttcatatataccatggaatactacacagccataaaaaaagaatgagagcttgttctttgaagcaacatggatggagctgaagccattattgtaagtgaactaacacaggaacagaaaaccaaatatcacatgttcactctcacttttaagtgtgagctaaacatcatgtacatacagaggggacaacagacaccagggcctactttagggcagggggtaggaggagagtgaggatcaaaaaactacctatcaggtactatgcttgttacctgggtgatgaaattatctgtacaacaaacacccgtgacatgcaatttacctatataacaaacctgcacacttttaggtaccgctgaacctaaaagttttaaaaacagtatatattatatactataatatatatatatatatatatatatatatatatatattccatgctgattaaagaaagcagttttgtcattaaagaatgacatttttgcttatcacttgagaataatgtgcctgtttatgccaatgtagaaaatagactctaatttttcattcaacctatgcattccacaaagataattcctgagggttagaaatgtacatagacacaagaagattacaatcaagagaggaaacaggtttataaaaaataattaaaatacaatgtgatcccttagctagaccttgaaagacatgtagaggggaaattattccaaatgagacagcagttgtgagaaacaatatcaagatattttcactctttctagcctggcataattaattgtgattactctggcaagtatgacatcttctaaatttacaaaaacagctattttgtcattgagggaatcattttttgctgtgctgatattacaataataagctggcttgtgtcattgcagaaaatggtctgtaattaaatcttcctgaacttctaaagagcagtttccacaaaatggctgtatcttctaatttcctttccattttctcagcaagacatagtccctatgacaaaagtaagattttttgaatatatttctcagtttcctggcaaagttgctcatttgcaaagtcacacacccagcccacagaaatttaaaaaaaaacatattttagtcattcatttggcaatgctttttacacaaacaggtaattaggaacactgaaaagacttaaaagatcctcaatctgaagtgataacgctcagagtatgtattggataacggcagtaagacagcagtccccaccaattcttccttctagcttcaatccccatatcttcctcccacctaattccttcccaggttttaaaaagaataaaagactttaaaaaatgaatttgtggcagtatggaatttttatttatttgcttatagcatgtctccattactttaaataccataaaagcagacatctcatctgtcttatttattcctctatacctagcacatggaacaatataaagcatgtattacaaactcaacaaatatttggtgaatgaatgaataagtgaaataaatcaatattaaatgaagtaaatcttctccttggcaatcatacttttcataaatatgaagacattgtcacactgtcattcttatcaaaagtaagggagagggaaatgagcattttgtgattgtttaaacattgcagtcaacacttattgaacatccactacttcttacataaagataaatagagatagtccctcctctcagagtgtagatttagatggggttgcaaatatgcaaacagataagtgtcataatattgatcttcggtaattataaaatttacatcttcagttttaactattcagaagtgatctcagagtagttatatatagtaaatatatttttgcctaagcatgcatgcatttaaatcacccatgctgcaaggcttgagtagagagctagtcagtgattttagattagtgttcaccatctgcacatccacatggcttgtgttctgtctcattcttagataaacattttttgggaaaaatgatttgatgctgtggcatcatgaattcagggatttccaaatatttgtttggagttccaaagaggtgtcttctctatctcttcaggagaattgtcagagtctactatgatatatatgtactaaaatacaggaatgtacaagaaactgggatagcagagaggatgggatgataaactgtggctagtaaagggtgagagaaaggagggcaagaagtcaggagatcgtttgctgagaagttgtatgacacgagtgttgaagattaacagatcgaataggaaattgttaggtaattaaggtaggtaggatggtgcaagaagaagaaatagcatgtataaaatcccagaaatatgaaattatttggggaatttagtaaacaagaaggcatgcggtgttttaagagaaacagttataaaggtgggaggagcatcagatgaaatgggacatttacgaggagccaggccattaggcattatgacttcctttcacagggatctctagatattattagtgggaagttgggagccattgggagattctaatttgggagaaacctgttcagatgaatgtcttagaatgttttagaaagaaccatttggtagctgtgtattggaaatttgaaggggaaattggctggagtcaggtggagaaattagattagtgtgattggccaggtaagaggaggaaaatccctgctaaagtaggaacagtaggaatggagaaaagcagaaaatatggagacatttagaaggcaaaattggcaagatacttcctaagcgattttagtgtacaaagtctagtttctgaatataagttgtttttccttttatttttaagaaacctgtgattttttttccataaatgtgtatatcttttttcactgaattctttttaaatgactggagcaaaggagtccttgaaaaatgtgacctgagtactgtgtttagtagattgaaaattcttcaggggcataagaaattaagaatgtggttttcttccaagatcaagaagctaaggtcatctaatggagaagttcatgtcatccatcacatgttctcatcttgcagatgtggaaaaatgccagtggctggcttctgtttgacagattcagtgagcctgcttcagaggactctgagccaggaaactctcaaggtgggctgcatcccacaggacagctcttgaatttggacagctcttgaatctggtctcatgttgtcaggatgacttggctcaccacaacgtggatgtccttctttgtagcttccttctttcttcagaccttacacaggccctgctatgggaatggctcctgtcctaacagatttgcgttgatatcaaggactccttttttccacactttacctcatacttcaacacttgacttcttgtgcatctcttgcttcctagttttgttctgccattttgttctgaccaacagtcccaacctgttggctctaaaatttcacactcttcacttggcttcaggtcctcggttttaccccgattacgaatcttttaaatattcagttccaaaattattcatccagctctttttgtttcccatgccacatactctttggtaagtccgccacagccagaacatccagaaccacctcaaagctggtatctctcaattcagatttaactcttccattcaaaattatttcacaatctgccaccacctttatctcacccaaagggaacttgttaattttcctttagctcttattccaatccatgacaccaacccactaagccaggtttgggacacccttctttgtaatgctatctcttgtctttaatatccagtcagtcaccaagtcttatcaatttttctcctacatgtgtctctaatcagtctccttctttccattaccattaccacttaaatgtcactaaaaacttttagcctgtagtgtttcctgcccacccgcctaaggtcattctccatcctgtagcccatattaatactctaaaacagaaatacaatctgccaatgtgctacttaatttttgcttgcttacccaatatatatacacttattgatctgtttttctgtggtttttgtttttgttttgttctgagatggagttttgttcttgtcgtccaggctggagtacaatggcccggtctcggctcactgcaccctctgcctcccaggttcaagcgattctcctgcctcagccccccaagtagctgggattacaggtgcccgccaccatgactggctaatttttgtgttttttagtagagacgaggttttaccatgtcggtcaggctggtctcaaactcctgacgtcaggcaatctgcctgcttcagcctcccaaattgctgggattacaggcgtgaaccaccacgcccagcctgatctgctttttatgtgtcaggcactgtgggaggatgcagtgttatcacaataaataaaatatacttagtcaatcttatactcttgatgcctttcagaatctgttaaaagcccttacagttcataaaatcctagtctgttccagcctaccagctgaaaaatggggtattgcaatgggtaagatctacttttcctcgtcctctccctgcccccagagtactgcacagtctgtggatgggtatataaaaggagggaaaaaaaaaaagatctggagtaagaaactagagtccactgctgtcattttagtagtcactggagagtcaagcatttaattaaacatgcaaatgcctgtcactgactacttttaagctcataatttaccatttcaaacatttggctcaaagtactctgaaatattactaacctccatcaatgggaacaaatactttattaatattgtgataaaaagtaattacatattaaaatattaccatatactatacatgatactctaccatggcttcatttttgttttgataataactttacgtgattaaattaacttttaaaaatatatttttaaattgaactatttggtataattctgataattttagaatatgtatactctcctaaatatacaccatgaaaataaatatcacagttagaattttagccaataagaatttatgtcgcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcctccagtgagccgagatcccgccactgcactccagcctgggcgacagagcgagactccgtctcaaaaaaaaaaaaaaaaaaaaaaaaaaaaaaaaaaaaaagaatttatgtcaataagaagatacatagaaatatcataaatatctgagttgttctctaccaaaataaaggatttcttaaataattcagtctgcaatcctaattatttctgcacagtgtaattaaatttctattgtgaaaattaatattcttaaaaagtaataacatcaattgttgcaggcttctttttaataaacatctacataaggtgtctgtatacttggagatatgcttatctgagtaggagaataagatttggtggtaaagctaatctagtaaatgaaatcaaatgagataatagatgcgaagggcttgacacagagtgttgcacactctaagtgctcagtaaaatgccagagatgatgaggatagtgatgctcacatctgtattgtcaggttatctcgttatcctcattttacacatagagatatgaaagctgcgagagtaacaatgactcactcataagggcaggcagataatatattgcataaccaggagtgaaacactgatttttcaaataggcttaaatccaagactcttaaaccatgctttgagcaagaacttctcaggatttgaaaaataaaaagccttgataacccagtgtggttggaataagcactcaagagcaagagagccacagcttcctcctgtgtaaacaggataaaggcacttaagggcaggtgaccagagagagtgagatggggccggagggaaggatagggtgatcagattcagggattggagccaatttttgtggatctagctacgtgacaatatgaaaaatgaacccaggtcaacaaaagttccttactgggttatagtactcttcttccttttaacttgagaagtagaagggtctgacaaattgagtctgatgaataaactcttgtgttggccaattctgcctgccatgtgcccttagactgcttgcagggctgaggcccacagtagctgtcctggccttttgctgtgttactggttcctggtgtacatctctgaaagggctcaggccacccttagataattccacaaggcaggtgccatggcttggatacactcacttgacccaagttagcttgttctgtttattcatatggttgtttttaacttggtagaaaaagtaaactgaacgggaatggaggaataccttaagcaagtttctgtcaaattattatttacttaaattcattttttaagaaactccctttacgaggtgaaacagttgaagaaaacaatacatttcaaatatctaattcaaaaagcatattaatttatgttcaaagatgttttaagaagtggtttaaattcatatttttactttttttttttgagatggagtttcgctcttgttgcccaggctggaagtgcagtagcatgatcttgactcactgcttcctccgcctcctggattcaagtgattctcctgcctcagcctccaaagtagctgggactacaggcatgcgccaccatgcccagctaatttttgtacttttaatagagacagggctttgccatgttggccaggctggtctcgaactcagcctcaggtgatctgtcctccttggcctcccaaagtgatgggattacaggcgtgagccactgagcctggccattttttacttaaatattgagtcactgctgtgtaccaggaaggttctggtgggtgcttggaatattacagtgagaaaaatgttgttatatctttgttttcccagaagtcagtactaagcaaaggagacaggtaatgaaaacaaaacaaaacagtcaaaataaagtgtaggaaatgttaggagagaagaatcgtgaatacagttcataccagggattcctaagttcctgatgaaaggcttcccaaagtaagtgacttctaagctgtggtctgaaaagtgagaaactatccagctagatgaagggttgagaaaaccagaggaaacaacttatacgcagacatggagcagggatgatggctaagctgggcctctgtggtgatgagaatttctcaagagaagtgttggggcacagtcagaggaaacaatcataaaggatcggggagacaaacagcttgctgtgttttaagatatgcagttgactttgtatcataataaaatatatcaaaataactattttaatagtcctataaaattacacatatataaacatataaataatagtgataaattcatttgctattgaagatattgctttggttaaaactacatatttcttattctgaatttcacatgtctgggggaatggggtcaaaacaaaacaaaccagtgctaaccattctggttctatatgcaaagggattccttaaaattgacattgtgtgcaacacacacacacacacacacacacacacacacacagaactggtctttgatgactattttgtataagttcttcatttagcaggtgctctttctgaaaaagaaaatttcctatttttttttcttttgtttgcttgaatgggatcgatgactggctaatcgtaaataaatactaccaagccttttatttcaaacttcagagctttcttctcaaagcccaggttaaaagaagagtcccagttaaatcaagtgacatattctagtccatagatttactggttcatggttctattattcttttattttgtactaagggcactatcaaaataaataaaaacatcacagctgtactgaaacactaaaagaaaaatcttgaattttcagtagtgattttagaccccactaccaagatttttttttctttttgcagccattaactagttttttaaaaatagctaaatttgggaggatctcaacatacaattttagaaagtctagtctgagattactttatcagttattggaataatctgacaagcagaagtaggactaggaataaagcattgattcaagatttcttgtttaaatggtgcttctcattctttgtttgcaaatcttgaggaatacaaagatgaatgagcatccagtccctttggtgtcaaaaatatcatgctgcaagtatttagaagagggaaagaggaacatttgtgcctggcatagcatttcctttcattttcatttattcttctgcttattaattcacttattcagtcaatcaacaaacatttaaagattgcctactcaatacaaaatccactagtgggtgttgatgatgcagcaatgatttggcactgaaaagaaacttaaggtaatggttctcaaaatttgagaaatctgtgaacttctttgaaaaggtgataggtactatgggtgcaacataggcatatctgtgctcataacttcagtggggctgaggaggatgccttgaagcccaccattggattccttgggacttatgaattttgcttagcaatttcttaattacagttttgttcattgtttgaattttgccatccaatccaaagcttttatccttattataaggttgatttcgttttcataattaacccctaaaagtaatattgggtcaaatcttaaagacacttctccagttgagagacctactgctgacgttaaagaaccaacctgctcagtaaaatgaacatgagcgccatctaatgcccaaacagaataaatgttggtaacaacattaatacacagaagattagagtatggggtgtatgtacaaaggaattaactttgttatcggttggttgactcatttctaacacttgttaattattttttgatattatcattttcaattattttatttcacataacagtcccttactgtctgaatttgaagataagaaacatttttaacaataagaaacattttgttggccaggcgcggtggctcactcctgtaatcccagcactttgggaggccgaggcaggcagatcacctgaggccgcgagtttgagagtagcctgggaaacatggcaaaaccccgtctctactaaagatacaaaaattagccgggcatggtggcgcacgcctgtagtcccagctactcggtagattgaggcaggagaattgcttgaacctgggaggtggaggctgcggtgagccaagatggcaccactgcactccagcctgggtgacagagactctgtctcaaaaaaaaaaaaaaatttgcaaatatgtcctttttattggtggagaagcatatgacttacatttttaaataaatttttgattttagaatgtttttcgtttttcagaataatttgcaaagatagtccatagaatacccaagtatcccacacccagtttcacccagaactaatatggtacaattgttacaattaacaaaccagtatcaatacattattattagctaaagtctacaatttattcatattttcttaattttcccctaatgttcttttatgtttcaaggtcccatctaggacaccacattacatttggtaatcatacctccttaggcttagttatgacagtttgatttacatttgatattgtatgtctttgaattttattttagctttctgttatttttcaaaatcttaaaacaatttaacttttcagaaaacactttcccttgttctgttcccttgataacactgcatgactatttaatcagttttataggggtttgtataaacatacattatcattatgcatcgttcatctctaataatgaaaaaaaagggttaagaaagaggattatcaaaatgtttaacttgccaagattgccaatataatataataaataaatgatgggtcagattccaaagcctatgacaccttccaaaaagctaacacatcttttggcatgcataagcttaaaatgccctccaccccagcaccatgctgctgcaagggcttctggaatgaccaacgcccaagacaaagtcgtttgcctttggagtcccattgcccctcacaagcactttttattttatataaaaagtttatataaaatactctataaatgagcctgggttgccacccaaactgttttgtgtttgccacgaaaacagatgtgctgaggtctcaaggaaacttctgtcttacactaactggaatgcattaagtctgaggagggttcacagttctgtcctagttgctaatattttaattaaacatatatttttgtggcctttaaaagccatcaggagatataaaggaatatttttttgataacttcagtgtcctgggagcaaaatggaatattgtgtttcctaattgaagaagtagtatatatgtgtatatggatgtgaaggaatttatagaatgctggcgaaaatgatttcctgggcaaacagtagaggtatataaattacttggatcctgcagtattgattatttgtgaatatatctgtaaaacattaagtgatttttgtacactcatagatttcaaccttggatgcatattagaaaccctagggagggttaaaaatcccaatacccaatcttcattccaaaccagctaaatcttactctccagtaatcaaattcaaaacagcaattttaaagctccccagttgattccagtgtgtagccaagagttctacattgtaactcaggggtttaatattgttcctgtacttttattctgcagcataaacttagctatgctatttattcttatttttaaaagaaggtatggcttacgaaagatgataagcattattatgtttaacaatcaaactcattattaaaattcctttttttcttatacttctgtcaaatgcattgttttttctctgagtaatttagatgaatgaattaataactgataaacacacatgtaatactatgagactcctttcctaaatccttttatctattttcaaaggattttatttctacatatttaaagttttttaaatcattttttaatttgtgcttctatgaaatttttttcttcctagaaattttattccggattatctgttaagagctgcattttgacagaaaatgattttccttattaactgagtgaattgataagtaagtaggaatattttccagtggtagtctcaagatagaaacttctaagagctttgaagttttagcaattaacagactttattaaaaatgaagccactaacaaggatattaatacaaggtagatttcaatctgggcaattatacaatatagacgtctttattactaactaaaatatcacagaatgatttgattaatgctataaatgtgattagtagaataagtgtatccttagtgccattggttagatagccaaagactggatgtcagagaaaggtttccaattcttttctacatatgagaatcaaaatcaaattatagaaaaaagtcacaattgttttcttgaattccttaaatatgtttttcatccttgaattctgctattactcttcattatagtggtcagtttgtgtgtgcttcaagtatgtcactatgttgttaaatatgtcagctgtctacatttctaacacaaaatgatcttttttttcaaccgctaagttatatgctggttatttctaagtacatgcatattcaatctaagtatctcagttgatttaaatcagtttcttactttgaaaagatttttaagactttttttgcacagaggtaaatttcagattcagcttataggccttaataataacactcctacagactgagtcaaatttaaatatcttatcaggtattaaatatatttaaataaaaacatacacattaatgagtgccctgtgagaaagtggtggtgaatttgagccatattgctatatccccacagcaatatctgacattttattcagtgccatcagctatatgattctagacatgccctcctaatcagtggtttgtagggttttatccttcctcatcagaaaatgtaaacaagattacaaacccactttcttccccaactgtaaaatattaattatttaaaattttaccgtgttttattttatacaagtgataatagctcatattatatggtctgaaattaccagtgatgagaataattatttggtcaaatactttctgtaaagttaaatttatctatgaatggtgcttctgtaatgttgacagtaaatacagtaagatattttgcccaaagtgctgtttgtcttagtgtattacttgatgtgacattctgacaccatcagactggaggctgagtcctctgataaaaagaaaaatgccacatagccacagaaattatttcaccctgtttccttgcacatctgggaaataagcaaaaattgtaaaagctgctagagtgagctgattgttttcttcctaagaatcttgagctttcaaaatttgaatttaaaataatggactttcttgtcagaaaaatattgattattaagaaaagaatgagacaaaaatgtaaaaagaaattttacttacctaattttattaaaggagtatttaataaaactttatgatacattttaactaattctggtgaaaggattaaatatttgtttcacccttacctcacaatgtgcacaatgattttaagctcctttctgttaaagcagttaaagacttttccaaagtctaaaatcttaatcacataaatctaaaagcaacacttaaatgcaaacatgagtgaagagcttacgggctttttctactaaaagactttcttctttttctattatagacctatttgaatttggacatttttcttgcacaaataagactgtttcaatacaaatttgaatgtattaacttgctagctcataatgttactcatggtttcagtttgacttgcacattccagaataaatctatttacttaattataaatgggtgtgtgtcattgtccttgacaccatgagaaatataatggctatcaggaagtgggggaaaggaacttagatcttttcgaatgtctactatgggcctgttgtttctctcagttgattctgctaacagcccacctaagaaagtattaatcatgccaagaaggtattatcattattatcttatgaatgaaaacttcacagaggtagctgaatgcctaaaattcacacagctagagtatcttttaagagtccttcttttgcaagtgacaaaataaataagctggcataaacaattaaaggaatccactgactcaaataacagaagcccagaagtaggactagctctctaagaggctagatatagctgcaaaattgatattaccatgaacttggcatctctgttgttctctttggtttcccttcccagcattggccttatcctcaggctctacaagcggatctgctgcagccccagtccccctcactctgacaactatggtgtcaaattggctctagccgttcactagaacgctgtaccgtgttcacaaatgtatcctgcactagctgggggaaaagaggatctctccttatagctctcttataattcctgagatttactcttatcttttttttttttttttttttttttttgagacggagtctggctctgtcgcccaggctggagtgcagtagcgtgatctcggctcactacaagctctgcctcccgggttcatgccattctcctgcctcagcctcctgagtagctgggactacaggtgtcctccaccacgctcagctaatttttttgctaacctcggggaactgtcatacccttgccagtttgggtctgttcctggacctgggggtggcgtcagtcccaccaaacctgcggagctgagaacgggagaaagcgaattgcctaaagaaaatcacaatgctattggctggaaaatttctaccaccgttaagtagtagagccaggattggatataaagtctgcactgtgtccgttatgcaacagaactaacaggacataacttcctccttctgtttacaactggcatctagtggtcagaggccagggacagtaatcatcctataatgcacaatgcaggccacccacgaaaaggcattatccaacccagaatgtcaatagtgccaacactgggaaaccctgtgctatatgatctgctgtggggcatattccctcagccttacaaactgcctccctcccctcttctttaagcagcagctaccttgaggggcctcctttcagttacaaaaatgtgccaaagctcttcaggctttaggatctttgaacattattttcactttacctggatgttctcctcccacccctctgactacagctgcatcattctttccaaacctagccaaaggtggggaagcattgagctcaaagagtattttcttgagaaagactactgattctccagagtgggtcagccccacccacctgtcagtagtgccctgccctcttttatactttaactttgtagcaatgatcataatttcaattagctattgtatcttttacagcaaatgaaaactctaaaacaacaaatgaagacttatttctgtttatactctgagcacttagaacagagtctgtgattaagattggatgtattttagatgaggcaatcaataagagtaaaagctcacaggcttgaatgcagcaagcagtttagggagtgtgctgagtagagcagtcaggaaatatttagtgtagaaaagcatgaacagtaagatggagaagggatggaaggtttctggtgttggatttaataattgtgtaactagtattttctgagtttcaattggaatatgctaactcttctgtgtagatgaagtaggtaaaaccagattaaatctgattttgtttatctgattaagtctgatgggcccagaagaaacagcctgaggcatcacttaaatttgggcattttttataatgcgctgaactcggagccaagtgaactaagatctagagctgagcctaacactaatgtactgttttcattgtgctcttttgagcttcagtctatttgtaaaatgagggagctggactaaaggatctgtgccgccctcctaatccaacactcctcctttactaagctaaaagagagttttggcttgctgagatggaactgtgcaagcattctacttttaaaaattgcaggaggaattttttttaatgcagttgtttgtgaacctggtaataaagaagcagaatattgtgagaataactgaatcttttgataattggggactttaacgtgtcccagagttttgcattattttatacattgaatatataaaagattgggtgatagatagcctaacctcacgatatatccttaagtttttgtgtttttcaataaatccctaggacaaatattttttttccatgaacactctcttaaaataaagtctactatgctttgtcaaagctttgatcagatgaaagcatttatatttctgtttatcctcgtttaccaagattaataggttgctagaggtctgagtacagagtttctcagtcttggcactgttgatatttggggctggaaaattcttttccagggctggggagctgttacaggaatttctaactctaacagatagatgccagtagcacctctccctcccagttgtgagaatcaaaaatgcttccagacattgccaaatgtccactgaggggctcagatgacctcaggtgagaaccattggtttagtgcaaagtaatctcctttaactagagcatactggccagatggatgcaaatattactgcttggttaacccatttaaacaaagttaaatcttgcccaaatgaatgtaaagccctcattgatagttaaatgtatctcactgtttgtcttactgctagatactcttggcacattctgaatgagggaatcagtgacttccttatataggcaacaattcctgggaaatctcaataaattatcagaagaaatgcaaaagaaaacagtctgctgattcagcttgtaagtttccagtggtatcgccttacttcccaaactaaataattctctgagtcctgttccatgataggatagtgactgtgggtcagtgctgtttatgtggttgttgatactcttgtgcctcttttagatagttttctaagagacaagacttttttttttaatgactgttcctctctatgaccctctgccccctcaaggatatcagagtttttgtcttcagcatttttcgggttataataaattataattctaaaaattaggctgaaaagaaagcctcaggtcttttgaaaggaggcagaaatagaactagataagcctttcaaatagttggtatggagtatggagtttgttttttttttttaacagaaagaaaagaaaaaaagagtgtaaaatgtgtcagtgtaatactcacttctgctctcctcctgcttgaaaagatcgctgtagtaattagaatctcaaacggacagtcttagcatctaaagtttgggtgtacttctagcaaacatgcattgcacaagataacaatataaattggccttctgaaagtaaacaaacccaaagaaatatactaatgttgggctgggcgcggtggctcacgcctgtaatcccagcactttgggaggtcgaggagggcagatcacaaggtcaggagatcgagaccatcctggctaacacggtaaaaccctgtctgtactaaaaatacaataaattagctaggcgtggtggcgggcgcctgtagtcccagctactcggaaggctgaggcaggagaatggcgtgaacccgggagacggagcttgcagtgagctgagatcgcgccactgcactccagcctgggcaacaggacgagactccgtctcaaaaaaaaaaaaaaaaaaaaaaaaaaaagaaacatactaatattgcagtgtgctttgctgattttagagaaaggtgctttacacttagtttgtttaagaggaatactgctactcagcatgttttgctttcagtccaaatagagaatccctcatcagaaacaggcttaagtttttcaaatagtttactttttttaaaaagtaggtctcacttctgcttccagccaatatggagtacagtgactagatttgcagtctcatctttaaaaaaactttttaaaatcaggacaaaacatacaaaagaacagttttcatgacagtggacattagacaatggaagatagtgattcctgagagataagaaacaaattaaatgagccctatgattgtcctagctaaatgccttgagaggcatccaggctgtggctcagggaggggcaaaccaggagatacccaacaaacttcttgagttgaagagatggagctgagagtcttgggagaccaaggaggctaaaggtcatagacagagtatcagagaagtaagagttgcaaaaagaccctctgacatcttccaaggatcctcattatgtattctgcagggtagtgattagtgcacatatgtgaagaaactacttgagccctggtgtgagggagatacccaaaagatcatatggaaaagcacctagcacttatacaggacttggaaaacaatgcctgtttccatcaggcagaatggaaaacctcataaatcaaggacactgcagagagtactcaaggttcttgccttagtaagggagggtaattagcccttcatgaaacactgttccagtcttgcctaacaaatcttaaaagcaagacttgaaaggaacaaattttttccaagtcattaaactgcatcccagaacaaagctcaataatatttatgagattataaaaatatccagcacttaagaagtcaaatttatgatatctggcatccaatccaaaattactagacataaagaaaatctgagacatgggactcataatgaagagaaaaattaatccaaatggataggtacagagctgaaacagatcttagaattagcagacaagggcattaaaacggtgatttttaactgtattccatattttcaaaagctaaattgatacctggaagatttttaaaaattccaaattgaacttctatagaggaaaattacaatgtctgagatgaaaaatatgttgaatgtgattaataacaaattagacattgcaaaagaaaatattataaatttgaagacatagcaatagaaattatcccaaataaatggagaaaattattttaaatgaatagatcatcagtggactttggaagtaattcaagctcctaacatatgtgtaattggaatctctgagagggagaggtagacagaaaaaaatattcaaagaaatagaaaattaccaaatttgataaaaactataaacccacagatccaagagctcaacaaacccaaaacacaagaaaaaaacatcaaggtaaatcataactaaattacctaaaactgatgataaaagaaaaacttaaaagcaaccagaagtaaaagatatgttatatatagaagaattaagataaagatgatagcagatttgttatccaaaatgatgcaagatgggagccagtggagcagcatctttaaactactgggggtaaaaaactctttaaacctagaattcaatatgcagtgaaagtatctttcacatatgaagacaaaattaagacttttaaacataaaaaagcagcgggaatttattatcagtgggcctacagtataagaaatatttaagaagtcctgtaggaagaagaaaaatgataccagatacaaatggatctacacaaagaaatgaaggtcactttaaatgataaatttgctatctttccacatcccatgagttggaacatgagggtgctctggatatgtgccaagacatgaagaaggaccaatgaaaaggaccaggtccttgaattactgaggggaatagagcagcctggcaatctggatgacccatctaggaactattattgaaagacaaataaaagtctatgttttcaaagtatctatattttgcagttttactgatactaccaattgtttcttaattaatacaattatttttaaagctgtgaagttatgtctgctacatcaagatctttaatttacttggaatgttttttccacataaaacaaagttgatccagagcattctaataaaaaagacatctttttctcacttatctgaaatgccaactcttttataaatctagcacctacatatgcatggcagcctttctgggttaaatgctccatttgtctatttgtttatatgatgctatccatgcactaattagatatgtttatggtagggcaaatactgtaacttgtcatctttctcagatatatcttgactctttctaccatactgaattttcaaataaattttagagtcaattttttaaaagtaggtgaaaaggttataaggggatgcagctaggtcacattagtttcaacctatctttttatgagttgatatatgcagaagtctccagccccaatacaagggttgttctcagactgacttttttccttacaaccagagtggcaaagagagcctggtggtgaaggggtgatatttggctacttggtaggcatctaggggtcaggtttcctccctccaaggaacactctacattcccctagaactaaggatatcatctcccacttgttatccattcgcttcagttatttggtgtagactgtgtcagtataaccccattactgttatcgtgtttaattatataacaactgtacactgagagctttttcaaggcatggaccagacagactaatcagagagtaaatacacagcacttaatttactcttcagaatttttaatcaatgcctattgactgtctcaagggttgaagtctctattttaactccattttaaaatggagttaaatggggaattcagccaatttattcaacatttatcactaatgttgaatacctgctttgctctaggtactatactaaatgtcgaatattcagcagtaaagaaatatatatactatatacatgtatataatatataactatatattatatatataactatattatatacatgtatataatatataactatatattatatatataactatattatatacatgtatataatatataactatatattatatatataactatattatatacatgtatataatatataactatatattatatatataactatattatatacatgtatataatatataactatatattatatatataactatattatatacatgtatataatatatataactatatattatatatataactatattatatacatgtatataatatatataactatatattatatataactatatattatatacatgtatatattatatataactatatactttatacatgtatataatatatataactattatatataactatatattatatacatgtatataactatattatatataactatatgttatatacatgtatataatatataactatatgttatatataactattctatacgtgtatataatatataactatatattctatacgtgtatataatatataactatatattctatacgtgtatataatatataactatatattctatacgtgtatataatatataactatatattctatacgtgtatataactatatattctatacgtgtatataactatatattctatacgtgtatataactatatattctatacgtgtatataatatataactatatattctatacgtgtatataactatatattctatacgtgtatataatatatacacgtatataatatataactatatattatatataactatatattatatacacgtatataacatatttatataataatataatatattatattattattatatttatagaataatatatattattatatatatataaatatataataatatatattattctataaatatagaatatatattattatatatacttatatataatatatacatagtataatatataatttatataatatataatatatataatttatatatattatataaaatatataaatttatatatatttatataatatatataaatatatataaatataaaaatataaatatatataaatttatatatataaatatatttatatatattatatacaatatagtatacaattattaataactatatataatatacatgtatattatatatagttatatataatatatagttatatatattatatacatgtatataatatatataactatatccttctctgatgggaaaatccaacatttaaacaaaataaacagaaatataaatatttaatttataattatgtttagtgctatgaaaggaacaaataaggttttatttaagaataactggagggagaaagtggagaaaaatatacttttcaagttagaccatattacatacagatgaaatctgatttaacctgtaacataaccagatttatgtagcaaattaaacataaattttttcatatacttaatctatttatttgtgtattcaatagcatttatcttctttgagccctataatgatccagctattaggctcacaaaaatgaccaggactcagttcctgtctttgaggagctcatagtttttttttattattattattattaattagcagtgcctttcattaaaataattgcataccaaatggaaacaaatatgttccttttcctctttcattcttctttagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccagtaagtgttctctggcctcctccttcctgtcttggcctttgttttgggctgctatgctgtcatctgtgagtccctgttctttttcttgatcctgtcattctccaagatattatgagtagaactgcccaaacccaaaagatagatagtaattgtgacacaaacttttatttgcactctgtgagagtgcatgaaaaatctgacatgactgagaggtgaatataggtttgtcatttcccacagtctctgtccttcttaagtatacctgtttaaaatacaggagagcaaatgttcttaaggatctgcattataatagaaatctcaatattttcaaaatgtttctgtttataaaaatggaagaaatacaatagaaaaggtggttggactgtttttttgaataaataaataaagtctttaaatttatatatatataaattataccttactcaaaatgcttgggaccacaagtgttttacggtttgaaattttttgagttttggaatatttgtgcatattacctggtgagcatcccaaatttgaaaatctgaaatccaatatcttccaaagagcatttcctttcagtatcgtgttggttctcaaaaagtttcagattttggagcattttggactttgggattttgaatgctctgctataccaggtacagagtaaaacattaaattctttttatcttaaaggtaatctttgacaacactacacatttttgcctcctgaattcattcttattttgtgtctggtagaaatttcccctattagatattaagccctgtatatgggcagcgactgtgtctctcacagtcataatgatgagtttggctcatcattatatccccaaacttataaaaatgtctagcccataataagcactctgtaaatatttatcaaattaatgaataaatacattgataagatggacattttcaaaattaacagcaaagaaaagcatgaaaatgtcttactttatcacactttggctttattctgggcattactgtacagctgcttaattaatttcatgttttaggtaacttagaatcatactgaaaaaaatgtatagtaggaatagtggccattgatttttctattaacatggttacaaaaaactcaagcagaaaatttgaatataaagataaaagttgactataataataaataaaatagtgatattttcaaacttttgataccaaattagagggtaatttggtatcagaaattccagagagggaatttaaagtttttagatgaaagcagatacttccagattctgcaaaatagatgagaaagaaaactgaaattacaaatataaaattaagagaaagtgcacattaaaaatacattttaaagctcttgctaagctcattaaagtagtggataccttgattttacagtttttgaataaagacacacctcttactaattttaaggaacccaagagattttgagggcctcacagacaacttctggacaaagtttcaggattctatctaatcattacttatctaagaactatatgctattttcaggatatttataagaggatttgcatcttttaaacttctcccaattttcccaacacaattctgggcatattacagatgatctgacaacaattaccatggcaaattgaattttgtcaaattctctagtagagatcagtgattctgatactttctgctctatacgatgaaaaaagttactgaagatcagctacctcactcatatcctattacatggttccatttattcccatcatggtattgatacttattttccatgtttgtgtaacttagtgtagatttatgtcttctgtgacaacttcacttaaaaaaaaaaaaaaaagatgtgtaaaagaatgggcccaacctgtgtgaggagttcatgccctgttgcttagacatcataacagtagctggctttgtttacatagtgatgtattaaaaaaaaaaaaaactctgccagccatacaagtctgtgcattttggtggtgactcagagtttttgtagtctttttcacagtttatgatgatccttagtgattaacaaggtctgaggaatgaaatcatttcaactactgcatacactgaagcttactgttgtgttattgttctgcaccttcacccccaggccccccaaaatcaaacagagccatagatagacacgttgagctgacaggtgggtagattcttagaacaaatataatttatgaagtaaaacccagtattaagctcatgagagtttgaaatctctattttatccctgaattacattctgtagaatgtccaacattacctgtttatcttgaaaactatatgattattataaactttggaagtggactgttttgatattatgataaactgaaatcattttttgaattgttcattccaaatgcattttgtcttaaatattcaaataattgaattttaaaaatatttttgtaactattgtggagtactgaaaagataataaaatatccatgatcctaccatagttaaacactttatattttgcttcagatatttcttaataaaaatgaacaaaacattttctttgtaattttctcagtctttcattgtgacatcctaatgagtttggtgtgtttcaaaggcccgtgttttgtttttccttcttttttttgagacgagtcttactctgtcgcccaggatggagtgcagtggcacaatctccgctcactgcaacctccgcctcccgggttcaagggattctcctgccttagcctcccaagtagctgggactacaggtgcgtgccaccacacctggctaattttttgtatttttagtagagacggggtttcatctttttagccaggatggtctccatctcctgacctcgtgatctgccctcctcggcctcccaaagtgctgggattataagcctgagccactgcgccctgcctcagtcccatgttctatatattaactttctacatatgtatccatgaacaatataattttattttacatgttttaattttcataaatggtattttactgtatgactgttatcactaactttggtttcttttaaacacaatttaatacttttaagatctatccatgttggagcatctttctttggaaattccaaagaaagaatgggtttggtaatttggtcgaaggtgcattttgagctgtaactaaaagctgagatagtaatcagtttattcctatgtgtttttattaacaaaagtcccttactgatgactgtctaaatcatagacagctctagctcatcattttaatcgctgtatgacatttcagtgtatgactccaccatattttaatatttcatacatatattcctctgttgatcaacacttcggtatattttctattttttaattatcacaaagtttgttcctgtgaacattatttacatgacattacaaaaaagaaatttttattgagttttaagttttccaaattagacattttcatttttcttcaataaatgtgtttacacacatttttgttcccatcatcccaatgatgggataagttttttatgggatatggattttaaatagtgcacataatatatgcaccattaatatatgcactttaaatagtgcatataatatatatatcatatatactaatattactttactgcatataatatatattttaaaataatgcatatattataaacaactgtcttaacatcatgctgctgatctataaaacagaaataattgcttatatgaaggatggctttagcaaattttgaaataaatgatttatctcagcataattattttttcttgctacagtgcaaactaaaagtgtagaaagacttgaattactttggtatgaaatttttcttaatctttaaacatttttgcttttctcattttacaattgatctacttccagatgttttagaacgcctatttttaattgactgtgaaaggcttctttctgttaaaaccaagcttcttcctaaccactgctacctgaacagctcattgtatgagagcatgtacagtcgagcagattaggcagtggtgaagtgcatgagctcagaatcaaaatgcctaaggtagaatccaggctctaaattttcctgtctacatgaactttagtgacttaatttctttggaccaagttatctcatctctaaaatgggtacatgtttatgaagattattgttggcatttaatgtgatatttttaaagctccttatacttggaacatattagacattcatttactgcttcatcctgttctttccatggaggaagaaaccatcttattccttcacttgaatctcataatttataaatttagccatgatgaatgatgtgtgctagtaggattacagacctcatctggaaatttgagagaaagaatgggtttggtaatttggtcaaaggtgcattttgagctgtgactaagagctgagatagtaatcagtttattcctatgtgtttttattaacaaaagtcccttactgatgactgtctaaatcatagtcatatgattaaaaattggctgtgtacatgggaaattcccaaatttaagctaaggtacataattaattcaattaatcacatgattaattgaattatgtacctctgcttaaatgtgggaatcatatatgtatatctatatacatatgattactaagtaatcattacttaataagtaatcatatatatgtatgtaatcgtatatatagtatataattaatctaattagtaagtaatcatatatatgtgattgcttactaattagattaattacttactgttggcttcaacaacacaaacattattttatagttctatagggcacaagtctgacacaggtctcacctagctaaaatcagcgtgggcgtcatgaggccttcattctttgctgaaagttctaggtgataacatgctttcttgccttttccagctttgaggccactctcattcctctgttcagaaccttcttcttccatcatcaaagccaataatagttcatctttctaattctacttctatcatcacatatcttttactgactcttcctccctcttctacttttaaggactcttttgtgattatgtcaggcccactggataatccatggtaatttctctattttaatgtcatctgattagcaatcttaattccatctgcacccttaattcatcattgccatgtgtattagtcaaggttctctagagggacagaactaataggatagatgtatgtataaaggggagtttattaaggagtattgactcacaggatcacaaggtaaagtcccacaatagggcgtctgcaagctgagcagcaaggagacagtccaagtcccaaagctgaaggacttggagtccaatgttcaagggcaggaagcattcagcatgagagaaatacgtaggccagaagactaaaccagtctaatctttccatgttcttctgcctggttttattatggctgtgctggaatagattagattgtgtccacccagcttgagggtgggtccgcccttcccagtccactgactcaaatgttaatctcctttggcaacactctcaaagatacacccaagaacaatactttgcatccttcaattcaatcaagttgacactcaatattaaacgtcataccatgagacctaacatattcacatttttcagggattgggatgtggacatcttgggaggtgggggttattcttcctacaagaagggaaaatttaaatgctaaaacctgcctggaaatatagccccaatcttacttctgcatacttgtctttgaggatttgaaaaaaaaaaaccatataaattatgtaagcaaaatctagggaggaaaaagaactttcacaaatgagacctctggcctgtaaaggatttttactgggacttaagatatagattcctgaagacaggaatctagtgtaggactgaatgatatttctatatttaagaagcagtagagcccttggcttgagaagactaagaagctatcctgagaaataagcagtttttataaagatgactgcagtcctctcactgcataacctgccctcagacacagatacccacatatcatctcttacaaaactcaagaagttataatatttaatttctctttagacctctagcaccaagtttaaaattgcacagaccacatttttgtgcaagagtttgatacagtgcataattcctaccctaggaattaagagaactgcatctaatattggttaagctatttgatgtcctagatgagctctcatgcatcttttagctccaatatctcatcatagtcacagcaaacatttattgaattactgacaatttatttatattgtcatttaatccttacagcaagagtgtgagttctgaattgtgattatctttgtttttcagatgagaaaaactgaaacttaggttaaataagtcactaagaacattgagctaaataagtgcgggagtcataattcaaacccgtagctgccctactctaaagcctgagatcttatctgtggccaagctgtcccatgggttgataactacttgaaataacatggaaaaaaacaataattactttttaaattttttagctgacacattatagtacatgtttataggatacagagtaatattttgataagtgtttacaatgcataatgattaaattaggataattagcataactatcacctcaaacatttatcatttctttgtgtgaggaacattcaaactctgctcttctagctttctgaaaatacacaataaattatcattaaccctattcaccccaagtgctacagaacaccagaatttattcctcctatctagctgaaattttgtatctgttaacttctctacattgtctcctcccccttacccttcctagcctttaatacccacaattctactctctacttttatgagcacaaattttatttttttaaagacccattaatttctgaatattactagcctcgatgagaggatttcttctgcaagaaaatggtgaagagagcagtggggagcaaagtggaattacagcaagggagattcgttttctctttgtagatataatgccctcaggttgaacttttgctattctggagttgtttttatactcaggataataaaaaggaaggatattatttctaacgtgtttatttggagtgtctgtatttctaactatattagtatctctgtctctagctctgaaatgaacatgagtatatgggacaaacttgtggcaagtggaagcttccaagtgaaaaaaaaaattgtctgttgcctctgtgaggctaaaaaacattttgtataagcatgtctctaatgcatataataatttactgggaatataggcttgcttttaggaatttactttataaacaatttggaggaatgcatatctttctggtaaattcagagaaagacgaatggaataattgaagaatgatgacattccttgggtatagtttttatttcattaaactataccttcgatatagtttaataatcagtaatactagtcaaaaacactagctagaaactctgcttctgttcctttgtcaatataattattatacaaggatgagatactatgttataaatatttactcttcttcctatggacgcttaatgtggggaaagatccaaagaaacttcaagaaattcttatctagtagtttttctgtagccttttcttaaaaaaaaaaatcaacatgctcatctgcactagtgatttgatatttaaaaataaaaagtattcgggctggcatgctactatccttcagtcttttaaataactttattaatcatcttatccttttctctatggaagcaccaaaacagtaaacatattttacaaaagaaatataatcagtaaagacaaatgacttagtagttttcccaaaaggataaactggagcggtgcctcaagaattacatttctatttttccaattacaaacagcaacattaatattacccttttaaatgtgccaataaaagtcatatctagcacaattgaatgagatattctactcatttcaatacttctttttactatctctttctttgtctctctgctatatatcaaaaagcattttccccagaaaatgtaattctgtggatcaggaatctgatgccttcccaattttttaaaaataagtctgtcttttttgggggtagggggattttagaatattccacttcagtcattccatatatttaccagcatatttaaggccattgcagtgaagtctttaaaaatcagaatataatgttgcagttatttttacagtaaaaatagtaaaaacttacctattagcttactcttaaaggtctaattgctaaaatttgtaagaatcaatgagaaaatatataattatgtactttgcaaaagtggttggttgttttcatagatatgaaatgaagagtatgtctggaaatttaagacatatttttccctgggaggccgaggcgggcggatcacgaagtcaggagatcgagaccatcctggctaacatggtgaaaccccgtctctactaaaaatacaaaagaaattagccaggcgaggggacgggcgcctgtagtcccagctactcgtgaggctgaggcaggagaatggcgtgaacctgggaggcggagcttgcagtgagccgagatggcgccactgcactccagcctgggcgacagaccgagactccgcctcaaaaaaaaaagaaaaaaaagaaaaaagacatatttttctttatgatttagtttattatttggcataggtttggcttatatgattaggcataagattaaatctagaagtaaagttttgctgtttttctttaggtcccattcctaactagtatgaagggaaagcttggtggttctctcttctcatgacggcagggctaaaaagttaattacctagttccaggattcagaatttaaaggcattaatctggtattcatgtcgataattcctatttatatgggagacatctgttaatttcacacacagaaagaatttccttgaagtataaatactgtgattggcaactctgcttaaatgtgggaatcatatacataaatatatgtcataaataacgtttacaaagaatgccaagcttaagtaaattttccacattatctaaaatactataaggtgaaaattagttactaaggtaattaagcatgatttaaagcaaaagaaaaagtcactccttacattttcctttccctttctccattaaaaatggcaccatttctagtggcctggaggtcaatatttattttgtaattaacacagctttaataatcctttctgaaggttcttttagatgtccacagtttagctaaaaaggccaagttctttagaaaagtaagtgttaaacatgtttggctgtggaaacaattcaagtaatatctaactcaaaatccaaggtagaacatagataaaagtattactgttgaggattttgggggctgctgttacatttaagccttatgattagtgtgtttatgaagcattttctttgcatactcacatgtgcttgtttctggaaagagttttttttaatattctcatcagatttcaaaatggaccgtgattcagaaaatattaagaatcactactgactgattaaataaatgaatgaccaaataaaataatgtgaatttcatattcctgttctgccactaattagtttatggccctggataagccacataaatgatctcatctttcatgtacttataaactaggttaggtctagataattctacaaatattttgtactaaatcctggaacagaaaaagtagcattaatagaaaatcagtgaaatctgaataaagtctgtaatttacttaatagtaatataccattgttaatttcttagttttgacaaatgtacccaggttaagtggaatgttaatattagatgaaattgagtaaagaatataagagaactcacttcttgcagaactatactatatatctttgcaattcttctatattatctttgcaattcttctataaatctaacattattccaaaaaatgcttatttaaaaaattattatagttctgacatccagaccaggcacagtggctcatgcctgcaatcctagcattttgggagtctgggggagaggatcacttgagttcaggagtttgagaccagtctgggcaacacagtgagaccttgtctctactaaaattaaaaaaaaaaaatccccagacatggtgcatgtgcctaaagtctcagttgctcaagaggctgaggcagggggatcacttaagcctaggagatggaggctgctataagccgtgatcacaccactgcactccagcttcagcaacagagtgagaccctgtctaaaaaaaaaaaaaaaaaaattctaacattcagtgaaagctgtaaatttattttcaacttacataacagaggatcttatatattattagagacccactgaatgtttttgagcctggaaacaacatgatcaaagaaaagcttacttggaagtgatgttccacagggagtggagtagggaacacctagaggtgaaatgaccataagagaagaggtcattgttgttccaagcctaaggtacagtcatgaactaaggccatgatcatgggaatagaggtatagaaggtatgaaaaaactttaaagaaataattgacagggctgactgggcaaaaacacatagccattctatatattgtatggttaatactgtgccttgaaattggaaagccatatttattcactctcagaattaatgccttatgaatatatttttaactttaaagttcttacttttaggtttagcatgtaatcaagcctctatatcgttttaaatttctccttttttctaattgtgtgtacattgtcctttgaaggaaatggcaaaattttatattatattgtttgttcgtatatggtactatgttgtattaaggaaatatgtttgtttcaaatcctctcaaaacaggaaggtagacttttggaagtctaacttccaaaaagctgatcatgaattgtattatttaaatacattttaatatttaataaaatacagcatgtttggagtattcgtttttaaactagagaattgaaaccagtcttaactgggccttaatcttttagcagtcagttcttcccactgctcttttgtgtgaaacactgtgcatcaggaaaaatctgattgctctaaatgctatgttaagaatcctttctgcagctcttattaaagtgcaaagattctcatgcattagtcacctattactaaatcaaaattgctttgtaatcagtttttgtgatattagccaacatgacagtgtttcctctggagatcttacttgaaaatttttcagatttgcaagtctaaaactaacatgtttgatcacgctgctttgtatgatcctctataaactgaatactttataaattctcaagcttccctaaatgttagagctgtaactaatctttgaaataaattagagtaaaatctttctttttccacaaggaaattaagaaaccagagaatttaagcgacttaactaatgccatcaactaatttgtctctatctaacctgtatgggggaaagaaaaactctaaaatgtaagagattagatatactgagcctacctatacctcttctcctctcttagtttctctccacaaaaatgagtatttctgagaagcataattttagtggaatttgcaaggaatattttctataaaacattgttcatataagaagtcggttgaactcttaaagaaaaggaaaaaagtatgccctttttttagcctccaaatattttcctaggttgatttgccttcttgggggctgaagttattaaaatttgcatgatctccttagaatacatttaggctaactatttctgattggttgaataatatagaaaatagagaacatagaattcttaagtctaggaatctaatttggtactaatttttaagtaatgaaatcaactaatattaatttttaaaaataattgtgcatattttcttctttccacttctttatcttttatacagaaagaccagcacaatgatgaacttgtttttaagaaagacttttggtcagagaagtgaaaaatgtgaggaaattatttaacttacaagaactggttacagttatcttttctaatctctcacttatctctttttaaagttctgtctatagacatatcaaacttttgcatgaatgttttaaagtttaaattccttgacatttactagaagtggagtttttaggctgttaaaggtcaaaattgacagggtccagagaagtcaatggggtagaatgatctttagttatttagcatcctaaaattcaagaatgtaaagggcattagttttgccactcaaataggaacatcccagaagatgtacactctctagcaggtatcaggtatgcagagtatgaacctatacttaagcacactttgccatcagtacctactcctggggtgggttgcagaaaaaatgtgcaggggtgtcgctgaagtgcctctgagactctctgccttatcattttcaggggacatacaggaaggctatccctttaggagaacttattggcctgaattttagatcccacagattgcctcaaattataaaattacctcaacatctacaagtaaaaatatttgcaaccttaaaacgcataaacatttggtgagatcctttttctgttttatttcatcatgagctagattcttcctttccttatttggaaaggtgtatttccagagaatgaatcactgcatttcaggggatttcaggctgtctagccgactcaataacaacagttccattggacctatcttcagactgcatcagatcttggagcagtgaagcacaaagcagaaatacagggcagagttccttcctttcttccactcaagtagaaagaagaaggtaaataggaaaaattcaggaactttacaacacttaggaaaacataatgtgtcttgatgtcttttattttcatctttcagaaccgtcgtccttctcctacacccaaaaatgcagtgcccaatgctattacaatagaatccaaatgcattccttagcaaaaaaagatattcagatgaataatttgtaacaacagaaatttctaattaagcaaattgaggccctgagtttatcattacccttttcggaagttaataattaatcttttttgaaacgacaacaaaatggcttccagatatcactcaggtacacacttgccaccgtcctctcttccattttgttggaacaaaatgacatatacacatacaaacacacaaagactggaagaggatttaaaaatggaagagaggaaggtggtaagtgtatgcctgagtgatatttggcttaatgtctaaaagaaagctgaagtctcaggtcctacagaagagggagtgggtaagaagcaagtatattcactctaaatctaaatatcagcctgtttacatgcacacatgcatgcacacacacccaacctaattaggaggataatctaaaacatccaaaatatgaccaaaagagattccagaaaaagtacaagggtagaaaatactctagggtattttaagtcagaagatatacagggaataatgtgcttacagaatcatgagaagagataaaaatcaggttctaagctggatatcttgaaatgatacccataaaatatagaactggccaggtgcacaagctcctacccctgtgctcaccacgggaactgtaatagtctaggtcaggagccgtggccacagccataccagcctttggacgtcaggaaactgaaaaatggatgcctaaatatgcattcccatgattatgaagttagatgttagactaacgtgtcaccagtactgggccattttcttgacacttaggaagctaaaaactggagcctgcttctgcaaaactccaatatcaatagtcactgttaatggtcagttgccaagggaaacggaatctacttcacttctgccattcaaaactttgtcaggtcaatcttattttaggagcctaataattactcagaaccatagtagctagggaaattgggaaatgtagtttcaagctgggtagccatgtacttttgtagaactttattactaataaataaagggagaacaaattttgggtcacagctaactctagaaagatatgagaggtttgttctcctgagacattgaaccagaggaattctaaattcaggaaggtaaatatgggaggattaaataaaagtctacattcataacagtgagattcccaggttatttcctaaattcaacttccagaatgctggaatccaggtgtaatcccataggaatgattggaatattgttacttggacaaactggaccaaaggaaaaacagtaaatatattgatatttgggaaccctaatgaaatggtcagggtaaacctacaattcaacattattttgctacacacaaaacttctaaccatgtcataatgacttatacttaaatagaaagatatttacagacattagtaatttgttgaatgccttgacatgaaaaaagagaccaaaacaaaaaagcaaacaacaaaatctagtcaattaatatctagaggaaaaagagacaatatagagaactaaagaaaactataaaaagatgattaatattctcatagatttaaaatagtaagaacacaacataagaaaaaataatcataccacaagagtggaaattaaaatgagatatctgaaattttaaaattctttatgtgttgggaaataatgttggatgcaatcttccagaaaatagaatgttttaaaatgagggaataattcgagaaaaaggaaaacaaattagaagattaatttaccaggtcaatgtctgactaagccaaaatgcataaaaagaaaacatataaaacaaggcatacaaaattattaaataactttttaaaaattcctagaactgaaagacatagtttgctacgtcaaaaggttcaaaaggatccactaattgtcattgtaccaaataaaaaagatgcacttagccatattattattaattttcacaataccagagatagaaagacgacgatgatgatgatgatgatgataaaaaagactaggagaaaattcacatgcccaggattaaaaaacagaatgacatcttactttttaacagccaaatactgaggagaaagtcaattctaaagaagaatttaatacctaattaaaccaatcaagttgagagaagaatgaactaaagatatttccgacatctaaagtctttaaaatgtcactgtcctcatatcttttctacccctctacaagatgcatcagattctactgcctcttcctttgcccttcaagtatcgcttggtgagcagtagctgggtagtgagtagacaaatttgtgattaccccctggtagacagcattctgagaatgtcactctcttatagctctgcacattacacagatctttccagttgttgaaacaaacaaaagattttccaatttcacacagtgatttcaaacgtgcagatgtcagagagctatatatactagtctgccgctattagaggctggaactggatctattcatttcagcaaggtttattctgtccatggggttgtccagggggcaaattcgcaaataaaaataatcactttatggaaagacattttcagcaaaactcaaaattctcttgtttccctctcagtcttctcctgtcccatacatattatcgtcagagataggaaagtatcggttcaggcctagctcacagaaggcacttaatgattacctgttgaccagttgactgctgaactcactgacccttttttaaaattctgtgttttgtgttaaaatttgaactacatttagatcatttgtacttcagtatgaataagtgtcagaccctttcccaaggtaggatgtaggacagagcacagagcttggtgaaaattggaggaaatgagcataaaaacaagaggtgagagagtcagaaaccagcttcatttctgcagctgtgatggagaagctccatggacctccatggaatcaagcttcctgcacatgcttgggagccatccattgatccaaagcagcagtggatttttattttgaaaaacaatttgtagaaaaaactgttgagcagagaaagggtgacaggcaggtaaactaggatttgtgtgatttccaaatgcttattaaacatgttgccaaaactcccagagtgtgtaacaaccagctggggattacagctggggattaatttagaggattaatttagatttatatagaatctaaccttccatatcagccctgaggtgctaaagaaatggattgttaggcagagctttagagccaacccagggacttggacttaataaagcatttcagaggggatcctaggctctgggatgatcaggttctaaataattcctaatccttgtatacatttgattgcttactcagtttcagcaccatgactcatatcatcaacaggcatgctgtgtgaaatgattcccctgacctcctccacaaaccccccagtaagtcattcagattgtcctattggaagtcaactgaatattgcacttcagtgttcttatctacaaagtctgctgtaataaatactggatatcataggagcttgaatcaatttatccttatgtgctctcatttttactattgaaatttaaaactgtatttagtttatggataccaaaatgtttactgggaaaagcaaataccatttcataaaaactgttgtctctgtaatttctagcaaagtacatgagatctatttaaaatgtcaagagatcaattcattgtgaaaagtttcctcccagccaatgtgcagtgaattatttaaaagttctgacatctgaagcagctggtaccatcttctttcagtcatttacaagtaccttcatagatctaaccccatttttgttttgggttgaaaaatctcaattatagcaaaacaaagatcttggtgagacaaactgtaaacgatacatttgaggacttaaaagatagggagaagagagtgtagctcatgtgcagtcctaattgttgattatgggctttaaggaaactttgtggaaagactgaactatggctatatgtggttcttaacttttgtacttaaatccatagtcatcatctctccctttctcctgtagaatttcttcctttagattgtatcagatgttgtatcattgtattgctaatttgtttcaatgagcatttcttgtctttttagttatattaacttattctgcaagtccccacttactcgtctccattcagaggactatttacaatgtcataaccactaaaaaaaagtttgattgattgacatcaatgattgacacctatatattacacattgatgactgttctatttgagcttagcaaaattgttgtggaattcactgctaaattaaaactgctgtatagagctttttacattttatttctgaagtgactgattatatattaatagtaaagaaaattgacatttgtgaaaatgaaagtaaaaagtactgatgacttccattcttattgtcattaattatttcttagtttagttgttttgtgatggagagctatcttacgtagtcttgttatttattgttgggctaagcttgactgtgtttacaggtctaggttccagttccattgtcactactgtcttgctgtttcctggagcaattcagtctaacttattctgaactcattttcaccctctataaatttggtggagatgagcatttttcagcttttaagttcaggggtacaagcacaggtttgttacatacaaatgtatatacatacttacatacatttgtaaatgagtgtcatgggggttcgttgtacagattattttatcaccaaggtattaagactactgcccattagttattttcctgaacctctccctcctcccatccttcaccctccaccctccaaaaggctccaatgtgtgttgttctcctctatgtgtccatgtggtctcatcatttagttcccaattataaatgagaacatacagtatttggttttctgttcctgcattagtttgctaatgataatggcctccagctccatccatgttgctggaaatgacatgatctcattctttttttatggctgcatagtattccatagtccgtatttaccacattttctttatccagtctaccactgatggacatttaggttgattccatgtctttgctattgtgaatagtgctgcaattaacatacacatgcatgtgtctttataatggaatgatttatattcctctgggtatattcccagtaatgggattgctggatcaaatggtatttctgtctttaggtctttgaggaatctccacactgtcttccaccatggctgaactaatttacattcccaacaactgtgtatacatgttcctttttctccaaaaccttgccagcatctgttatttttttactttttttttttttttgagactgagtctcgctctgtcacccaggctgtagagcagtagtatgatgtcagctcactgcaacctccacctcccggttcaagtgattctcctgcctcagcctcctaagtagctgggattacaggggcgcaccaacatgcccggctaattttttttgtatttttaataaagatggggtttcaccatgttggccaggctggtatcgaactcctgacctcgtgatctgcccaccttgtgagcctcccaaagtgctgggattacaggcgtgagccaccgtgcccggcccttggctttttaataatagccattctgactggtgttaaatggtatcttattgtggttttgatttgcatttctctaatgatcagtgatgttgagctttttttcatatacgtgttggcttcatgtgtgtcttattttcagaaatgcctgttcatgtcctctgctcactttttaatggggttgtgtttttttcctgtaaatttatgtttcttatagatgctagatattagacctttgttggatgcatagtttatacttttagcttttgcatacaactatattatgtgaataaaatgggataaggcttttgaaagaattttgaaatgttagaaggagacttgttttttatataccgaatgaatatcatcattttgtggttttttttaactgccattatatcctttagcaatcaaaatactatagctctagtttttaaaattaaatatagactgttcatattataacttattagtactaccaactattgttttaggtaatattttctatccattaatagcattcgaggaggaatattttcttcttctccttagagatactcataattgattgtgcaatgttcttatctgttcacacatcctttattcttcttgtgctcattgtttcttttgccccgacctgcctcctacttggagctgctgctaacatgaatctgtcttaggaggatggattgtttttaagaaaaagataatgggtttggatccaaggtgctttccaaataaagtctaaactcttagtttagggctttaaaactttttcctaacctactgccccagccttaaccctcattcttacctcactgggtaatgctatcatatggttagaaactttacaatattcttgtttctaaccctttggttacattgttttccttatccacttgttgaaactgtatatgcctttaaataacatctagtccatgaaagctttgtggtcctcccactgcaaatactttttttcttctagacttctgcaattttcgtgtctacttttctgatggcatctagcctattacgttctatactttgatattactctgtgttttgttcatttattgggtttttttaaaaattcttttattctgtttctatatctgttgacaaaactgtgagctttttagatgtgttccacttcttatattcacagaagtgtctaggaggcttttcttgggcaataagaaacagtctatcaagagctgttgaattaaattgaattgttgggccacacttttagatacaagtatcaaactgaacctttcatgaaactggacaagtttaaagaataaatttattccaatgttgttagtgttttgaaaaagagtctttatgtgtgactggaagagaagaatcaagctgtttaaccaataatgctatcgagtttggatagcatgcttggctagaaatcagcaagcagatatcagagacattgggagtcacgaagtgttgttctacaaagttaaatacttgattaaagttttttacatacaggacacacatttaaagcttacggtttaccaaacataaaaggagtgcactagaatttgggcaggttttaaaaacggaaaaggtaaatcctgcatgcttgaaataaaacctgtattatgaagtttccttgggcatttgtttagggaaaacaataacatttgaacaaatattttcaaggaatgctgtttagaaagaaatcaatcttgaacaaatattttcaggtagtaccatactcagctttggggtttttttattattatcacatgaagggatcttttctgagttataacatttcctagcatttggaatctgatgaaggccacatctatacaaagaaatagaggtattaccatgaacagtcagagataggcttcctgagcctttaaaatttctgtccatgtatttacatttccctggcctacttgattcatgtgctctgtattttcttcttagattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagccagttttgattatatattcctacatttagtgagttggtgggtgaggaatattttctaagtttctttttctgaacagacatttcatacatgtatcatggcagtgtggtaaacttcccaactggaagaattgtaactcggcaaaatattttagggatattacctatttttatacatatctcttctagataactacatttcgcacaacattattagattttcagaatctgcttctgtattgttagtatattatatataatgctaacctattaatctaatatagtttcccttatttagagagatcagtgcttcgactgagaatacatataaccaaggatttcagataccaagaaagcattatatgtctgcttagtaaatatatcttttagatttaactaatgtagcatggaatccagaggaaatggaatttcctaacaccagatgtatctgtaaccaagattaaagaaaggtctttttgccaccttctaacaaatatcagttaaaatgaaatgctttgctacactggatccttttcaacttagcacttacaaatataggtagcttttgcaacactaaactgcattctaataaacagcattcagctaaatgacatgttagttacccccttcctcttccccagttgatgcctcctaagagccgactgctattcttgagaacaaattcctggatactggcattagtgacaaagaagtgtcaggacagtttgccaagaatgttgtttcttcttgtacaacacaaagcaaggaaacctctgtattttatggctttgaggttttaaaaaatgttctgcagtttgattgatatggcttttaaattcagtgaatcactttcatgaatactgaagtaggtataatcttcagaactagtaatcattatagttacagataggattccatcgcatgtcctgctcaaatgaagacctgttctcattaatcaatactgcatgaaaatattactggctcacactaaaattaggagcatcaggtgtccagagttttcctgtttgggttcagatataaaatctaagtttctattgaggttaataagctggaagcatttgtttcctttaagccttggagaggtcattttcttactcattgatagcttatgtctactgaatgcaatattcttttctgttcagggattttggctgcattatgatttggttatgacataactcagttaaggaatatatttactaatttccaatgtagtctatgaggttcatttaatgtttttaaattttctatgtgtgtggctagaaggcatttgtagatatgcaaatatttgttataatcctgatcccttttataatttgagttattttcttgccctgggggtttacaaggacacgagtgcaacactctttatatggagaagacaggaaatagaccttgagctctaaacctttgcctgaccccctcttctgtgggcctgtgtttctggacaatggggaggtttacagccagtatgagcagagcagactgggagcacctcaatcctcatgcttatattagaaaatgccttagcaatgttgatgggctccttgtagcactggagcatggggagggaacaagctcactgatgtcatttatgcctattgtcttcagtaacttagaacttattatggtatattaaatcaataaaatgttggtgatgaacaatgtgttttgtaaccataaggctgaaagggacttccaggaatatccaatctatttctctcactttttataaagatttgtctaagcaactactctaaacacatatttattatctccatacttaagaatatctacgggaagcatatttgaaaagcatcattggaaatccacctcaatactagtgataggcctggagagaagtattgtatttatatatctcaatttatcagaagaatcacaaattctgtattagtttatatgattttacttagagaataagtatccatttacattgccataaatgtcacgatgaagaacgtgccagagatttcttatttatcactgacaggatgtcaactacatttttcatacattataacctaagtgtattttcacagctatagtccgagataatggtccaatttgttatcattttgctaatctattatagttgattattgtagttacaatgttgctatatatgtttatgaggtactatataaaatgtctgttcattcaaacttcaatcacagaagttagaagatggagaaaaaattatatttttatttgtcctacacaatgccatctacatctcttctcttaggaattgtgattgtaacaatgtggtggcatttgttatttcatatgacttttatctatacagtattctcacttacttacaaactattaccaacagcatgcattttagtatggcagatacaagaaatttgtgtgatgttcccttagaaaccaaatgatattaaattggggaaatggttttaacccactctgcaagggatactttaaaatataatttggcacctatagctcttgcattttaatattcttttaagctgctgtttggaagaaggcaccttataactagccattagcaccaaagcatcacgttggtatcaggattattttgatggagagaatgtcatcatttgcaaataaatcagttatctaacaaaatcagaatcccccaatatgtactcagaatgtactaccctgtatcttctttgtggaccttaatcattaggtaacattggccataataaaaaataataatatgcttcagaaacatagtagttggatctcttgtctatataacgtagagaaggggaagaagacatagcttccaggtaacatgggacccaattgcgtacaatctgcctttatattcatctcttgctctatattttaagtaatttcagattttccttttaatatctgattatgtggaatcaagtgagctttgatctgggactctgagacagacattgatgcctgagacttgagagtgggtctgtaggttcagcacttcaaatgttgtttcttacagtcttgcactccttcctcttgtccagtaacaacggtgtcaggacacagtagtttagtgtgaatatgtgtgtctttccaggaaaaacaaagcaaaagaggataataacaacttaaacaaaatctcattcacaaggggagcaagacttttaattttgcaaatgcctccaaagagttccagcaataaagcaaaattaaattgatagataacaaaaggcaaagccatggagaattctgaaaaccccaccaggctctgtgttttgtatagaatcatactgctgctgaatgaaattgtgtatctaaagtcgtaaggcatcaggtaggagctcaaaattatgaccataattaaatatatttgttgaaggctccttgggtccctgactttctgagagcaggtgttgtggatggttaaggcaaaaagtaaaacttttacacacaggtttctgtcttgtcattttgagaatgactcagtccattctggaccctttcttactccattctgtcactagaaaccatctcaccccctcacgcctggccacagcaaacagcattctctcttcacttctgaacccagaatggctacagaaagggttgctggtgcctcattcaggcggataggaaggaccacacacagtcaggcctgagcaacaatgtacttctgaagtgtagtaatgaactggatgtgccggggcattgattatatctgcagcttcaccctctgctctttcttcaaaacacagtctgactccaagcacttcatacagcttcactgaatgttcctttgaaattaattataaatgactctgaataggctttgggtagcaccaggcgtctttcagctgacaatatctagaaactcaagttcaagaaccaagccctatatcgtagcttagttttttctactattagattatagaccttcagctacaaaaattatgtcatttcagaggcttctataatcatagcttaataatagatataacccaaaaatcatgatgcatgagactgaattattgaagtttaacatatttctaaacgatttatgggcagctcttgatatgaatgttcctaaaccacaaccagctggtttaacatacacataaattgtgttcatgtgattgaacaaaatttattgttaaatgggtaagttgacctcagctatggactcaatttcaagatcctcgtagtggtgaatgaagagcagacactgatattacatacagattaacaatcttgtcaggctatactgagatagtgtgcaaaattccttcctcacacttgatccaaacaattgaaacctgcgtatgactgttcttccatcccttgttttcttccttcctttgttccttctttcctttaattaaaaaaggtcactgatacatttataacacaggaagtatcacagctaatcccatattctaaaatagttttataaagtgattaatatttttagtttgtgtgtatgcatctgtgtttattgaatgtagatgtttcatgattgaaagaagtaagtttctttggaaggacttgggaatgcagagaagtaaagtttgtgtctttatttctaatatgttataaccagatcacggtttcagttaagtacctcattgccatcccatccttaagaaatgacctagttcagtggttcagctgatctgcttggaagtatctggctggcttcataagaattccgtagggagttttaggaatacagaagactagtctttaccttcagagatttggattcagtaggtctcaggtagggcctaggaatctgtgtttagaaaatcactctaagtaatgctaatatacagccagacttgggaatcattgaaaagtattcaaataatcccaattactaggaataaatacaagttgactgggatagtgatgttatttcatttgtagttattttgaaaagttaaatactctaggcctcataccattatttctttcacaaattttaattttagctttgatttccaatttgtggtcttctttctgagcatgaatcttcaaacttagagacagacgtcaacactgataagcatgagggatgaatattgctcactatagggctattaggcatactagatacagtaccattttcttagttactgccagagctgtgcagtatattacaacatttgctaatcctcaccaccgaggtaaaaactatgacctttgggacacagaagcaaatatcaaagtgacagccttacttctgaatgctttgatttttatgtcatgaaaagacatcaacttaatacttagtctcactatgtacttttcatattgaattgtacattatctgaaaactgatttccaagcaataccgtgtaacaacctttcaagcaataatttaagccatggtgatgatgccatatgaagcttgcacttctttgcatttcatagagcctttgtgaaaacagaaacatgttttatacaagcaataatatagctggtgtggactttttaaagatactcattattctgtagcaaaatgagcagcaagtaatgactcagattaaaaatattcgggcaaatgacatgtttaatctatctcagaagttattcatttgcaaacatgctgtaaagtgattaatatacatcagattatttctggtgcataattttaaacatggctataaaaatatgatttctattcctgtcaaagagatttgtgtattatttataatgttgcccaatttttggatctttgtagtatataatagtaaggaagaagttaaggatggataaatgagtggaagtagagcataggttggaagaggtgattgagaaagtaggctttgcaaaaatatagatgggtcttgcggcagatttattcaaatgttggtttgatatggtcttggaagatgaaagagtaaagataaaagagctcattattactgttttcaatgatagctacacaagtttttggtaagtatgatagtattttgacttcagaatatgattgactgaaagtcacctgtagcacaataaataaaagtctgaaaatgattattcagtaatactgaaaaaacactaaagctttcagatttcgaaatgaaaaaatcatgtttttagtctacttaaaatacaattttaatagaatgtggcatagtcaatgataatcagttctttagtagttaaatttacttcatcatttagaataatgtataaggattacagctaaaatcaactagtaaatttatgtttatactgaacagtatctaaacatcagattatgatttagcatataagcttaggattcattcctaagcatctaaataagatgacagctcctattattgccctgcaaggtaaacaatcccctaaacatgaatatgaacccatttgaatggtgggtgtgttcgatattttgtctttacctttctattactcatagcaaaacttaattttagcattctcctgcccacagtttggaaaatttccctatcaaaatcaaaccggattgttgatttactgaggctttgacaattatcctcttgtatatcactggatccttaaatccttagtaagaatggttttgggttaaataaataatggaaaatatttaatttgaatctattaaattacactgaagttatccttccagttaattcagctagttgctgatcagatcattctttatattagacttaagtattgttgcttattatttaaaagcagaaaagaaaaaccaaatggcaggtctgagtaatagttactttttgattcttttgatacatatttttaaactgaagaaatcactttatattcagtcttcttctgtggactttttgctatttgcagataaagaaggaattctacttaatatatttttactgtggtctattaaatgtcattaaacctatatctaagaggaaagtaataactgaaataaaatcaggaatgtgcaaaattgtttcttcatacctcactttctgaagacacttctttgcattctgctgcctggcatttacacagcagactcaggacaaagggacaaatggagtgagtgaggtgggcaggagctttagaagagatgaagcaaagagagttagttttttattcaggaagatgtagagactcttaaaggagaggcaatttccgtaacaaacacctctggtttaatggaagccacatgatttatttgactactggtcactcatttttaaaaagaaaagagaaagacaaaaaaagagaaacccttcacaagccatttttagttttcctaggaggtagtgccaacctctcggcagctgcacatctcagtgaagctgggatagaagcttacagagctacaaatagatgctttctgaaggtggcagatagaactagtcttggttacaatgattaaggtaaatgaaagtgtcagaacatctgggttgaaggaacaaagaaggcccaataccagctctgccatatgccacagaaaaccctgctaaaattagcatagaaaaacagactaacactatgcaagtgatattaaaacaaactatattttttccttttataacatgcctggctgagctagcattcagtgagaagaatatacttttgtcttatgaatcatttaaaaacatttgttgttgttctgacattaaataaattacatattcccttagttgaaaaatttaatcacaaataataggaaatatttattttgtgtcctgaaatttttaaacttttggcggctgtactctacgccatattcttcttcacattcttctcaaattgggtttggctgctagcaaaacaagtgtggaactttagagcagaaaaatgtccatctgtctcttacagaatgtgccagagtatttgagctggagagagaatcaccccatagcatttaatggtattctgtgagacacgaagactctagtcttctaaacttaaaagtggttaggtagtaccttaatcatcaaagatttttcacttacatgtaactggttaattcatatagagtttgtttagaacagaaactttaaaaggagggaacaaacctgagcaatttttaatcaaaattatcagttagaaaaagaatttaagacaaagatttattgtcctgaaagagtcaactcactcatatccaaaacttagaatgtcagagacttttgaaagttttctgaatgtgtcaacttcttcagcaatgagagattcaattaatgttgtttctaggttccttagagttttatcctctgatgataacacttaattgtgaattacatttaagtgatttttactttatattttccatttgttacagaaaaaaagtcataaatatgacagacttaaaaattgtggcattgagccagggtttgcaaatttggcaatattattttacttaaaatattacactttttaaaataacataaacattaaggataatagtcaaataatactgtattttcagcttgttcacattagaatatagaacaacgcattgtaaacttctcggaataaaatctaagtcaaaaccaatttatgttcaaatcatttgaacaacaaatatgaatattgttacatcacctctgactctctgactagtaagaaactatgcatttccatacccaatgaaacctcaattcctacagcaattctacttttattgcctcccaagaactatttcttcatggtcaatatcactctttaaaagctagcaaaatatgactttcttctgaggtttgggcaatctggatcaatatttatgtatctaaccacttgaaaggctgtctccttttttggccttttaaattaaaacttccataaaatgaagcaaaatatgaaaacagctagttgatttatcaataatgtgaaaccctccttctgaatttttttggtaaaaattaccacactgaaaccaaaacttaaccttggcttggactctcagataaattgcttttgtattctttgactacaaagtattctcaaaaagaagaaattatttctgatggtagatcaaactctagccaagaaggtctagataaactagaggactgtataattatctaaagtaattcagggggacttttagaaaaattctttaatttttgttcctgtgtaaaaattattattaatggatggcagcccaaattactattcttcttttaaaatttgtttcaagtgtgtcaccaggcactcataaaattcatttatttgttatataactcaatgacctgaaataataggtgctcattgctttttcatttgatccttaaaaacaattttattctgtctaaaaaaaattctcctgctaaaatccaaatgattacctggctataggaggagtcccattttatgaacatgtatgaaatatttagttggattcagatgaaatgcaacttagagaaaggaatggataccagtagagaagatggaaagagacacaaaaatcagactttgcttacatcaaaattaggtctgttgtctaatcctgttaacctagaggcaagctgaaaatagatggtaaggataaatagatttttaaacacagtatttatatttaacagaatgtcataaaaatgacagaatgccatgaaattcagcatgtcaaaactttgataaaacaaacaagaaatttaataaatatgctaattagagtgaatatttaaagggacaaaaataacttgtcacatcatagatgtctccccagtgcagaatttattatctgctgggaaaatttggttttatgtcttcaatcaatatttgctgcattatctaattaaacattagtatattttttgtgctaatgagaaaccatgcaagagtccaaatatcaagtgtggtgacagcttgaatcagttgagtttggtgttcatgaataaaattcttgatgaatgtgaaatgaatggtttatatacataagttttatgtgcagtaaattaattaggctttaaaacttgttagcatgcttagctcctcttttttccattgaattatcttcctatcttccttccttccttcctttccttcctttccttccctccctctttgctttatttctttctagctcttataagataaatgacaatagtactttactatttgggctggagcctccctttttcactttcacatgattgaacactttgtggatttgtgagaaaaggggaaagaagatgagcacgtagatgcagatcagttgaggatagaagtgactgagagaattgggaccttgacttccagagactgtcagtcaagagaaatgtgggtctataaaaatctatgtgtgttcattttcattgaatttaaacactttttcaagaagtatcagggtcaatctgtttggacaatctcctatttttacccccttacaaatgtcttaagttagaaaaacctcttattttcaagtagtcatttttttttatgtgagtaccacactgctaaagactgaaatagaaaaaaaaaatgctttttctgtttgtagggaaattgctttctgaaaactactcccaataagatgtatacatcaaatgcaacttgattttactggctctttatctagagataactgatgcactgtcttctttcttagatacccttctgtaattcagcttggcatagtatgatgttttgagttcttattgagggtttggaaacatttgtcatcaattttatgtctactctattgaaaaagcaatatacaatgtattccatatttcttagctctgtgtctttgaggttttaaacctatattcagatagctgtttttagctacaattttgagtattcaccagaatttacaaattgccattttattaaatacaaaaaaaaaaaaagtacagcttggatcaagagatcaaacatttacaaatctcaatccaaagccattatttttcagggaaaattaaatcatttctagcagagtatttgactcctaagggaaaataagtcaaatatcttctttaagagtaagggcattcttccattgtaggtatttctaattgactttataataatttgaacaaatcttgaacaagatttaaagaatttataatctcccaaacttaaaattgtattctttctggttttttatttttatgtattaagattatattcaaaccacttaattatcttcatgacataagtttgtgttaatagaaaattatacagaaaaaaacatgatttgttcctctgtggaaagatatgcttcaatgagttaaatacccttgaattttggttctcatttcttatttggacttttctgttatgtacctcaggggtcttaaattctaacagatgaagtagtcaaaggggtataaaatacttgaaaaaaattaaaacttcaaaagggacgaatttctctgttaacttttgtttatcctatactgacttattttgaaattgtgaaaaaacaggcagctaccatataaattggtatctatgaaaatactgattactttcttcctgtgattttcactgttaagaaaacctttgtcttgaaatgatggacaatcttaatacttgttcagataaagaaatgtgactttcaatacctttaccatttgtatttctttagggaaatattttaataatgattgtaaaaatagaagaaatatggttgagaaaaatagaagaaattaagatgaaatttgaacagttgtaatccacagtcccatttttccctctattttattgccttctactaagttattgaaggcccagatctgcaaaatttacaagctactaattcattgtctcctttaagaatttggagcaaaaattattccgactatgcggaaatgaattcacatcatcatggcaggttttgactatgagggaattcaggttaggttcaaatagaataatggtccatggagaaaaatactttctgatttttcttcaagttggatggaaaggtttttctttatttaaaaaaaaaaaaaaaaagtcctcctgagaattttgccttcgaaaaagaagttttataacagctgcctgtagctacattataacttcggtaattaagtgacaaaactgtctcattatgcttttaaaatactgattaagtgcattccagaaataatacatatcattcatttcaaaatcaacctacctgaattctgactcttcaatcatgagtagccattttacaaaaccaaagggtctcatttcccaaacagtactttaaatatcatcctaatagtaatatcctaatagtaataatcctattaatactcacttcaatgcataaaataaacagccaatgcacttccatcaagtctgcaggcactatataataataaataggtttccaaaatcacttaataaaaacacacagttataatgtgctcggccttcattagcatcctctgcatggggtggttttcatttaacctgaattattttaacattttggctaatttgtttgctgcaatttcatgggtctaaatttttggtttggtttgcaatgtaaatcatattgtatatctgctcctttgttattagatttactttgtgaataatatcttttaaaaattgagttatcaaaaacttaaattataatgtcatcaactaataccaggtaaatatactaatatatatgtagggcatgattaaattgcatatattttgaaatgtcaaactattttttgtttttttaaaaaaatgaatgcatctcttaaacctgtaccattaattttaaaaaagtttcatttggtatttcatattatattttaaaatatttttctttatctagtagtacaggtttaaagaaactttttctgattgaaatgataaaatatgcctcatttcactagaattttaagaataatacatgtaaaagtataactcatataagattataaatatccacaatatcttctttgattttcatgtaacaccactttttactcattcttttatttgttattattcgaaatcattcacaatgtaaatagcatgtttcatgatgtaaaatgtctttgcatttacagactgcagaacaaggtgaatttgtatatgaaaaataagtgatggaaacgtgggattcttataaaacaaagtggaaatgatagttctgtgttatatttacataattcattacaaaattgtctagttaagtcatgcatttatttaccttaaaagtgtccaaactgtcacttataaaatatttaaatcaataaataataccaaaaaggagtctgaa

SEQ ID NO: 143 - DNA, 70353 bp, Homo sapiens
cacacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatggtgcgttttggctgctactttctttttcagtctttcggtgcggagaaggggaggaggcgggcagaggtctgaaaaaatcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacaggtagacatgagcgacccaagcgtaagtgccgctgccgcgagtgcccagggtgcactcgcgcggggaccgacaggtgccactgcagggtcccctctcccgctcactgcctgccacccctgacgcctgctctctttctccattcgcagtgcggatttgcgaggcgcgccctggagctgctagagatccggaagcacagccccgaggtgtgcgaagccaccaagtaagtggtcgctgcatccccacgcgggtcggggttcttcagacaggcggtccctcttccgggacccccgcttgggctgggtctccttcctctcctgagaaaccttcggtacgctcccagttgcccagccctgggaagccagcatcgggttcccacgctggggaggagcgagaggaaaggagaggacgcccgaggggccggcccagggcccgggggacccgcggcgcccgagggaggagcacagacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggcggtggcgggcttcagggcaacttcacccggccggctgcggcgtgggtaagaggcgcgtcctcctccacagcaaaagctgcgatcgctgggctgcccagagaaggcagccggctaactgcccagcggctccacgaggtgtgcgcgtgtgtgcgagagagacaaatgatttactgcttagcagtcccatttctgttttcgttaggactgcggctcttggagaaagcgtgagcagggggccaccgcggtctccgcgcctgtctgcaccctgtcgcctgagctgcctgacagtgacaatggtgtgaggggctgcgttgcaatgtggtcatgtgatttcaggctatggatttcgtgcgtctttctctgctcactgattttcacatggttattctttcattttgcactcgataaacagtttacatcttctgaagtaagccagaagattgtatggctcacttaacgatgactggttgaaggcatcttgatttggaacctatggaaacagtgctgagttttaaataggacagatttttttttctttcatttgaacttcatttataacatatcaatagtgatgttttaggatcagttctcctatggtaatttcactaaatgcctatttaatgaattgatttgatttcatacatctctaccacttactagaactgtctttgtacaaacgtcaaactttcctgttacatatgggtaagcatagaagcacttgatataatttttttttatcttggttcagagtgtagaagtggtctgttgcttttcctaaaattgctatacatattttttctttaagagtgatcatttcaggtaccctattatgtacagtggtaaaaagtaaactcgttatgatagcaacgacgatgtaaccaaaataagcaacacttaattggtctgaaagttatacatataagctttattattgcttcagtggaagttgtctatgcattctgtgctttgttcagccattaaacaactgggtccgtgatcttcttcaaggggccgtgaagtccctaaaattgtatttaaacattagagtggctgcattttaagggagatagtacatagtcaaatatccaaaatggacctgtgtcctaatagaaaattaagaaccacggggtaaaaacacgtaagccatactttttcttatcaaaacaacaggctgtctacatacagcctgcagacataggctagaaggaaaattctagaacaattaaatggtgttaccgtagttaaatatttcacataaaatagaccagatgtatgtattttaatgtattaggaaacaggtctgtgaacgtatttagtagaaatttgtaattaatagatgggtaccttatatttatatttataaggtatatttatactttatattgtaagatctctttctattatacgacagaaaataaaaattatatttttgtctttgaaatccaatcaaaatataaagtacttatgcttggtatagtgtctcatagtgtatgaaatataaatagccccttaaaggtcttgcttctagatattcaggtattaaataacatgattaaaatcgttttctgtcattcggagaatgaggaaggaaatataaaattattttatttatttatggcaataccaaaaacaaaagtgtgaaaaacttcacaatgcttagtacttataactcttataattatgtcttattaagggatctttcttaagacattttgaaaagctattttaatatttcactacaaacaagtgataatattaaaattaaagtatatctattacaaatacatcagtaaaatattttgtgaccgaattttaagaattttgttatatttttcaaatgaaattgaaaaaaattaaatgtttatctaacatcacttttattgacacattgatattgcataactttgaattttttcagaaactatacaagggaaattaaatcctgcatttacatttgctagcaactaatgagtgtggactgaggataatatttcttgctttacaggttagtttaaaataacacgatctgcacccccataatttctaattaaccttttttcagaactaaataaacatcaaattagccatcagaatgaatctctacaagtaaggggaaatggaaaggtaaagcaacatttcagtaatacaagccaaaaagtatgtgcattaatgggaaaaatttttggaggaagctgttactgagaatgactttttctgtcagattcactaagaagttgcttggcttttatttgtgagaatattccattttgaaggcactatttttacactggttaattaaaaatatttacccaagccacttttcttaaacatttctatttattacttttctgcacatttgtaaaaacaaattttttccccaaagtattaataattaaaaatatgtttgtctcttgaccatctacattcattctgcaatagtttgttttgggtgtctacatcttgacttgatataagaagagcttttgtcaatgtttagttactagttgatttactttgggtgaagtaatttcctggctatcctgaatcatatctgcttcttttattttctttcagaacattttgaaatgtcttacctattatatatgtaatttttcttcttccctgggttcatgccaataggcttcatcttcctatagcctcgaaggcttacagaggatgaacagagttattttggaggggtgaaagaagagctgtagagtgggcttccctctcagcccacagtaggagagaatggctacatcttaaaacttgagggactctggagcaggctcttccttgccacaagaatgtgcctcacagcctgtagtttctaacttctggtatgctttctggccattaaacaatatttcattaaaacaaatcctccattttaaaaattgaggccaagtcaaattaattaactcacataccaagtcatctatctcaccatactaagaattagcaggaagtcgacacgagacaatggctttgagagtgaacaccttcttaggggggaagcaaatggggcagacccatttcttaatcctgacctttttttctaggtccagcctatctatttatccccttttgctatgtcacatgacattgaaagtacctgtttaaatgtctgcatctcccattaaactcaaatctccttcacggtatccaatgttggatccatagtgcttggtgcatagtaggtgtctaaagagcttaacattgttgtcattgttattcttgaattaaggcttgtttatgctttgatgctaccacatggagctatggtcttggtgacagagacccttgtgtgctcttccgtcatatagtttgtggcctcttcagaattgcttgtaaactgttatttatttcaccaacaattttaactctgctccaacccttaaatctcttgccactagacctaccagaacctgccttcccaatgtcagcttcacttttaatgtttgctttaccttccttgctgttgatttagctggacaaagagagacataactgtatcttgtagccaactaccaattgcttcactccaatgtcagcttggaggatactttgtgcagctattttattcttttttagttaatgtcatatcaaattctccatggtacatattctggatttttccaggttttctagtctgcccagattatctccagactcttcattcttagcagaggaccatactttttaattcacagaggatgttaaggtcagtttgggcaaattatttgtcaacactcatcttgaatacagtaagcatttctttgaccagctgtgagcataagaactcttttcttatattcagctatcgaatttgtctctataatatttatatctttaattttttacctcttagagtatttatagaaaatgcttttacatctaacaactcttaatagtgtctaagataatattcagtttcttcaacccatgcttatttaccatgggttgagagtctcattgttaccagggcttttctcttttggatgcacttctgtttttattaaagtgtgatccccagagtttaacatagaggactgtcctctgatatatttatcttctctggatatcatgtagtaaatcaacctgaaatctattctactcttcccccctccgttttttttttgcactcatacaacactgtttaattatgtatcttttttgcacattcttctgcaaatacacttattttccccatcgaattttatgtttggccacttgatttgggacttttacaaatacttactgcaattaaatttaatcattacctttagttagcctgttgttccagaaagtcaaggtcatcttggattctgagtccttgatacagaatagccattttcaccaatttagaggaattaacagatttgatcaggatataattaacatcttcatccaagtaactatctacaatgctgaactggaactacctttggcatattcctagacaccgtcctttacgttagactcctgctttacattagtccataaattattcctctttataaggctgttcaaccagttatatagtcaaataactctctttgaagttgacattcctttgtgtgacttaagagagtatactgagacagacttggtcaaattcctccctgaaatgagtctccactttctgcagaatagatgtcaagtaactgctattaaaaacaaaaggagataactaggttagttgacaaggataggttcctgtgacctctccttatcttgtagataacagcacttcacattttgaatgcttgcatgccatgtttttaatcatctctttggaatagtacctgcaattaatgtccagctctctaaattatagctgatggaatccaccttcccaattttgaaaattgaggcaatggttggactctgtcaacacttctcttcatcacaatatttttaaagatgactttaacaattcctttattttatccacacatgctttcaatattttgtagtgtaatttctccaaattaatggatttaaactcatttagaatatttgctatcattctacatgctggacctttgttatttttagttttgttctacttttataagtatggatattgttttcttaaggaatggatatgaaacaaaacaagagcagagtagttctgcctgtttgttcatgtactgtgatttgaatatctttatccagtgtgctcttcctatatctaataaaaatgccattatcaccactttatctggcaatcatagcaagaattaaaaggacattttttcttttttttataagcttcaacttattttatgtcttatattttataacactcttcttagagactcagccactattttgtacttctctcaataaagtttattatggattatgcttgtcactgaggaagatacaaagcaaagtttatgacacacactccttgacttgaaggaatttaaagtctgcatgaacaaaaccaagaaatagtctcagaattatacatgtcagcacttaacaatgagcataatatttgtagaatagttttaataagttttaaagaagttaggagaaggaagagagttcggtatgatggaaatattgagtaaggctttccagaggaaatctaagacttagctgaggttttaaaacaagatcaggatgttggacatcacaggacctgtaggatttaaatgtggcaaacagtaggaagagtattctagacagaggaaaggaaaggattcactgcagggatcagatgtgtgtgtgggtgtgcatgtgtgtgtttgatgtgtgtgtgtgtaccctgtgtgtggcggaacgggtaatgctgagccttcccaggccatagctttgaagtatttatttgtggagaacaccacttttccatttctagcttttcgtttccccttgttcaatctttgtggggcccacacctacacatcttgtagatctcaaactaagctctgcttcttaaaacctttccctgaacttccaagcctaaattgcatgccttattatgttttcctgtaacacattgtgcttcctttgtagaattattatgatatgaataattacttgctgaatttttactattatactgatacttgtggagagaggtaccatttctgtttagttccccattttatacacagtcatctaatacaagtgctcaatggctcataagcactcagtgaaaacgtgtgctatggccgggcgtggtggctcacgcctgtaatcccagcactttgggaggccgaggcgggtagatcacaaggtcaggagttcaagaccagcctggccaagacagtgaaactccgtctctactaaaaatacaaaaaattagccgggcatggtggtgggtgcctgtaatcccagctattcgggaggctgacgcagagaattgcttgaacccaggaggtggagtttgcagtgagccaagattgcgccactgcactccagcctgggcgacagagcgagactccatctaaaaaaaaaaaagaaagaaagaaagaaacaaagaaacaaagaaaacatgtgctatcatgagcctacttggaacagtgaagttatgtggagagtacttgtaaaaaaaaaatgtttaaaataaagaagggttagattacaagtccagcatcttcgttctttatatgcttattctaacagattttttctatttttaaaatttatttctttttacatcttaagcttttttattaaaaataaagacaaaaacacacaccttagcatggacctacacaaggtcaggatcttcagtttcactgtcttccactgccacatttctcactggaagatctttagggacaataacaagcatggaacagtcctcgcctatgaatacaatgccttcttctggaataccttctgatgaaactgcctgaggctgttttacggttaacttatttttataagtaaaactagtaccctctaaaataacaataaaaggcataatatagtaaatacataaaccaataaaatagtactttattatcactatcgagttttatataccgtaggtaattgtatgtactatgctttttatatgactggcagcacagtaggtttgcctgcacgaacatctccacgagcatttcagttatgcattgtgctatgacattacaatggctatcagtcactaaggaatgggaatttttcagccccattataaacatatgggaacatgattgtgtatgtggtccatagctgacagaaacattgttatttggcacgtgacagtatatgcactggaatttttagctgcttatttttctccatttgcaatatcactttgcagcttcaaatatgctcattataagcagttaaatgatatgtggtttttattacattattaagttaataaaataagtgacaaggagtttcagtattccatagtataacataaacttttaaattgtgtatttgtgagcataaagttatatcaagatctttagcactatatatgaagtatttagagagttacaaatgtagcattgaaggaaatttgggtaaatgcaataaaattgtcagtacatgagttgtaaagcaagatatccatatattagattagcactatacatttgtaaatatgattagcaaaaggcaggcttcccagcgaaaacaaacgtctttgggtaaaattctatttcttttaatgttttaaaatatttgtagtcactaattgtaagtcatattcctctttgtccagctctatcccaaataacaatttaatacaccgcagcatctatttctgcttattttctgtgtcactggctcagaataattcataagcccttgttgtttcatcttatgctaacaaaaatccagcagtggtatgtaggagagctgtgatatgccctgataagagtttatactttggagaacaaattatcctaattaaagtcactgcttttcttctcttctctctctcctcctctttgaagctgtgagagtttatcttaacctagactggttaccacctatggctttatggcttgcctgctggcttggctgagagcaagaaagttgtatatgagggatatcacaaggccaccttccacaaaaattgctctcccacttggtcctgtcctaaggcctaaatctcctttgggttgatgcaatcttttggagtgtctcctggagtcaataagatgcctgttttaccgtgaagagcagcacaatgaagaggttgcccaatagcagtggttacttttattatgttgtctttctgccttcaatcaagagcatgacacttggacatagctttttaaagtaaagagaaaaaggaaactgaaaggctcagtatgtgggacatagataagaaaatgagacctaaatagggtgtattgggcaacaatacagggcttaaatagaaagaggaagaccaaaagaaagcaaagaatgtcctaagaagagctggtttttttttttttttttttaacaattttgttgcctattagttttcttcattcctggggatggttgggacatttttccacatcggcatgttatggccttgattatctacctaaatcaaaccagaggaaaatcattttagtttatttttatcttaacattggatctgtttcagcgcgtcctggaaattagtagttgcatgttgtcaccgtctattttgtacacagtgaaaaggtatttggctgtgtttctatttacattcactgtccttgataaatactaattggccagtgattgtaagtctcaagaatttttgctgcagagcgtgtgttaaaactcattttaagtggtgtaggagtcatgcagtgtttatcacttaagtgggtaatctgacagctgtattttactgcctgactgcagctttattcttgatcattctcttccttgagtagtgtgttatggtcatgttgtcttagctgcaattaattcccaacctttttttgttttccagtctttgtcttttgcatttatttttctgctcctgcaatgccttactttgctgtctctgcctcgctatttcctatttattctacaaagctcaccttaagtgtcacgttttcagggacatgtttaccaatgtactgtacaggggcacatgcagattcttcatgtccccatcacaacctgtcatgacatcacactgaactgagtttgtgtggtctaagtctgtccgccccaacctttactcaaaacgttccttaaggaactaggattggattgtttttatttctttgtttttgtttttaatccctgaaatttcgtcctttagaatgtagtaataggtacctaataaatatttttggcatatgtgaatgaatgagtgagtgaataaataatcagattagttgatgaaagattctaagggaagattaggtaatgtgattataagagaaagatcctgaagaatgcttgggaatggatcctttactcatacatgattttgttcatcagcttatatgtaggatcacagtcatttggaaaatattggtccattgaaatttatacattttccaaatggtgacacacttcattatacagtgtcaaaagttagccttcatgactatcaccactgatctcatcaggaagttttaagtattggatagctataagctcacaatggcagtcctagatagtgcagccgtggattgaaaaagtgttctagtttcctctttttaagccaagaatccatccttaaatataagaagaaaatcaggccgggcaccgtggctcacacttgtaatcccagcactttgggaggccaaggtgggcagatcacctgaggtcaggagttcgagaccagcctggtcaaacatggtgaaaccccatctctatgaaaaatacaaaaattagccgggcatggtggtgggtgcctgtaatcccagctactttggaaactgaggcaggagaactgtttgaacctgggaggcggaggttgcagtgagccaagttcgtgccactgtactccagcctgactgacagagcgagattccatttcaaaaatatatatatatgtatatatatgaaaaaatcaatagacttggtcttagaataaatattaaaatctaaaataataagtttatataaaaaattagcaaagtggaattacttcttatgtttacatttaagaccaagaaaaacttcaagatttcaaaataataaattattagacaataatgaaattacaaacattataacaagtatactgatagttaggaaaaataatagagttctgagaacaaactgcgttaatctccaaaaatgtacacttatactttaaacctactaatttagaaaattctacacaaatataaattccattagaatgattacatcatcacatgtcatgtagtctctggagaactctgctgcaatctgtgagagaatgagaatgaaaaaggtgcataatattagaatattgttatgaaaatagttctgaccatgcatatcctctgaaaaggtctcaggacatccccaagagtttgcaaaccacatttcgagaaatgctgctttaactcaaatgtgtcttgaacaaggtaaacataaaggtttttacaataattttatatcaagtccagtttataatagtgaacatttcttaggtacattttacattccaagcattaatacaactgcattactttaatcaaatcccttgaggaatgttctattctcatcactgttctacagatgaaaaaatggatgatgcacagagtagataagtcacttgcctaatgtcatacatttaattaataatggaaccggtatttgtagccagggagggttcacacttttacttactatggtaattactatggtaacctttctgcccacattgcaagttttcctgatgatttgtgaattacccaagttttgcttataaacaatagcatttgttgaatgtctagcattttaagaaactgccaaactgttttccattcccaccagtaatctgtgagatttccagttattccacattgccaataactcttgacattgctgaactctagaattttagccattctaatgggtttttgtttaataactaataatattgagcatatgaagaaatgtttatgactgtttatataccttctttaatgattgtctattcagatgttttgcccattttaaaatggaattgtttattttcttactgagttggaaaactgtatattctgaattaaactcccttgctgttgtgtgttacatatattttcttctagtatatgacttgtgtttttgtttatgtaataatgtcttttgaagagccaaagtattttttttattttgatgaagtccactttatcatgctctttttaaatatttcatgttttttttttcaaatttaagcatctttgcttcaaacctggtcacaaagaatttcttttatgttttcttctgtaagttttatagttgtaactttcgtacttaggtttacgatttgtcgtagtctgtttattttgctataaaagaatacccgaagttggataatttatttacaaaagaggtttatttggctcaatgttctgcaggctgtgcaggaagcatggcaccagcatttgcttctagtgagagcatgaggctgcttccactcatggcagaaggtgaaggggagccagcgtgtgcagagattactgagagagagaggaagcgagggagagagagaggagacaccaggcttttgtgtaacagccagctcttgaaggaactagtagagcaagaactcactggctatcgtgagaacggtgccaagtcattcatgagggatctgcccaatgactcaaacatctcccatttcactccacattcaacactgaagattagatttcaacataaagtttggaaggttcgaatatccaaaccatggcatggtccattaagatttaatttttgtatatggtatgatgtgtggataaaagtttatttctatttctatatggatttccagttgttccaatggcatttttattaaaaaacaaacaaacatattttctttcctgattttattgccttgacacctttgttgtaaacacaattgtggatctctatctcattgatctctttgtcacccctttcaaactgatacctcactttcttgattactttaactttttaagttttgaagcaggtatataagtccttcagtgctattttttcttctttaatattaatttggctatcctatgtcatcaatgaaatcttagcctcattttgtcaatttttactaaaatgatggctgagatgttgattggaattgcattgaatctataaaccagtttagagaaaatttgtaccttaacaatattatacatggtatatatctctccatatatttagaccttccttaatttatctcgtgaatgttcgtagttttcagtgtaaaagtcttgtaagcctttggttagatttattgctaagtatttattaacagtatcataaatgagtttttaaaataattattttccagtatttgtggctagtacagaagttataatggaattttgtatatcagtcttgtatcctgaaacattgcttaatttacttcttagttctagttattttgtatatccactgggaattcctacatgaacaattttaagtatatgtgtgtgtgtgtgtgtgtgtgtgcacatgcatgtgtatgatccttgaacaacacaggggttggggcactgacactcctgcacagtcaacaatccacataaaagttttgactcctcaaaaacttaactactaatagcttactggtgactggaagctttaccgataacataaacagttgattgacatgtattatatactgtattcttaaaataaagtaagctagagaaaagaaaatgttacaaagaaaatcataaaggaagagaaaatatatttaccatttattaagtgcaagtgggtcattataaaaaatcttcaccctcgttgtcttcattttgagcaggaggaggaagaagaagataaggggttggttttgctacatctgggatggcagaggcagaagaaaatttgcatatgagtggacccatggagtttgaatctgtgttgttcaagggtcgattggatacacacacacacacacacacacacatgcacacacacacacacatgcacacacacacacacgtgcacataaacctgcaaccttttggccttttgtttaactgattgcaatggctaggacctaacttctgtacaatattgattagaagtggtgagagcaggcatctttgcttggtcctgaataatagtggaaaagtgttcagtctttcatcatcaagtatgactcaataattatagttttcatagatgctttctgatgggttaaaaaaattatgattgcagagcttgtctcacttgttctcattattagtgttggagtgggagtctcttgtgactttctgcaatttaaccagaagtcaaagaccctgtactttgagctaacttttgtgctctgtatagtaagtatttctatttacagaaagctacaaatataggtaacaaaagaaaaggatttcatatcctcacaatccttctttcaaacttgctgtttcccaatccacagatcttaatgtaatctgtactcagttacagtgtagtactttatcactataactccttattttcttccactttcagtctactattcttattcaaaattttgccttaaaagccataaacatctttctaatttaaaaatcaaatgatattttctcagtcctccttaccctcttcagacttgtgacatacacttcttttcgaacacgtgtcctctttcatattcattctcattgtacttttctaattgctgcttctctgtcatagtcataatactttctccagtccttaaacatgaggattccctggagttctaaatttggttatcttctctctatatatgtagcctcttgatcttaaacagttttagttaaactcctgactataatggtttctgctatggggaggagcacaaattcatctctaatctgttacacatttctgaagtaaatactccgattttcaaaagcacctccaccctagattccctgctacctcagttcaagatccatgtatctaaaacaaattcaacatcctttctctcaggcctactgctctgtttctgttacctgtttccatgaacggtgctatatctttctacacaaaacttcagagtcattctattcctcagatctagtgagttgccacatcatgccaactttaattttataatatctctagtagccatcttttcctgcctctttcccacaatttccttcatttcttgctttcacttacactgttctttctctgtggcgtgccccttgccaaaatcttaattttcagaacttagtcatttaaaaaaataagctcaaattctgtacattccaagaaggcttccctgatgattcttttgccaccaccgcctaaatctgatatttcttataaacagttttaactctctatctttacttattctccctttttattgtagccattagctatttaataaaatttcttatatatacataagaaaattcgactgggcacggtggctcatgcctgtaattccagcactttgggaggctgagcggggcggatcacgaggttaggagttcgagcctgaccaacatggtgaaaccctgtctctactaaaaatacaaaagcattagctgggcgtggtggtgtgtgcctgtaatcccaactacacaggaggctgaggccggagaatcgcttgaaaccgggaggtggaggttgcagtgagccgagatcatgccactgcactccagcctgggcaatagagtgagactccatctcaaaagaaaaaaaaagaaaagaaaattcagtgtgtgtgtgtgtgtgtgtgtgtgtgtgtatataccccactcatatcaggctttgaagaaaattaaagaaaggaatattttttgtccttttatgaaacagtaaattttgattgaattataaatggatctactgacaactcattttaaaatgtatttccaataagcaagacattttagaaactctgatttagctttcttttatttgtattttatgttttttctggttcatgttttgccccctatattgattatagctaatagcctaatattaatatattttattgagattagttaatattaattgagtggccaaatgatggatgattctgtgctgagtgtttctgataaggcagtcaagtatagaaacatggatggtttttcatttagctgatttcacagcaaagtgcaaaaggaggataggaaattacatgagcattgttgatttctttatcaagcacagaccttggaaatgcataaactctatgtatagtgagatttcactttttctgaaaaaagttgaaaaacaacactaataataagtaaaatagaaaaagagaatatataggaaaacaaaaaaaatggcttgtcaaattgtgtgtcatttacagaggtgtgtttgtgtcttcacatacaaagaatccagggaaaataaatggaaaaaaattgaataaatttaataataacaatttagttagcctatctatgtcacttccgtgtttataccagatgactcagagccagtagttctttcaatttcagcagaaaataattattggcagtcccaaagttggataaactgtgacctgcattggctggtttgattaaggctggaaaatagcaaacttgattaagtgacaaagacaagataatgaggaaagttatttagaaaatgtgtttagagatttgaaaagggactaaaagatagtttctcaagaaagtgcaaaagaagatgagaaaattatgaaaaagagtctggggcaacattttaggaactgtagacagtgaaagcaattttataatgtatgttaatattagcatgatatatagacgaaaggtaatcttctgattggtctgagatgaagtagttatgttaaccctcaaaagatgatgaagtgtgaaatttgaattcagataactaagttttcaagttttctcaaagtattccctgcagtggctggtggtccacaaagaaaggagggcttctcagcattttcagtagaggaggtcatcagggtatattgggtgaactcaatacacctatacacctcctgagctttggggtttgagccacatcactgaagtctgcactctgtcatctgcaaatggaagggactgcaataaataatctctaactcctcttccagttctaaactcctattatgcaaatgactctgtctttatattgacttttatgtaagaggtactgaaatgaataggaaaaattgtttggtatttctttaaattttctctattttgaatcaattagatggcagaggcattaaaagaatatagttgtgggtttggatttaatgggaaaagactcagcctttctcaatatggactttgcaagcatccaaatatatacctgcaaagtatatgttcagaagtccaaattcatttctggtaatgattcttctaaactaatcattatgtaaaaacttggcagaattgagtttgtgttggaatttgccacgtcttttgctaacctgattccagcataagcatcaaggatctgtgtcccagtgttatgacaaaagttcatttcctgtcttaagaatcagaaagagctttactgctggtcagaaaactagaaaaggtacctgactacccatcaattactaataccttagtagcctggtcccctgggccacctccaaagaaacatctgctgagtctccaggcctcgaatctcacacttcacttttatgagccttttctctggggtcataaaagaaaatttctctgagaaacgtactttgccaaagtttatcccttggctttgttgtaaagatcctttaaatgtggcagagacaccaacagcctttttagctgcctttcaattcttctctgatgcctaaaactagagaggctcaaagtgaagttttcaaagggagtctccttagagttcactgggaccctggaagcatctctcatgccttcattttgggaatatctaaacttcattaccttaattgacatgcccaacaacctgatctttcattttattctgtacactaatttaacagatacaatttagtctttgttttcccagattacattttttagtaggggaacttgaataataatcaccatgatatgtcaaaagctcctggtttctcaaggcagctccacagcaggagctctgtagttagatagggttgggttcatttcctgtttctgccactcaccagctatggccaaggacaagttacatgatcgatgtttcagattcttcttgtgtaaaaaatactaaaatacacaaacacacactcacacacccttcccataagattgttgtgaagattaaataagataatgtatgtgatgtccccaacagctctttaaagcaggagtcagtcaacagaccccatcaaggacaagatagtagctacttaaggctttgccagtcatgtgacctccatagcagttactcaactgcacagtttgaacacagtagccatagacagtgcataaatgagtgggtgtggttgtgctccaataaaagtttatttatggacatagaaatttaggtctcatataatgctcatgtatcactgagctcctggtgttctcctgcatgacagcttagctttgtctgaccctctcagccctgctccagcttccgcagctcctccaccgcctgaaccgcctccattgatgcatctgttcttgttctccttgtgttttttttttttttttttttttttctctttgctgttctttctgtagccaggcctatacttctccattaatgtgttcttgattaggtttggtaagattctatctccagcattgcatagatgtcttaatttttcatagctgtataagtttcttgtcctttctctcaaagagcttggaaaaatttccaaaggctggattagaagaactgtgagagtcactagtgtctcttattccagaatcttctttccaaatatgacaagttagagtccagccagtttgtctttcccctaccattcggtgagttctgtactcacaaggtcactccttccttcccatcaaggatgaattgaccttggtatctcctcattgctcagaaaggtaattcaagtgttccacaggtcaatcccagagtcacttcacttttgtcaggaatccctgtgtctcttactttaactggactctgggtgacctatcttgtttgcacaaatatcttaaagtgaacatgccaattagtgtctcacctctacctgctcacaacctaaacctttccaccaaactaacattgagaaagtaagtagataaaagaattattggccaggcgtgatggctcatacctgtaatcccaacactttgggaggccaaggtgggtggattgcctgagttcaggagttcgtgaccagcctgggcaacacggtgaaacctagtctctactaaaatacaaaaaaaaaaattagccgggcgtggtggcgtgcgcctgttgtcccagctactcaggaggctgaagcaggagaatgacttgaacccgggaggcagaggttgcagtgagccaggagtgtgccactgcactccagcctgggctacagagcgagactccgtctcaaaaaaaagaattatcactgaatccatatttagaagaacagttagcttataaaagcaataattagagacaggattccttgtataacaaatactaatcatttcccaatatggcattctgggaaaataaaatcagataccacaggatttctatttaagtttggttgttatgagattttgttttgttttcaaatttccacattgggaataatatgaattaataaaaaatagtgagtagtgcaatggcataaggcttgcttgatttataaaatagttttggcttaacgagtagaaaatgaggtttaaaattcaacatagtcacccagtttttatattctaatatttcattaaaggaattagacatgcaacttattatataatagaattagataagataaaaccaaaatagaatctttctgctctaagctgtgctgcaaattctataattttttagttcaataaaaagaactgttgacttagatataactttcttggtatattctctaatgctcatcaagtaaagattgctttctatatttgtaggataatgagcattggatatattattagagttcccttaaacaagctttgatgcatgaaaaaaatggtttcataagtataaaacattaaggaatctttctgagaagctagaataaaattgtcaatcatttatttaataacttatgtcagcacaattttcttgtagtatgcaatgagcatttacatttggttgtatgtaccaaaaaaaaattttagggttgctctgaagttatcaaggagacactgatcatttttttcctgttataaaaagttgcctagagctctagtagaagaagcatcacagctttcgtaaggcaagtgactgaagacttgatccaagactggacttttatctttttttaaaaaaattatggacctatggatgctaggcaagaccaggcactttatatatattattccaaattcttaatttgaatctgttacatcatgactttaccattttatgtgtgaaataacagaattcatgaagttatgaaacttgtccaatgtcacactaccaccgagtagcatttgtgatagtcaacatgtattcctcccatactgggtagcagtgcttttctaagtgctttctatttattgctttgtttaatctcacaacacatttatgagatagttgctattattatccttatttttcagatggagaaaattgaggtgaagttcagttaagaacttcactaatgtcgcagagttagcacatggtagacgcagggagcaaacacaggccatctgttcatgtagcctaagcttttaactgctacgccaactccactgcctcagggaacaactgggcatggcacctacatttatgtgaacccaaccctccaaattatgaagtctctgtcatgctaattatctgcatgagacatgagacatcaggcacttaaaaactcaccattacagggccgggtgcggtggctcacatctgtaatcccagcactttgggaggccgaagtgggcggatcatgaggtcaggagatcgagaccatcctggctgacacagtgaaaccccgtctctactaaaaatacaaaaaaaaaaattagcctggcgtggtggcgggcgcctgtagtcccagctgctcgggaggctgaggcaggagaatggcgtgaacccgggaggtggagcttgcagtgagccgagatcgcaccactgcactccagcctgggcgacagagcgagactcctcaaacaaacaaacaaacaaaaaaaaaaaaaaactcatcattacagaagagggaaaataagggtgtgtgtatgtaagtatgtatgtatgtgtgtgtgtttatgtatgtctctacatcaaggatgtagaggttttactttacttccaggccttcctgcctgaccaaaatttaaaagaggagaaattatgatgtcatgtaatcatcaagttcattatgtcacctaaaagaaatctatcaattagcccaattatttaatcaaggatttgttgtcactttaaaagtttcatcagattattttacctaaattataatgtactctgtggagtctcagaaaatgtgatcttgttgagtgtttcttccaggttggtaggttggcttttcaccttatatgcaaatttaaatcaaacattgattagtgtaggagtatttctgatataacacagcatagatgttcttggaaaacctcatatgcttcaaaactgtgcactaaaaataaaaggacttagggaaaaaatgtgtttgagtgaaatcattcaatgcttacgagcactaacaaaagcaaaaaagaaaaaaaacaaaacaaaacaaaatccccaaaatataaaagtttagttaaaagatacattgaattctaatgaatactgcacctcagcaattgtaggccttgacctaaggggaaaaaagtgaaagtagttggtaggaaagaactataagacagccttgagtctgctgagttatggagacaagagaaaaatacaggaaaattgtccaacagtacttctacgacagagcatatggtcagactgggctaagaggaagaatggggagcaaaggggatctagcatgcctgcattttatcctgacattatttccctagcgatagatgtgcctgagccaattgacattcctgaaatgtacagtacttatttgaaaacagataaaaacaaaatggctttttacagagtaaaaaggaattacatttcttccttaactcatttcataatcattactatattttcagtaagtatattttaaagtgactaagcctctgcaaggaactattttagcaatgtaactatgatgagaatcatagaaaaagatgcaagaaattgttttatatattttagggaaaattggttgaaaagtttatctgatttcctcatgatcagcatgatgcatcataagtagtgatgatacttaatttgaagatgtttaactgcatgtattcaaattgtagtcatcacacgggagagtttttaaaatatattttaggatttataatcccaaaggtttttctcttaaattagttataaaacattctgtaaatactttgataaaaactgagaaacaaaatgtgaatttgaatacttaaaatctccctactatagagttgagtgtactgaattttgctattatttcaaagatgccacagaattgcctcttaaatctaattttaaaagattgtagattgcactcatcttattttaaataaagatttaatgcagcttattaaacacaatttgtgtccagtactgtagttttatcaaggcggttgccacccggcgagtcggggggcaggggcactccaatatgattattgaaagtgaggttgccgttgtctttagagttgacctctctgttttgggagaatcatcagtatgggctcttgagttacaaaaatttaaggtaagcatcctcctctttaaaaatagcttgagacagctcacacttacatgtagatgcagtccgttaggaaggtgaatgccctactcagtaatagaaattggagtgaacaattactgggcttttgaacaaggagaaattgcttcccaaaatgagattttaacagaagaattggagtaacctaactcccacaaggtgttatataatattagaaatccaagctctaggcttggttaagattgaataaccagagtcatgggaaatgtattatggactattttgattgtgcactatggtccctagagtttttccttggctgggatattgagaagtaaagtcagaggaatgtgtcttccctctgctttggtccccacacccagtcagtagcccaggcctgcggattctctctcagaattacttctgcaattgattcattttttccccccagggtcctgtttttgcccaacccagatctaccatctgtcctactctgacccatttttcattctacattccaaataatcttctaaaaatgcagtctaattcacttactctcttgcttattagttatttagttgattgcccttagaatagagtattatcttgtttaatgcggtttgtagaactctgcaaaatcctgacctctgtctattttgtctctcaccaccattatcttgctctgtcttaacctcattcatgcctttgctacactggaattacttctgttcctagaacattggctcccaagcatgctgttctttctggaactctcttggcctgacgcagctcagatgtttctgagaggactaggttcagatctctgatttacattcccagagcactatatccctcccctttttgcagcagaggccacccttggaactgatacatcagaaatagttttcctcctggattgtaagttcttgagagcaaggggtgttctttacacatcactctgaccttgtgtctagaaaaatgcctggcacagagcaagaccttcgtaaatatttgttgaataggaagaaaaatgaacaagtgcatgaatgcgtgaatgatgtagaagacaatccagtaataccaaagaatctattggaatcaaaattattaaaaagaaaatgcagatgaatggagaatttatgttaaaagccaaaagagtcttgagctttgacttttaggcatcatcaaatttaataaagagatatcagtaacatactaaagcaaaagccagatggttttgaacttaagaataaatatgatgtaaggaaatgaacacagcccataaagccaacctttcaaaaagagtaacaataaagggagaatggtagtgctagagaggaatgatgggatgaaggagtctgagatttgtttgtctctttttaactttgtggcagagagaattggacatgctcaccaatttttctactactttgtcctgctttcctgatataccacagggaaagttctataaacatttcctactacaaagtgaaaagaaacctattttaaaagactggtttatgggattttatgtaatatttttcaatttttgagtaaggaaaactttctaagttttcagtctacctgaaaattaagcctttttccttatttatgaaaatagttgttacaatttgtactgaagtatacaaactttatccttactaaggcaatttgcttttaagttttctcctccttttggctactcttaaaaatctggactttcaagtttaatcttaaaaagctcatatctttttaatcacagatattggcatgtccaggtaccaggtatgatggtagacatttgatacagctaattgcttttgtgatggatacataatttttaggcttgcctcttccctgtaacttttttcgatttttttattatttatttatttcaacttttattttaagtttaggggtacaagtgcagtttgttacataagtaaacttgtgtcatgggagtttgttgcacagattatttcatcagccaggttttaagcctagtacccattagttatttttcttgatcccctccctcctttcaccctttacagtccaaaaggccccagtgagtgttgttcccctctatgtgtccatgcgttctcattgtttagctctcacttataagtgagaacatgcggtgtttggttttctgttcctgggttagtttgcccaggataatggcctccagctccatccatcttcctgcaaaggacatgatctcattcttttttataactacatattattccatggtgtatatgtacgacattttctttatccagtttatcattgatgggcaattaggttgattccatgttttactattgtgaatagtgttccaacaaacatacgtgtgcatgtgtctttataatagaatgatttatattcttttgggtgtatacctagtagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccagagagtgtggtaaggggtgttttccttacatgatattgttacatgtctacatgatcttgttacatgtagtaaacaagatgttcatgcctaattgaattctaggatgggcatggtggctcacgtctgtaatcccagtgctttgggagactgaggcacgtggatcacctgaggtcaggagttcgagaccagcctggccagcatggcgaaaccccatctctactaaaaatacaaaaattagctgggcatggtggctgccacctgtaatcccagctacttgggaggctgaggcagaagaattgcttgagcccaggaggcggaggtttcagtgatccaagatcatgccactgcactccagcctggatgacagagtgagactctgtctccaacaaaaaaaaaaaaagttcatgcttcattaaattttaaattctagagtttaaatgattgagggttgccttacttgcacaataatctgtccctgttattaatactaggccagtagctgggtcattattctcaccacggcaaagttaatcactcactagtaaaaagagagtgagcattaagtttatttggaggctgtttaattatcaacttttggaatgagaagtacctcttcaagtttctgagaacatattattccacttcttgccaaggcctgtcgccaaatttattattttaatttatttgtttttcccttaccatgttactaccatctctacaaccaactatgtactgaattcacccactgaccaaaccatttctgaagttactgctaacgttacccataaaaatcatcactagtttacttgaggaacaatcttttgcctgccaggaatattctgtattctgtattcctggcaggcaaaagcaagacaaacaggtttccaaggtatcaacactgcgtgcatctgcttcatagtgtaatttcatcagttgagcagatgaagaatgctaattagtttgtttatacatatgtaatttaatgagactaaacacttaactatcttaaagtaagcacaacttacttcctgttggctgtttttgctttaataaaaaacactgttcggcttatttcctggaaattatagtaccgtgcagtacaggaaaagaaattatttcaaggaaggttgactggtcaattgtattctactgcagctggattcagtaggaagataagaattaaaatattgggcttgggtaccagcgttgaaatccaatgtgaatgagagagttaagtttaatggaaagatctattataaactatattatggcaaacttctaagtccaatactaaaattctaatatataccagaataattcgttttagtaataattctatgccatcctcagacctaacctataatcttccatttcttattgtcttccttttgtttttatgtacccttttttgctagttattgtagttagattttgatataactgaaatagtggcattcagttaataaagctcttttccctgaaaattaatacaaaatagtggtactattatttgtataaatagttatttagtattatctattacactctttttgattactttgaagttgttcaaaaactggatcccagccaggcacagtggctcatgcctgtaattccagcactttgtgaagccagggcaggaggattgcttgagcccaggagttacagaccagcctgggtaacatagtgagaccttttctctactaataataatgaaaaaaactctccaagctccccaaccccaaccaaaactggacctgcgtaggctgttatttttggagaggagtgactagaggagatgaggaaataactttgctcctatagtcaaaattatattttaattaaaatgctttagttaatatactcggttttctacaaccaggggtcagcaaactactggctatgttcacagtctgcttttacaaacaaggttgtattggaacacatctgtgcccattcatttgtatatcatctctggctggcttcacactgcaatggtagggttgaatacttgcaataaagaccatgtaacctgcaaagctgacagtatctattctcaggccctttacagaaaaggttaaagcacttttaaagcttaaagctgatcattgatttgaagcttaaatcagaagagaagttattaaacaataatagaattatgttgagatgtagtaaagactaagaaacaaatatttattacattaagtcccaaaacaaatgtgggtaaaattattagatatttaggttttgtagaacctaagtaatcattccccctatagccatattacctttggaccacttcagtagtctattgaggtagaccgcttccattctgttctggcagaacaaattttctactcataaatgcataggattttcttttgtcccttcttgaagttccataaattatatatgagcatagattttgtttataactttaggtaacagagccttggcagcttcttctggcctgccagcatccataatcttcctctatacctaatgtcccatgacatcccatggggatcagatactgaatttagcttccttgtttgtcccagttcagaaaatgagttgttcattgttctaaacttattagatgacttacatgtgacaatttacaggctgttgcttatgggaacatattaagggcattgaggagcatagaaaataaaaaaaaaaaacctaattgaacttcaactctaaagattcaaatataaggctgaatcttggatgtttcagataccactagccaatgaacaggaaattatgttcctcactgaattttaatataaatttgtaaaccatattttgaagataaaaatctaagttgattaacaaagcccgattgtgtagaaactgctctaatttagtaatattagtttggagttatagaaaacacattggctttggagtcagctgaatctgcatttgaaccctagttcagtcattctctagcatttgaaatgagagaaaactacctaaacttttgagcttctcacccattggggataataatacctgtgttatgtggttgctgtgaggattaattgtaaacatagagttcccagcactgtgtcaggcacatagtacttagtacatgtggggattagcaaatatgggttcttttccactctttgtttttcttccccaagagtaggaaatagctggtagacccagttaatcaagataattagtattgttgatgaactgaattcacaacttgacagttccagtaacaaatagctaatgataaatgggttgtgaattgtgggagaatttacaaccacagcatcaacaaaaacaaaagtactgggggaaatatgctggaatggcgatgcttatgatttcagtgggaagtggggtagtctttgactcaccgcagtctagatttgtttccagagacccctgcaaatcccatggtatgttcttggggatcaggagttctgatgtttttttcattttgatgataatatttttaaattgctttaccatttaaagtgataaaatttttcttttgccataatcatcttcattgaactttttttcattgaactttttttttctaagttggtgtttcaaatctgaaaacatatacttggggatcattatacatattgttttgctttaggtatttttggaagccattggtttttactgttctgacttttcagaaaggagagcataatgagaatgtagtagtacaagcatgaataaaacataaacttagatgtggcttttgtcataaaaccgtggtgttccactcttgtgaaatcaaactggaccagatgagtgtaaaaaatggaaatcagtagttgatgctaagaacattttggaaaaatatattttattttaaaagttaaaatagtaagaggaagtattttgctaatattgtgaaattcacacatattaagtaaagatctttgccaaatgtcctgctcattttataattggcatttccagcagaatttttttaacttgagaatgacatgactattgcttttgctcacctgtctttttctgttttcatccgtgcataaagtcactcctctttctgttctgactttttgctgtccatagacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagaggtgagtgcgtgctctttagattttgaaattgtaatactttgaaattgtagaagaatgtttttccaaggaaaatttaaacacttcctttctcactttcaaggctacaataaatgtagaatattttcttgaaacacataaaaatattcttttaaagcaattgtgttcttaagttgtgttttatcttaaaatgtttatgatcttgaattcttttcaaaagaacactgcagtctgacaaactttatgattttgggcaacaggcttaatgcctctttacctcagcttccttatccctaaaatggaaataatagtagtacccaccttctacagttttaatgagttttaagtgaaaccatccatagctcttgccataacataagtgatcagtagttgttagctattatcttaaaattaaattcttcaaagaataacttattttctgctcaaattttctctcctaattttaaagagcatcatacgtcccctgccagttttcagagttgtgaaaatctcccttggccacttgctctgattctgaagttctgctcaagccagtcttgactttctcccttgggtcggagtcatgagcctgtgattgcctacacctgcgtgttattaggtctcacacttcttcatatagccctgcaagctgcatagcatagtgtcatgttgagatctagagcaccttctgtcaatccaccttgaaggaaacttctgggaagaggacacagacctaaataaatagaagagcagttgaaggtcttcatgatgtcttcctccctctgtcagtcttcatagttttatatagatttgcttaacctatgaatttggctggacattgacttaatcagacaccagctaacataatacattgataatttttaattgactcaataccaaccctctactgtgtgcaaagcaccaaagaaacatggactggctgattttcagaactgaaaggaatttaacagataatcttgtttcactcccaggaagtgctagggaagttcagtgacttgaccaaaattacacagctttcaaagggtagagcaattaattcctgctgtaaacagtccaggctggaatgactgagaaagaagaaattgaagtttgaaagatggataaattagacttagcagaaagttgagggagtttatttcagatataatattaacacaatagtactttggcagataacctttgaaatggaaatgtttaattattcttaccacactctagttgctagacagccagcattggctaggataaaggatagagccctcctcagggagttggtttgtagcacagtctgggaaacaatcggtgctctcatttcaaggacagagtgaaatgaacagaaatgaaccaaaggtgatgatgaggaagctgagattgcttctatgttttccctgaatcctgtccttactatgttggctttatcattttgtttggtaaattttgaatttctgcaatggaagtcatacacatattggactcttttttaaaaaacattatggttcacctccagcctgggcgacagagcgagactctgtctcaacaacaacaacaaaaaaattctggttcacttgatggtgccaccaaaagttccacaggcttccttcattctttttcattcattcttctttttgcccttctgactgaataacttcaaatgacctctcttgaatttgctgattctttggcttaagtctgctgttaatgctttccattgagtttttcagttcagttattctttcattccagaatttttacttggctctatttttgtggttatctctttgttgatgtttacattttgctcatgcatagttttcttattttatttagttgtctgtctgtgttttcttataacccactaaatttcattatattgaattttttgtcaggtaattcattgttcttcatttctttagggctggttactgtagatttatttatttatttatttatttggttgtatcatatttccctgatttttcgtgtcccttgtagctttgcattggtgcctgcacacttgagtatgcagtcacctctttgcttcttttcagactggttttcacaggaaaagacattcaccaattggctcagctagagattttgagagcctctcaaacattttctatggatgtgcatgttccattcctctcttttcctgctgagggagaagtttctgggtggtgtgccttctcctgatcctgaagagccatacaggctgctataaacttcccttctctttttcctaggaaaatgtactgaaagactaggatgcaataccaaattaaaattgtatataaaaaatttagtagtctatgttgtttgttcatgagtttgtaagaataagcattaagatttgactacagtgtcatgtaacagagagggcaagactataggagatggaagaggtatgtttggcattagtaactaaaactcctctccaactgagatattatcgttatggcagtaaatgttccagtgttgaatacatttgagctgtgtagtcctcaatctagatgacttcaaacatctgcttatctttgataaatacttgttatgtttttttactgattatttgttaagtttatagatttaatgcttagactgctatttagtgtcagttgtattaataatacaaaagaagatatttaaaatagcatttgacatcacaatttttgttttagataatcagaattaacttcctggttatatttttattagtgaacaggcaagtataaaaatgtattatccttagaaaatgtaacatgagagaggtcgttctcaagtaatggaatactagagctttaaaaagtcttcttgatcatctaatgcaaacttatcatttctattttaagaaatagagacacataaatttagatctcttgcttaaagcaaaagataactggagaaatggaaaactctctgcatttcattcacaacccattgctcttcataatataatattgtttgctcttttttcatgggtattgtttcccaataattctgtaagctccttcaggcatactgtcttgaaggagcttttaatggagccacagtcaaagcaaatcagaaaccacttactgaattgaaataattgaattggatatgcttacataaatgataagatcccaaatcaagtacctagtaagagtaggatttgaagagaatcacgaggtctgtagatgtgttctagaatattaggttgaaagaagaaaaagaaacagtattacaatttatcttatgaattaaaatattattggtctagaaaaacgttaagcactgtaggaaaattaaaaagccaatgaaaatagtgacttatccataaaccacaccaatgatatttttattaaaattcacattgttgacagcaatgttgcatcaaatagcagtttttcctgaagtattcatatatggtatatttgtggcaaaagtacttgttttaataatttaatcagatctattctttatgagccaaaagataattgtttagtcaagagaaacaaacttgagagcactacaaactatttgcattggggaacaagtgtcccctctgtgaatcagaaagtccacaatctacaatacttcaggttccagtgattgtacaaataagaggatctgttcccccaaaattcaaaataaaggctttcccaaatagtagggtgttttagtgatagacaactaaaagatttacaaaagactgctacacaatgtttacatatattgaactgtaaggaatgaatttggaaggaaatattggatttagttctaaaatctgaaaccaaaaattaatatatagaattgttggggtatggagcagtcctgaagtggttgattttatgttatgaggccctgaggttggctgtgtgtgacagatctcacttatagttgaatcctgcttataattttattgtggactcatattatctcagggtcaggatatatcacaggaagtacagcaccaaggtaggaaactcgatgcaccagcagcctctaccaataaatattctgcctggaaaacatgtgagttctgtctcttatgggttttgttttgaatttacaaaaattttccagaagagcaatggtataagatgaatgtcaatttccataaaagcctattcactcataatattggtcaagtatgctactaatgctttgcacggactttattcctttttttctttaggaaaataagttttgattcaaaatggaaagccaaacatacatttgctccaccaaccttagcaattggaaggggaccatttctcctcccctcttacaatgatagtgtatacgttaggaggaaaagaccagaaaaagacatttctggtggcagtaggaaggaaatgaaagacaaataaacatcttgactaaaaaggtaaaagagtatacccaatggcttaatcagagacataaagaggagtggagtatctccagtagcatggaagaggaagaagaaagcattcttcagtggcagaattggttgggttttctttctccctggcccacaaaatgttcctggtcagggcgagcatggtggctcatacttgtagtcccagctacttgggaggctgaggcaagaggatcactggagctcaggagttcttggctgtagtgaactgtgatcaccactgcactccagcctggatgacagagcaaaactctatatccaaaaaaaaaaaaaaaagaagttcctggttcaagaagcaattaatatatatataaacaaatataattgaaatagtttacattggaaacaacctaaatttgtttgtaaacaagctaagagagtaacacctctatatctggctttatcacttcacagataaaattttatagattaagccttcaagactttgaatagctggcaggtggacatcattcattcattcattcattcattcattcaataaatatgtattgaacatctcctatggataggtaccattgtaggttttggatggaggggtaagcaaaaccgacactctctgcccttttggagcttctgttgtaatggaagagacagattatgaaaaatttacaaagttggcgagcaaatgctatgaagaaaaactgagagctcaggcacaaaggcagcaacccttattttattaaagacttcttttttcatatgaatgtattttgcaggaacaaataattcatagccactcatgctttcatggatttgtatccacattgatactctgttaactggagtaactttctactgtaccaagtagatggttcttgaaatatttaaacatttcaagcaccctggctgatttacttcatgtatagtgtcactaatttaatgttaccttcctttttccttgatgagaaagatgtctaggaaatatgcccatagtttctttcttgaacatgtttctcaactgccctttgcctttacatagctcaccaagcccgactcagaatctgccctctgggtgcgtcttccaccagcttttctttcatcctgtggcagatagtatcctttctctctatatctgaacagtctgaaaaattgttccacattgtaaatttaaattctctttaattttttttcagcaattgtgttttctttcaatacatttttaaattttctttctaagctttgtatgtgtatatttaaaactaaaagcccttttcataactcatgtcattaaaacagaaccttgatctattttggtttactccagtacctcacttgactggtggaaactctacaagagatataaatagtttttaaggaaaaaggaatttcttaacttgggacagcaaaaaatttttcactttcctctggggaaactatagaaagaatcaatggttctatatatataatatatagttttatatatatctctatatatacacacatatatagtgagagggaggtacatacatagatacatatgatttttacatggaatatataaaaatggacaacactgcttatcaatgctctactttccacttatttattagagacaatcagctgttaagataaattaatagctactcaacatgtatttattaagtataaaagcttacatacaaatgtcttgcaaaataaggaaactcatgaaattctcagaaatcaataaaagaaaataaaaccataagtatttgatgaggattattagttcaaagaaaggaaatcagtgtaagccaaggtaaacccaaggctcatttcaaataaatgatcaactaactttggtgacagattagatttaagagatcaaaaaaggaagagacagagataactccagagtttgctagacaagaagatgatatgaatgtatagttaagggcagagagtcactggggcagctgggtgtggagtttgtgaaaggaacagaaatttgcttggcttggtccatgctgagattgaagtattggccgcccgtccagagggatttcctgactcagaggaagtgatgcccatggaatcctatattgcagaagacctaacactaccaaactgaaatcttctgtttgggttcacactcagctcaactattctgtggctgtcagtgagaccaccaccaaaggctaaacctgtgggccacaacacatatccaatctcagattagtctcagcacattgcttcctctccagtttgaaaaacacatagaaaatcacttccagtttccaaagtgaaaattcataacatttatcattcaagcaattgtataatgtgctttattctcgaaaataaatcttcaggatgcatttttaaatatataattccaaacaaattattatataagggaatgtttaaaacatttcttttgaactttcagtttgaacggctgaatgttgcacttcagagaacattggcaaagcacaaaataaaagaaagcaggtaagtcaaaccactttagttgtgtgaacctcttattacaatgactaatactgctactaatggccagcagttactgaatgtgtcagccctttattgaatcattgtggtatgtcagaaactggacttagtactttagctgatactaatttcaaagtaagtgcatctatttatcacattttataaatgattaaactcaggtttatatgaagtatttagaattttatagccgtttaaggaaaagacagagctggggttcgagcctgggtttttcagagccattattttaagcatgtagttataaactgctgctttaacaagctcctgtaaggccgattcttttgtactaattggtaacttctaaaatatttaacaacaggtaagtcatggatcccaaacaatcaagacttcctgcctgaaggatgctgccaaagttttgagcagggtcccagcaggtaccccatccccaacacacatctcaacaacatgttaatactttagtatctgcatcaggaggaggtagaaggatcaagtgcttaagaggagggggactcagggttccggggggtagcagctgtttattaatccttagggaagtgtttctgtattctcctaactagtttggttgcactgcagaacatcagtttgtttatactttttttctagtattctttgaaattttcctttaaagcatttctgaagaggcttaatataaagttactttttattttttattttttttttagaaacagggtctcactctgtcatccaggctgaatgcagtggtgtgatcatagctcactgctgcccagaactcctgggctcaggccatccttctgcctcagcctcccaaaaaactgagattaagggcatggacctaaagttacttttttaaaatttatttttatttttttgagacagggtcttgctctgtcgcctaggctggagtgcagtgcaatcttggctcactacaacctctgcctccctggctcaagccattttcccacatcaacctctcgagcagctgggactacaggcatgtgccaccatgctcacctaatttttgttttggtttttgttttgtagagatggggtttcaccgtgttgctcaggctggtctcaaactcatgagctcaagcattcacccgcgttggcctccaaaactgctaggattacaggcatgcgccactgcgccttgtctctaaagttacattttttaaatctgatttatttagtgaatcaaatacaatttagcacatttactgctgacagaaaatgtaataggggccaggcacggtggcaaatcccagccctttgggaggtcaaggtagacagatcacctgcggtcaggagttcgagaccagactggccaacatggcgaaaccccgtctctactaaaaacacaaaaattagccaggcatggtggcagatgcctgtaatcccagctaatcaggcaggagaatggcctgaacccaggagacagaggttgcagtgagccaagattgtgccactgcactccagcctgggcgacagagtgagactccatctcaaaaaaaaaaaaaaaaaaaagtaataggccccgtttttgattccctgaaatttcaaggtttatttggtctataaataatagaataaatactggtgttgaaatttgcagaactgaacattggagttttacaaaccagcactattgtcaggaatgttttaacaattcattcatctgtctcctactcatgagtgatcatctgctctgtggatcatatgtgcttgattttccttgctgactagctggtcccagactgcaggcagcaggaccaagccaagaaggggtcatggacaggtccagaaggaaagagtgtgaatctatgtgtctgacagaagctttgtttacacgagtaacatgagaagcattccagaacacctctgaccttaataaccagtcaagctgataagatagtcttaagtctctcactgtgctactgtgtctgtctgcttaagtccttggcagccagtttactcaaaatttattctcagggctttgtgttctgaatcgttcctacagcttcttgcaatactcagttatgatgtgtttccagcagtgtgcctcttaaaataatctcaaaacttaagccaacaataattatttttttgaaattttgaaatttttgtttaccacttccctgatgtccctaaatataaaaaaaagaaatctgattatacttttaaattttcttgatgagaactattcagttgttgaaacaagatttttgctcataagcctgcctgctgatatgttaagtggttcctctgtgcttttttagttttggggtatcctcttgtttaaagattttttacttcactttcttattggtaagtcactgccgtttttattgctgtcagtttgccaactgctgaacacaacttaactcttttttgtgctgcttattctcttctacgaattgacaaacaaaaatccaatatatcaaccaataaactgcccttgaatgaaggactagagctgcccccctcctcttttttttttttcagtgaatgagtgttagtatagccatcatgtccctcaggattggttgcccagagagttcttgcttagtttctttttctgggatcttttgatcacatcattatatgtatgaactcatgctggtgtgtgtgtgtgtgtgtgtatttgtataaggcacacatgtgttggctggtgcatgtgcaatgcttacacccacttgtattttttgaaggtgagggtaggaattgtagtttgaattgcactatgtgctgtttggacaaactaagcttcgctcatttggcaaattttgtcataatcactcatcactatcagaaatcatcacaaacaattaggcaaacatgaatcaacaagtcgtgcagttaaaactgcaaaaaaatcttatcaataaaaaagcatgctattacagtctcaatttctatgctgtaaaacaagtgcagtaattgcatgaagaataggtttctttcattactaattttttatacaaaatcaaggattaaagtttaatataatgatatctgagagataaacacagccttaaactaagaagcaaaagattctatgtatttgctttaggaaaatatataatattacttaaaagtgaattctatctgtatgtaggtttttcttggttatcagaattaccatcctcttcttggccacttcacatttgaggttgctagccagggaaggttctcctgagtacagagtctccttgacctacagtggagttacgtccagataaacccatcgtaacttgaaaacaccctaagtggaaaatgcatttaacacgcttaacctactgaatagcttagccttgcctaccttacatgtcctcagcaacttaaagtagcatagagttaggcaaaatcatctggcaacacagtgcactgtagagtaccggttgtttaccctcacaatttcatggccacatgagagctgtggctcactgccactgcccagcatcacatgagagcattgtactccatacctgtagcatgggagaaaatcaaaattcaaactttgaagtacagtttccactgaatacttacagcttttgcaccgatataaaggtaaaaaaaaaaaaaatcctaagtctgagactgtctgtattagtctatgtaaagttcactttaaaggtaaatatttcttatgaagaataacaaaacattctatgtcatatatattttggggttttccaacattgttctggatggtatatgtcattgctcctttctcataaaattgatagtcaagatttgcttctacagaaaagggaatttaaactattttctttctttctttctttcttttttttttgagacagtttccctgtgttggccaggctagagtgcagtggtggctgatctcggctcactgctacctctgccccgccaggtcccggttcaagtaattcttctgcctcagcctcccaagtagctgggattataggcacacgccaccatgcccagctaatttttgtatttttagcagagatggggtttcaccatattggccaggctgctcttgaactcctgaccttgtgatccacccacctcggcctcccaaagtgctgggattacaggcgtgagccgctgtgcctggcctaatttaaactattttctatcattgtttctgtatattataatctgaacttttagcatgtatttataagtttataacttaaaatattgaaatatttccaggaaatctttggaaagagaagactttgaaaaaacaattgcagagcaagcagttgcagcaggtaatagaattgtttatgtaattagaaagtatgccatatacctgtagaactcacattttctccaaaaatattcatatttatttgttggtgactcccagtatgaagtgttcaatattatgtattctgttaacgtaaagagtaactctttttgatactatatgtttttgtttgacctaaaacattttctctgtttatgtttacttgctgaggagtagataaggctagatgggaagctgtctcacagatattcacaggctttgatcttgaacctaactaactgttcctcatttatacatcaaaaattctactcaacaaggtaaaataaagaatgcttttaaaggttaggagcagtcatgggaaaaaagttaacagtattctcacattaatgattagtttgagagaaaaaattgatatgtgactttgtcttgctgtcctttccaaagtttcagtacatgaaccacgaggttgcatctttctaaaagtataagatattgataataataataatgactaacgtatattgaggcccccctaggagcaaggccctattctgaatataagccccacaacagtgctatgaagagggcactattctttttcccacattacagataagaaaaaatgtggtactcagagtgtaaagattaaaggagattatagaaagggaagatcatacagagcacccttgacataactaactccatctttaaaaaagactccattttgtattttgtagggcattttgccaacaaaaatagcatgttttatttaataaacaaatttaaaaaaatgaaaactacatacaacaagataaaaacacaaacacacttttccactatcagttctcaccagaggactctgtaactataaaaaattaaaccttcaacaactcaaaacggtcgtcctgacaccttcttacattcactcgtgataaaaactggacatctgccaccaaaggctctgccatctcaaagagtctttcttataagacggcctgacccaaaccaagactccttttgtcttcttcaccatacccaccctcctttgttaattctttctcctatctctttttccttttgatgttaagtgttactttgttacaaaatatttaacctataacatttatattttctatattaattaagcatactattatgtatcgtttacaatactaactgatttgtggagtgacttgagcctgtgtgcctgcagctctaagaaacaagtaaacagaaagtactaaaaaaactgcctcttggcaaggcatggtggttcacgcctataatcccagcactttaggaggccgaggtgggcagatcacctgaggtcaggagttcaagaccagcctggccaacatggtgaaaacccgtctctactaaaagtacaaaaattaggcaggcatgctcgtgtgcacctgtagtcccagctactctggaggtgaggcataagaatcacctaaacctgggaggcagagcttacagtgagccgagatcgcaccactgcactccagcctgggcgacagagcgagactctgtctcaaagaagaaaaaaaaaattgcctccttaaaaacttcatgtaactcatggcttttatgataaaaaataatattaataaaagcctaacattgtaaaaagacacagacatacagaggcttatttctaaccttatagcactcgtgaaaatgctatagaaagtaaattatatactccaagcagacattcattcagctaacactaaacaacaagaatgcgatttgattcaggaaaaaatgctttgtaatcatttctagacaaaactgagtttcatgccagtaattttaaattaacttccgtgtctgacccttttgctgctggaaaccctcatagaggaagatcctcttcatgaggatggattgcttttgttgttaacagaaagattggaggacttttgccaaaatgtacttaatactggaattcaaattattcttttgtagttaggtttcagggagataaaaagttgtgtattatactcaaccggtcattcttttttaatgaactagtttgggatttttcttcagttactagaattttagaagctaacctaggtagataatttggatataggggtttcattttggttggaaatgttattagcagatataaagggagctaaatcagcaaataacgcaagttgaaaataggaataatggcacagctttaccaaggtggcatatttgatatggcagaacatgtattatgtgatttcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggtaaggaaaacataatactatcttgaatatgaaagctatttcatatttaagagcaagaaacaaaagggtaaaaatatatgcatcacttcaaatgtttgataaaacatatgtaaaacaatggtaaaagaattgtaaagctgtaataaactgaaaacaaaattctttctgcatttgtttgcttacttgattcattactccaaaaatatttattgaatgcagtctgccttttaatatctttatggaatgttttataatgaaatttgataaatgtttatataaaaatgttttcaattatcaaatagctgacttaggttgaataataagaggtattgttttacaacaaacaaaagtcacttgtttcttgtaggaggcaactaaatggatttttaatcaacatttaatagacatgaaaaaaacaaataatttatttgattaattgttaccgaatgtggaagttaaaacatattctgtcatctcatggtagagagctttggtaattatttagtctcaggaaagaaagtttgctaactcatagttgataatacaagcaaagctaagagagaagtttcacacatgtataactttaacagaagcaccatttgttccccaaaaggaaaacagctttattattgcttttctatcataaaaataataaaatatattgagatgtttaaaaaatgagtaatattgaaaggtgtttattgtagcaaaaaaatgaaaaactaattatatacattttttgtttaaaacaaaaaaatgctattttacaactgcttttatcatgaaacagtgtattttgtgcatcctcccatgtcattagatataggtctatttggctttcttggagtcttagtggtatcccatcatatggttgtgctctattttattttatttatttagactgcgtcttgctctgtcgcccaggctggagtgcagtggcgtgttctcagctcactgcaacctccaactccggggttcaagcagttctccccgcttcagcctctcgagtagctgggattacaggcttgcaccaccacatccggctaatttttgtattttttatacagacaaagtttcgccatgttggccaggctggtcttgaactcctgaccttgggtgatccatccgcctcgttctcctaagctctactttatttaactagtaccctactgaaggatatttgggttgcttttggctttttgctgcaagaacacacatgcacatctttgtccacacatgtgcaagtaaaccttcttgtggtccaggatgatcacttgaagccccatctctctcacgacagaaaaaaaaattaagataaaaatcttacctttggaggctttttcacttccatacctgccagatggagcaagtacttatgggagaagtggggaagagaagagaaacatgctaaaagagaaggaagccaaaaaaatagaacaaagaaaaaagtaagagggagggaagaaggaagaaagaaaggacacattttcctgactaccatattatacaaaaaatagaacttcagattaatcaagtgagaccattaagaagaatatagtagcaaaagcatcagcatgctgcttagtgagaaagccttgaagcaagagcgttttgcattgttcattgtaaatcttgatttctgtgtagagtatactctaatatactcttcaaacatctgcacgcattttagaactcatagaaaataggaactataagaaagcaaattgttccttttcagcaggtttaaacacaaagggtttattactgtatctacttccccttcttttgtctcagaaagatgtgggaaacttgaataaaccacaattggttatcctttccttcataggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtaggagtggaccagggaaataattgttttaccagcaaactcactggggaacaagcactgtgcctaggacctgaattataatgcaactgaaaggccacctctgtagggtcttgcaagcccagtcctgggagcaggtatggtgcattcattatgtgggtgttttccagccagcaatagctctgaatctgcccagaaacagagataattgttctgggaggactgccacactgtcctctcaaagaatgaggagagaatggagggaggatagggtgctcaaagaatggaggatggggtgtaggacctgtgaataggagaagtttaatagtgaatctgccacttcactgtggaaaccgagttgaattattaagtgtgagataattcaaagtatggcttatacaaggaaacattatcctttgtatctgtaagagtaaagacacatgaggattataaaaattgcctttaaatagattacttcaatatagagttaacatgatacttttcatggccagttaacagaaatcaaaatcacctacttaaggcatttttgcagcttggccaagggcagagacatttgaaaaagaaagacctatcttcaaatcttgttctctgccttacttgctttgtaaactgaccaagttaaaaaacctttctcatcacttctaagacagagaaaataatattcactcacagagtttatatgcatgaataacacacattatctcccataatcttcatgaacaggattgttataaagattatgttaggtaatacatgatattcatcagtcatacaggatgagccaggcatcattgtaggcactggggatacagcagtgaccatccctgataccttttctttttaaacgtaactactattagtaagagagctaatgaagagatttcaagttctgcctgcttctttagaattaaaagtttttactgatttaaattactttgctttcttttagacattggcactaagaataaagcgtatttctcatttgtatggcttgaatcatcttctgaacttgccacataacaatctgacatttcagagctgaacccaacaggaaataaataaattattgtggaagaaacgaatattattcatgataatacataagctcttgtcttgttttattctagatgccagaagtaaaaccttacttttaaaaattcctaacaggaaagtccaaacagagccatgattcccttggggaaaaagaggtccatgtatacttacagaaaaaataattggcttcagttacgttaagtttgatggcctcttgtggaatttactatatttatttgtagccattttctatcttgagacggtctcctgtcttagaattgtgagaaggaagtctctcttccttgcaaactgctgtaattgctaacagaagtagccctcttctacttttggttatttctatcaaggatatagggtatagtttttaagtatcctgacaagcattttgaaactatgctcctcactgtaaggtataaggacaacagccacagagttccctgattaatctaactagagttgtaactagatagtaaattaccttctatgccagccctcatttctacttttttttcacttctgattttgcttgagattacttcgagatagctgaaaataaatatagaagggtttcagatacacaaaatgtataatcgtagcctaccctatgagtgccaatggctttgaaagaatagtcagcgttatttattccaagactggattatactagggctttatttaattttattttctctctgtctttcttgggtttttggccatttttctgtttctctgtgtgttcatttacccattgtttcagcgaatatgtactggttatccagcatttgccagcatgggtgcgcagtggctacagagctagagggtacaatccctgtgaggaaagttcacatatggagagggagaagagggcacaatggaccaatgccagatttccatatgacgtgacgaagggatgcagtatgcacaaagggctgcaaaagcagatatggtaggcccctaacatcaggtaggggtgggtgtaggacttcttctaattagcctatttattgagcacctgtgatggccatcatgatgagcacttcttatgtactcattgctgagaaaaagcttatgggtggcattgccacctggttcattcattactgggcacaggtaatgtaggagtcaataaactagataaactcaaagggcttacatatgattaggggaaacaaagacaataaacaaatgagtaaatttatagtatttaagtcagtataataatgtgaaagaaaaataaagtaggttaaggggaagaagaagggcagtgggtaaggggtgattgctatttcttagagggtggtaggaatcagcttttctaataaggtgaggttttagcagggactgaaggaaaggagggacaaccacgtggttatctgcagagagattgctccaggagaaaggaatagcaagtgggagcatgtttgatgtgcttaaaggataatggaaggcagtgacattggaactaagtgagcaatatggagaataagaagataaagtcagagattaggagaaagacaggtaaagaagaaatctggagccataataagggtatcagcatctactctgaggggaatttctgaagatttgtgcctcctttcttttttcctttctcaccctcatcctttcacaattgaggctttgtgtaagaataatagggtcttatagttacaataaacatttggagaagaagaaaaatgaagctcttagaattagggggttatttctggactaaaattaactatctgctttttgcagccagcatcacagacagataaaaattgcctgtaacgacaacaataatgatgatgataatgataaggttaatacttagatttttgataatagcttgatttccagtggtctttcaaacaccaccgttgtttttacctgctggttcaacatcttggtttttataattgtgattagtatccattagatatgtaattgctatgaggaccccaagggtcctttagaagaaccgtttctctttactcttatgactattaatatcttggttttacattgcacaattttactgcattgatgtgacatttattgagtagtgacttgaggcaaaatactattttatgatgaggaggatataaaacgagtaaatgatcccaacatctttaaacaatttattataattcaaaaatatattgtttctacaaaaactatcttatatggtgaaaaaaaagagatgaaatgatatgatgagtcagtgtgcaaatctgggagtagaagtcaactgttactgtgttcataggactgtactgcctctcagtgcagtgcctcaatgtaatgggtctaaaccttgcgcatttcctgaaaaagaaagccatttctgggcgtatctgattaaccctgatcctccagaaggcctgagcaatgagaattctgctatatgacttaatttcttctatccgatgtaggctgtgattcttcctgagcatttatttatagtatggaaaatatattatgtctaggtggagaccattggcgatgcctattgtgtagctgggggattacacaaagagagtgatactcatgctgttcagatagcgctgatggccctgaagatgatggagctctctgatgaagttatgtctccccatggagaacctatcaaggtaaggcagatgatatattgtccaaaagatgtcacaagagcaaatgcgtatagttgattaccaaaaccatggtgtatcagttgggggttagttgagagagagagagaaagcaaaatctatatagagaacacaatcttctctaacttgtttacattggaagaaatttattatagggtattaaatggcttacagaatcattgagaggacagaagaacccatctataagttgggctttcaaaaaatgtttcccatagtatagggattttctattgtcaaagtaaaatggcttctaaaggcaaacttcagaacaactgcattttcaaaaatctggaagctgattccaaaactatcctaccaaagccacagtcaggaaactgccatgttcagaaagctgctgcctcttcaaaaccacatctactataataatcagcaagatggcaatcctgcatcatgacttacaaaatgagtgatgggaaaatggactctctactaagcatgctatagaaaacacaaaggcttccacaattgttcttgagttatagtggagattgtgcctgccgaatctcatgcaactgtgcatctgatttaccaagcctaactgcatttagaagctgcaagttagtttagaaaatgtagttttagttttccagcccctggaggagaggatattacatttgaatggatgttgactgttaattcaccaatattttccaaggcacgtgacatttcaaaatttctagatgagccagattccagactaatatctcaccacacatgaggaaataaagttaacatggtaggcattggtttaacagatagaatataagcagattacctttgtctcacagtgaatctgccccttaatttttataggacagtcctcagttgactaccttcagaaataagcctttgaggtattgtaaaatcttatccggtatgctataaaacatatagagaagaaagaagaaatttaaaaacaaaactatatttggagatttacccttaactctctttaaccttaatagaagccatatgtttaagccttcgtaactattttctaagtctattgtcatcccatttatatgtttctgtgcaacatacttttctaaatttaatggtataaaatcacaaacttttattatgcgtggattctgtgcatcaaaaatttggataagtcatagcaggaatacctcgtctgtgctctacaatctatgggacctcagctgggaataccgaaatgggtgagggtgcctggaatagctgggattgcaacgattgaagctggaggattcattccaagactgctgcttcacttacatgtcagattccttggtggggatggctgaaaggttgggttcagctgggattgttagcgttacatgtgatgccctaatatgtattttttatgaggtggttcatgtcccactgaacaagactggtggaagctgcatgacttagtcttggaagacacaccgcaacacttccactgcactctatcagccagagcaatcacaagtctgcccagaagagagagggctcagagcccaagaatcaataggaggagtgtaaaataatttgcaagtatgttttaaaagcatcacaatatctgactttttcagatttattttcgataattgcatttttttagaggaggactatatatttctttctctttctaatttgtttgagggggcttgtagcatcaatgtaaatgttaaaaatatctagactattaacaacattttaagtgattttcacacaaatacattttataattaagatgtgtatgtttggggtgggggaatttatggcatttttgttatttgcagaaatgtatttttagatttttctaagttggaagaattatttatagctagtttcaaagatagttacctgggtaatgatagattagtttaaaagacctataaagggaatcattaatcatacctttttatgcatactaacctgcagccctgggaaatatctgacgtccctaaaagataccggtgaaacatcacagaggcagagtggagagtatttttagtagggaaactttaacatgtatcagaaaggagcatattgtgacttaacatcgtctcatttaatccttataataacactttaaagaggcatctacactggcagacacgagcagtcaagtctcctatgtgtcagtatttggagtcatgtccatgtgacttcaaagcccaggctttttctgcttcttgccctgctacctcttggtatagaattgaagtgaaagaatagaaaatattttctttttttatttttcaaactctatgctttcctttagcacgtcacatgtgcaaatcattcatctattcatttattcccattgatttcctcactaacatccatccagtcaggcttagaaagcagcaggtgggttggtgacagagaccagtgggctgagtgtaaccgtgaaagtcagtaggtgacaagtgaacacggaagcaaacttctagtacccctcctttcctaagcctagaagcttatgatgagaaatgggctatgccacaagtggtctcaaatagaagatgcccttagtaggttcccattcaaacttttcccgggagccagaattctgcctttgcctttcattatttcacagggaagtctgttaccagtgaaaagagatatgctcagggcacgatgtgtgtcttaaacacgttgtgttttaaatcttgctgatgaatttgaaaagctctgtaagaaaatgttagggttgagagattcaaaactggagaaggggaggaaggcagcacggcatggaaggactaggagggacacttgccttgtctgcatcgtttcggtttttacgagcagaatatatttacattttaattatgaaacaagataaaaatgctatggtaaatttaatatataataagctggagtaactaagtataggaagaaaaactggtttaaccagaagagtgctcacagaaagcaaaaattcctcaatctaaatatgctgaagtcatagttgatatttatgagcagaagagctttattctatctatctatctatctatctatctatctatctatctatcacttgctaaatgtgtaaattaatattctcctaaaagagacaaagccagatatataacagacatctaagttttgcttgttaaagtaaaactttgatgaagaaaggtctttaaaaataatcaaacccctgcattttataggtgaaaacatgatcggagggaagtaaagagacttaaggaagccagactaccagttactagtagagcttgttagaatacaaagttcctgattcacagtctagtgcttttgtttgaaaattttgtagaactcatatgacatcttaaaagtaaatgagtctggaaagtttctagcagatatctgaaattagttattaaaactagacataactgaattcttctgatttctaaattatatccaagttactgagttcttggtcttcattcaaaacgcatacatctaatacaactttttaaaatggttgagtaaacaaagagtttgaaaataattaacatggtatcatcatcatttaaaatatctccactttagcttgttttgtagtagcagtaatttaagtgtttgtgaatcttttaagatcatcaagtaatcagacctttgaagattccattgttaaatatcctgctttggctaggcaaggtgacttacatttgtaatcctagcactttgggaagttgaggcaggaggatcacttgagcccaagagtttgagaatcagctgggcaacatagcaagaccttgtctctacaaaaaatttaaaacttatccaggtgtgatggtgcatgcctgtagttctagctactcaggaggctgagatgggaggatcatttgggcccaggggttcgaggttacagtgaactatgatggtaccgctgcactacagcctgagtgacagagcaagactctgtctctaaaaaataaataaaataaaacattctgtctcagtggctttccaaatcattggagacttccagaattcctaaaattttgccacaacacatcccagactgcctcttatatctaggcatggcacaaatctgatctttcatcagtatggatttttaatttcatgtatatagacattgtcatcgtcattggactcaagtaccttccactttctgcttcctctgtcattttctgcttaaatattacaatttcatttcctcagttgtaagtcattagaacagtgggatagtgtttggtataaagctattttgaggtaaaatgtctaaaagatatatttaatatccttagagctagcttcatttgcccttctttgtcagtgtttgggaaaatgattccaggagtccagaaattatgtctatctcacttgaatgagaggtggcagtttcacataaacagctcatatcccccttgctatgttgctgtggttactatgatccctgtgcatggaaacttgtttcagatgttgaagacagacacaattaagatggtttgtgtaataaacctaaatggaaaagagttaagaagtgtgactgttgattctgcactagtaatttttaattgcatgtgaggagtagagggaagttggctgaaggttttgaggaaaggggtggtgtcctgagggtgaatggtaaaataatttagacggtattcaaacgacactgacgagtaggaagtgttttaccagtgactgggaacatcatgttattttttgctttcagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcttcataacttttttcttccttagtcgtaaggaaaaaagaaacgtgataacttttatcatcctcactttaacttttttacactgcttattagcctcctaagaatgacttgcctgaggtgtttgtggcccagccataaatccatgacagatattacatagtcttccatcattcttcttttagaagcacatattaatactcttagtatgttgataggtgttctgacatcaactagtacactgcagtgcagttctggcagtaaacacccagactcagcacagtcataaccacaagttacagggcacagaacccaacaagcctgcccttaattcagatgccagccacccttcaggacctaagtatgcatttagacgactgagctacaattttgggggttcccatgaacctctcaagttagataattatctaaaatgactcacaatacttagggaattgctatacttactattacagttttatttcgaaggatacaaatcagaaccaaccaaatgaagaaacagtttgggtaaggtttgggagggtcccaaatgcagagcttccatagaatcagaacttatctccctccagccacctcagtgggttcacaagccaggaagctccacctgattgagctttgagtttggtgtatggagtcttattgttttcattatgtaggcatgattcgttgaatcattggccatgtgattgaactcagtcaccacccccactctcctccccagaggttaggctaacacaaaaccccaaccttctatccacaagattgatttttctggggccctgcccccattctgagtcatctcattaatataaactcaaaagtgatccaagggcctcatggaaaacagatactcctataactcaaaaaatccaagagttttagaagctccctccctgcaatcaaggacaacagccagtcaaattccctatcatacagggaagaatttaccagaggaaaactagctggtcatcgagcacttttcaaagattgcagttttatggactggcagcaagtgttaacacggtcagaggagccacgtgtcatctagcatcagaagaacctttattttcactgtcgccttgacaacatgtagtatacagcctgagtcaataaaatctaccattttgttatcacttatccacctttaaccggaaaataaaccaatccgtggtaactagaaatatatctttcatgtacattttgtctcattatattggaaactcttaagtaacaaaagagtttttcagatctatacagtagctaaattatactaagcaagttagctttcctattctcagagataactctttaatagcatcttctcccttcttcttctgcatttatttatttatttatttatttatttatttatttatttatttatattttttgagactaagtcttgctctatggcccaggttggagtacagcagctcagtcttgcctcactgcaagctctgcctcccagtttcaagtgattctcctgcctcagcctcccaagtaggtgggattacaggcgcccgcctccacgtctggctaatttttgtatttttagtagatactgggttttgccgtgttggccaggctggtctcgaactcctgacctcaagtgatctgcccaccttggcctcccaaagtgtaggattacaggcgtgagccaatgcacctggtcttctcccttcttaaggcaccagcatcctttcctttccagcccagactctcagttgataatcttgcctcatatttcaccaccagaatagaagtcagacaggagctttgccatctttgtgctgtaggttctctcagcagagctaccccagtactcatctcctccttctttgttcccattacattggcccagctcccctcctgcccctggttgatacagttttactctcagtgctatttcctctcaccttctcaataacttttctgtggaaattaactctctatgatcaatttctctttgatgaaatgattattcccaacagaatacaaccatatctattaaagctctgaattgaaaaataaaaaattccttgtttccaagtccggcttctgctacaattttcaatttctgctctgttttatagcaaaactgaaagaagttgtctatactcactatctgtattttttccacctcttattttctcttcaactcactccagtcagtgtttactccactcaaacggttcttatcaaggtcatcattgtgccctgctaaaataaaatcactgtcagttttctctccttatcctctcagaagcatttgaataggctgagaactccctcatttaaacattttcttctttaaatttttggcaccacattcacctagttttctcactaccccatgtctacaccttctcagtgtcttctcttggtactccttccctaccaaacctttgttgccgtgctcagagcctcttttcctgttatcttctgtatctgaacttttatgactctaactattttttaaaaaaaatctttcgcccatcctgtgattctctgcagagctacagactcatatatcctattccatatttccacttggatgactaattcacatattaaaatgaactggaccgaattagaatgagtgatttcccacacagactgatgaaatccacttcccacccaggcaagcttaccaatcaccttaaaatgatatcaccatccacctagttactcagaccatcgaccttacagtgatcatttcttctcctctctttaaagagacactccttaactatcataactatagcaacaaccttctcctcacataccctctcattatcctatttcatcttctcagttcacacctgtatctgaaattgtcttatgcagtatttatttatgtgttgattgcctgcctccctttttagaatgttagcttcctgtggtacacattccatattcccagctcctagatcagcgcgtgaaacacagaaggaaagcaagaagtatttactggttaactgttgactcctgggtatgaaaacaactcagtataacctgagaattggaaaaatccctggggttcattgtaatggtaattggcctatggtcctactgggtataataggtagggataagaatccatgccttgagataatatgattctactctctctgtaggcattaagaggaatcatcctattaagtaggagtcagttgcccatcctttcactgacacctgtgtttctctttcaatgttaagtgatgtgttatgtgtatatgtgcatactgaggaatcctaccttaaaacaaaactgctacatataaaaagcatattttcctttttcttctatattgattgtttttaacagtatgaaactaaactttttaaattcttgcattttgtatctcaaagtctggtggtcttgagtcatgttagggggcactgatattagctacttatttttcttcaaaatataattcaggatctcatgtatttcagcagaggaccacaacatgttgacatatatttctgacaacaggacaatgctcatgacttaagtcttagattcactgtattggcaatgttactagaaatgcacatataggtttttatagcatagatggtgttatcttttaaataaattttttattactgtggtaacacatgcccatttcagaaaatttacaaaattagtaaattataaagtaagtaataggaataagtcataatctcattacccagagatagtaactattaacatttctgtctttgtttcagttacgtttatatacacatgcatgaatgacattgaaattttaatttaatttatattgaacttcagctcatttgctgaagtcatttctactttttatagacaaatatgatatagcttttttccttttgtattgatttcaataatagtttactttctttttattctcgtatatgagatatttatgccttgcctaagggaaagcagtagttaatactgtcttatttaggcaaaatataaatacttaatgttaaatacttttaacaacattttaaattcctttctttcagagatacttcacttttcttccatatgctgggaaaacttaaaataatataaataaatttcaattaaacatccaatgctttgggaaatttagtcaacggtaggggcataattttagttttactcaaactatagtacaagaagcggctgctaaagaaggtgtacaagcacaaaatgcagttttctttggagagctttattgatgatacattaaattctggaatgatatttctttaataataaaataatctgtttaatattgaatgtagcttccatgatatatttctgaaatacaggtaaatttaggacacagaatacatacctataccaaaaaaaaacctgtatcttcaaatttccacttccaaattctaatcagtgattcagaatgtagcagtgtaatgacagttatacactcctgttttttaaacattgtcaggagttttactttaattttaggggataatattcgacattttgtttgcattcttgaagtaaggaaaactaatagagactagtagagactacattagatcagtgagtcagtggatccaggtctactacattagttccaggtcagtgggtcaatgttagaggattatgtggtgatccagggatcattagaaacaaaaatggcaagtggggaggatacatggatgctgtccagtttgtggggtaaacaggcctagaatctcttatttgtaggacaagtctgagcacattgtgctagagaagcaagaattgacttctgtaagaagaaggaacaaagtgaataaaggaatataggaaagataacagagaattggagcattgatgcagtaatttgcggaaaaatggtgtctggtgaagaaggtgtagagaaaaatgtccacctatgaggacatctgggctgttgctgccttttttgggtgttgctatcatcaagctttcatcgaaatggtttgtttttctaaatggtttttcttatatattctgattttttaaaaagacaatataatgaacatttcaaactccatagcattctaattatgtttgtctgttaagtgtctttaaaaagcatagaagttgtattcagaagacatgccttagagtcccacaaacagcacttaccagacgtgcaatctagagcaatgcccttaataaattcaaatgatgcactttaaagccacttctaaaggctgaatatatgtatataatacatttaaataggagattataattgtcattaccgtatttagtaggaaatgttgagttgctgtagatagaaaaaataatagataaatttttttaatcacctatagttttatacatttttatttattagactcttatagttgcatacatttttgtatttaatttttaaacatataaaaaaacaaagcaaacaagatgacactcatgtagccaatactaatatttaagtatcaacattttgccatatttctttcaggtttctgttttataaaaaaataaaatgtaaagtaaatagatattaatataataaaatataaatagaaactcttacatggtccctgttacacgctctgacacaatggatcctaagtgctttatagcttgtaggagctgagaatatgtactctctgcagacagtctcccaaatacagatgcatgttcagcagcttctccacaactcatcaataagatgtcacttctgctttccaggaaggaaaatgggtagagagaggcaggaatatcactttcatttaggtcctgccagatagaaaaataaagccagaggaaaatagattcccagtgaacatatccatatccttttaagacttgccttgaatccactcagtattatgtttctgagatagtttccttgataaaatgtaaatctagtcataaatctagattattcattttaactattgctaatggagtggtttgctggtaaaccagctttggaggatgaggtagagaatccatgattccagcatttgccaatttctgtggtgttactatgtccactctggcaggtttcaggctatggatggcttaactgtcttacaaagttcctgaattttaacaattggctctcacaagccagtatgaaccagatctagcatgttactatatgtgcatgtgatataatgtgtattctagagtatgaatgagccagactctatcttctacctgtgggtaattagagtgtgtccaatttttcattattacaaaaagtgattcaataggtatctttatacatatgtctttagataatataactaaaaatggtattcccagaccataggctatacccagtttcaactttaccaagcattaattagctgttcaaaatgattttaccaatctatgctccaccagtagtgtatgaagtgtgctattctccaaggtgatattgtcagacttactgttaccaatatgataggtgtggtgtgatttctaattgatgcttagtcagtttttaaaaattgatttattcaattttcacaactgtcctaaggaatatgtactattattatccccattttaaaggctggataatggacatctgtgctgctagagctatcagactttgaagcttatacttttaatactgtctaattctataccttttcattatgtattctcaaataatagtcactcaaaaatatttataaattcatgactaaggcatcattttcattagttttattgtttagcagattacatatttattgatgtactgatgaaaattaaactgtcattcttgagacagatttctattcagttggtttcttcaatacatagatgttgtcacagtaccaaaatctaattcaacatcatcattctatttaatgtagacatgacattacagactagtgagtagaagaccatggtctgtttgggtaaatataataaatgcttttctgtagaaattggttgagaacccacagccatgcaacatttttcatctatggcctgaatattaggttagagagaaggcttattaagttctcatttgatggaaagctagggaagcaaatggaaagagatgccaatagcttaatcagtaagattagaatttgaaataggtttagcataatgaacaagtagtaaaatagcaaacaatataatgtggtaaacagatgaatttcaggagaaaaaatattgctaataacaattagtaagtagagtggtgatatgtacaattaaatctcatttgagtcctactaatctagaattcataaaaattctattgaaagattcaaaagttgttctcacatcatttttgtcattgtaattttggttcactatttcttgcccatgattacgttttatgcccacaattagcataatatttacaaaattaatgaattgataaatggacatcttacctctttcaactcaggaaatcttaatactgttatggttatgtgtgaatactttgctactattaaatctttggattattttttcactactgcaaattgcactgttgtgtggatattatttttgcaaaaatattttataattttttccagtgtaagtgaaatacattaattgacacaattttcttgttgtgaattgattcttcattgtacttctgggaagatgtctgttaatctcgttagactttttctgtcactcacacctaaaatcactggtttataaatattctcagtaacattcagttagttatgttgtgttctttttttgagtggacaaacatttatgtcagtattatattttaatattttcagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacatattttcacagtgaagttaaatcatctgtgataggttccccagaccagcctacaaaggcccattaaatacagaataatttgtggatcttcaaagaggatgaacatacatttccatgacagagtccatacgaaattcacaatttagatgctaaaaaatttaaggaatatctttttttctctatcttatctgctttgaagcatagcgattagcgagaaacttttcagatccagaccactgatggtagccagagtagagaccctggagcatagattcttaaaataaataaggggcccaagtcagagctttgaggtattgaagatggaaaaatagtggacaaacagcctgtaatcaggttggggattacgggtactgagttatgttgccatttaactattctaaaaaataagactgggtctcaagactgcttccctaacagactgtttctcctgaaaatgcaggagctattctttctgttctggttatatagtttccattcatggcttcttgtcctgttgttttttgtgtcgagtacactatataaattatctccttatacatatttctcaggcaagcacagagttatactgaacttttctaaagatgctttgcatcaagaagcaaagggaaatacagaattaaaatgtttctttccattttgctttgtttttctatatcgatctagactttgtaggaaaatgcaaagcgtatatttaagaaaacctaaataagaatagattcatttactcattttcatttattcattcatgaagaatttattgaatgcctactatgtgccaggaatattgctatatttttgaaatttaaggataaaatatggcccaatctatcaagaaaggaaagtgaaagacaaatgtaagacataattacaacattctgtgggagcacaaagtaggggactcagttcttagagaagtcttttggtcttagagttcatcaagcagagaaggggaaggacatggtccaggaaaataaatcagcacacaaagagatggggtcttgagggtgcatagtacattctggacagccagttacctgggatgagttgggagggaggagaataaggacaaaagaccatctgggcaaaaatcacgaaggggtatgtgtgtcatgtaaaggtgtgccatgatagttattcatattgctattgtaatattaatatatagtaattaactacacatgacacagctttacatgaccttaagtagttatcaacattaccataatagtaatattaataactacaataagagccattattattcacttgaggcacttgttcaaaatagattttacaaaagaaaaaaaaaaaagaagcaacatgagtaaaattagatccattggctactgactccctctccaacagttttaaagctactagataagagaagcatcaagtcttaaaggaagagaatggtatgatcagatgtgtgttttccaaagactattagaaacagcatggttaaggatagggtggatatttacttgcacaggtgactgaatgaacatctgtttatacatcaagggaaaatgattcattttatatcctggatattttaccataagtatgagcataaagctgggatgtctggcattggaattttatgtcactctcaaggctaattagtctttcagatcctttggtagggaggaaagaagagttgcttcagcattttgactaacatttcttccaaatttcttctccctgatatttccagccacgccaaggcaaagacttcccagctctgtctcaggttaggttaaaagaaggcataggatggaagagggtggtctgtggtaggcctagcaaatgaaagagatgaataaacaagagtgtctagtctaactagtgcctgaggaatagacatcagtcctctgagattacccagctggaaaactgcccagatggagctttacatgcaaagctccagtgaagtctagtgctgtataatgctttaaatccacaatcaagcccttgttgatgcaaatgttagtcgcccaaagcagaatgggttaacgaattactgcagtggttttaggtgcatgggtttgacccatgtaaatcattttaataagtaaaattgaatctttgatacatatttgttgaggagcttgtcagatcactacctttcactgaacagtaaaacatggatcatttatttcacctcattttgcacttcaatgcaatttcactctttaggtggttgtacttggacagttaaatgaagactgtctttaagggtgcagggatggagaacacagcatatatgagaggtgggagggcagagacgccttgcgattcctgtgaggagggacttaccgtctcctccaaaacagaaattcagtgctgcagagacggtagcaaagtgcagttctcttgttaaaacacaggctaaaagcagtgactgcttaacttattaagcagagaaaaccaaaatgtcattttcaaccaaaattgagtgttagagtttatggtctctgttatgatacttttcaagacctgggaaatatttgtatcctttagtgaaaaggggaagaatcaattactgaaagccataagcttacagtaacggagccaattaatcctttgtcatctttgttgagtttagttttcttctgttcttagcacgtcagctagtagatctttgatgaactgttgctcctctttaaatgtttcttttattatattgatgatgtgcactcattcagtattcttattttaagctgcagtaatcactgtacatttgattgccatctgtacttcccttgaagcagctttgcttattacagccacacctgcatctgttttgactagcccacataacctacacatttttcatccaaagctatcccattaccttatttatgtccatttattttcatatatagtatctgccaaaatagtagcaaaagttttatcaatgtgtagatttcaatcagaaaaacctaagcaaaaggaaaaaaaagtgatattctaaaagccacacttcttttatcaccagtgcagttttttccatcatcataaacttagttttatgaaaatgttaatatcttggatttaaacattggggtagaaatcaggacaaaatttaaatgtcatatccaggacttaatctcagatattctggtagaagatatttagataaggttgtggctgcctgtcaagttttttaattttttaaattatataatgtcagaaaattaaatcacaaatgagccttccagattgtgaggaaaattacttggctgaaaatgactttgcataatgcccaaatcttgaagtatctgctcagatgtttgttccatctgaaatgctgccaaatccatctgtattgaggaaagagctatgaggtagtttcagagaaagtgaaaacaaaacaaagcaaaacaaaaatgctattacagaagttggacagcccaatgtgttaagtattatacacctggaacaagagcagcaaaactgaagctctttggaaagttatggcaacagtggtctgggaattctgggcctttagaaataatcattcccagtgatacagggatgtgcagcatccagacactgcttaatcacagtgagctgccgtcttccctgaataagttgtatcttataacattgaagtgaatgaaaatgtattagtatttgagaatttactattccttcacctccttgcacatgtaaattaaagatgttttggaaaatatgagaacttgatgttcactgccctagagcactattctccaaccttttagattcctgcaatctgttaataaaatattgtaggacaacaactctatagactgatacatgctgctctcaatccatatactacatattaggacagcttttcttttctaaatgagcatgaatataaatagaaattctagtattttcttcacctaccccagtgaatcatctttatattttacttgggaaactgctacagttggctagtgggtcttcacttttattgctttgagaaatggataaaagacatagactatcacccctccaaaaatgtgcatatggccccatacaagacacatgtactgccagagcttggggaactccctagaatctactcctagaccaccctagtgaagtaccatagaccatattgtctagatgggacaaaataataaattttgactaagaacttactgtttagagagaaaaaatagtaaataatgttcaaaatgagaagacaataactgacaagtctgtgatttttgggttagatgagaccacttttgatttttgaggaataaaaggagttagttttttggtcctgatgtgtaaaatgattcatggggtttcacatacagacaagtagttttcttttcagcaaatatttaacatatctctcaatatatttttcaccagtttttggtaaatatgcattgctataggtataccaagttttttttgttatgtttagtaactaatttcattttttctgtatatgtaaatatagctattggaccctgcattgaaaaccttcttagtactaacaacactccttttattattaccttcatagttactttaaatgacatatttatttcgagttttacttctggctgagttgcaaagtctatgagaatgttacctcctgtctcagaagcttgttagttattgtgccacctaaatattgtaataaaagtgtttaaataaaaatcttcttaaaatttaaaatga

(The sequence listing continues in the following parts.)

What is claimed is:

1. A method of making an engineered population of primary cells comprising:
   a) introducing into a population of primary cells a ribonucleic acid encoding for at least a portion of an exogenous functional T cell receptor sequence or encoding for at least a portion of an exogenous functional chimeric antigen receptor sequence;
   b) reverse transcribing said ribonucleic acid, thereby producing a deoxyribonucleic acid encoding for said at least a portion of an exogenous functional T cell receptor sequence or said at least a portion of an exogenous functional chimeric antigen receptor sequence; and
   c) introducing said deoxyribonucleic acid into a genomic break comprising at least a portion of a cytokine inducible SH2-containing protein (CISH) gene in a genome of at least one cell in said population of primary cells, wherein said genomic break is performed by an endonuclease and partially reduces or completely suppresses expression of said CISH gene.

2. The method of claim 1, wherein said endonuclease is from a system selected from the group consisting of CRISPR, TALEN, Zinc Finger, transposon-based, ZEN, meganuclease, and Mega-TAL.

3. The method of claim 2, wherein said endonuclease is from a CRISPR system.

4. The method of claim 3, wherein said CRISPR system performs said genomic break in said genome of said at least one cell.

5. The method of claim 1, wherein a polypeptide encoded by said exogenous functional T cell receptor sequence or a polypeptide encoded by said exogenous functional chimeric antigen receptor sequence binds a cancer neo-antigen.

6. The method of claim 1, wherein said population of primary cells comprises cellular viability from 50% to 100% following said introduction of said ribonucleic acid to said population of primary cells.

7. The method of claim 1, wherein said ribonucleic acid comprises a nuclear localization sequence (NLS).

8. The method of claim 1, wherein said population of primary cells is a population of human cells.

9. The method of claim 1, wherein said population of primary cells is a population of T cells.

10. The method of claim 1, further comprising introducing a reverse transcriptase.

11. The method of claim 10, wherein said reverse transcriptase is selected from the group consisting of: Avian Myeloblastosis Virus Reverse Transcriptase (AMV RT), Moloney murine leukemia virus reverse transcriptase (M-MLV RT), Human Immunodeficiency Virus (HIV) reverse transcriptase (RT), and derivatives or combinations thereof.

12. The method of claim 10, wherein said reverse transcriptase is functional at 37 degrees Celsius.

13. The method of claim 1, wherein said ribonucleic acid encoding for at least a portion of an exogenous functional T cell receptor sequence or encoding for at least a portion of an exogenous functional chimeric antigen receptor sequence is a mRNA.

14. The method of claim 1, wherein said ribonucleic acid encoding for at least a portion of an exogenous functional T cell receptor sequence or encoding for at least a portion of an exogenous functional chimeric antigen receptor sequence incorporates a unique sequence.

15. The method of claim 14, wherein said unique sequence is selected from SEQ ID NOS: 1-4.

16. The method of claim 7, wherein said NLS is from a BMP2-OP1-responsive gene (BORG).

17. The method of claim 1, wherein said ribonucleic acid encoding for at least a portion of an exogenous functional T cell receptor sequence or encoding for at least a portion of an exogenous functional chimeric antigen receptor sequence comprises a secondary structure.

18. The method of claim 17, wherein said secondary structure comprises a hairpin.

19. The method of claim 1, wherein said reverse transcribing occurs in a nucleus of said at least one cell.

20. The method of claim 1, wherein at least a hundred copies of said deoxyribonucleic acid are detected in a nucleus of said at least one cell.

21. A method of making an engineered cell comprising:
   a) introducing a genomic break in a cytokine inducible SH2-containing protein gene in a genome of said cell, wherein said genomic break is introduced by an endonuclease;
   b) introducing into said cell a deoxyribonucleic acid encoding a construct comprising:
      (I) at least a portion of an exogenous functional T cell receptor sequence, or
      (II) at least a portion of an exogenous functional chimeric antigen receptor sequence,
   and at least one homology arm, wherein said at least one homology arm binds to a nucleic acid sequence adjacent to a genomic break at:
      (i) said cytokine inducible SH2-containing protein gene; or
      (ii) a T cell receptor alpha gene or a T cell receptor beta gene in a genome of said cell;
   such that said exogenous functional T cell receptor sequence or said exogenous functional chimeric antigen receptor sequence is introduced at said genomic break.

22. The method of claim 21, wherein b) comprises introducing said exogenous functional T cell receptor sequence or said exogenous functional chimeric antigen receptor sequence into the genomic break of a).

23. The method of claim 21, wherein said construct comprises a viral deoxyribonucleic acid.

24. The method of claim 23, wherein said viral deoxyribonucleic acid is an adeno-associated virus (AAV) deoxyribonucleic acid.

25. The method of claim 1, wherein said deoxyribonucleic acid is introduced into said genomic break in at least 15% of cells in said population of primary cells when quantified absent a selection step.

26. The method of claim 1, wherein said population of primary cells comprises at least about 80% viable cells as measured by fluorescence-activated cell sorting (FACS) at about 3 days after said introducing said deoxyribonucleic acid.

27. The method of claim 1, wherein said ribonucleic acid encodes for at least a portion of an exogenous functional T cell receptor sequence.

28. The method of claim 1, wherein said ribonucleic acid encodes for at least a portion of an exogenous functional chimeric antigen receptor sequence.

29. The method of claim 21, wherein said construct comprises at least a portion of an exogenous functional T cell receptor sequence.

30. The method of claim 21, wherein said deoxyribonucleic acid encodes for at least a portion of an exogenous functional chimeric antigen receptor sequence.

31. The method of claim 29, wherein said at least a portion of an exogenous functional T cell receptor sequence comprises at least a portion of an intracellular signaling domain sequence.

* * * * *